United States Patent 12,747,451 (RNA ENCODING AN ANTIBODY) - sequence listing, part 8

SEQ ID NO: 40001 - RNA, 438 nt, synthetic construct
  misc_feature 1..438: note = derived and/or modified sequence opt5 from anti-HIV_cap256-119-143998_VR-Chain
  source 1..438: mol_type = other RNA
caggtgcaactggtcgagagcggcgggggagttgtgcagcccggcagatccctccggctgtcttgcgccgctagcgggttcacctttcgcaactacggaatgcactgggtgagacaggcccctggcaaggggcttgaatgggtcgcgtccatctctaatgacggaagcaaaaagtatcatggcgattccgtgtgggctcggttcattatctctcgcgacaacagcaaaaatacactgtttctccagatgtccagcctgagagccgaggatacggccctttacttctgtgttaaggaccaacgggaagatgagtgcgaagagtggtggtctgactattacgattttggccgcgagctgccgtgtagaaaatcccgggggctcggactggctggcattttcgacatgtgggggcacggaaccatggtgacagtcagctct

SEQ ID NO: 40002 - RNA, 438 nt, synthetic construct
  misc_feature 1..438: note = derived and/or modified sequence opt5 from anti-HIV_cap256-119-143441_VR-Chain
  source 1..438: mol_type = other RNA
gaggtgcacctggtcgaaagcggcgggggactcgcccagcccggcagatccctgcggctttcttgcgctgccagccaattcaactttgcgtcctacgggatgcattgggttcgccaggctcctggaaagggcctggagtgggtggcctctatcagcaatgacgggaccaaaagatatcacgccgaatccgtgtgggatcggttctctattagcaaggacaactccaaaaatacactctttctgcagatgaacagccttcgcgtcgaggatacggctctgtacttctgtgtgaaggaccagagagaagatgagtgcgaggaatggtggtctgactattacgattttggacgggagctcccgtgtcgcaaatccagaggcctgggcctggccgggatcttcgacatgtggggacatggcaccatggttacagtgagctct

SEQ ID NO: 40003 - RNA, 432 nt, synthetic construct
  misc_feature 1..432: note = derived and/or modified sequence opt5 from anti-HIV_cap256-119-141307_VR-Chain
  source 1..432: mol_type = other RNA
caggtgcacctggtcgagagcggcgggggagttgtgcaacccggcagatccctccggctgtcttgcgccgctagccagttcacctttaatcgctacgggcttcattgggtgagacaggcccctggaaagggcctggaatgggtcgcggggatctcctatgacggacgggataaataccacgctcatttcgtgtggggccgctttattatctctagagacaatagcaagaacacactctatctgcagatgaactcccttcgggccgaggatacggccctgtactattgtgttcgcgacctcagagaatctgagtgcgaactgtgggagagcgattactatgacttcggcaaacggctgccgtgtgtgaagccccgcggggtcgctggaacctttgatctctggggccaagggacaatggtgaccgtttccagc

SEQ ID NO: 40004 - RNA, 432 nt, synthetic construct
  misc_feature 1..432: note = derived and/or modified sequence opt5 from anti-HIV_cap256-119-140896_VR-Chain
  source 1..432: mol_type = other RNA
gaggtgaagctggtcgaaagcggcgggggactcgttcagcccggcgggtccctgaaactttcttgcgccgctagcggattcaccttttcctactatgccatgcactgggtgagacaagcgcctggcaaggggctggagtgggtggctgtcatctcttacgacggaagcgataaatattacgccgactccgtgaagggccggttcacaatttctcgcgataacagcaaaaatacgctccatctgcagatgaactcccttagaccggaagacaccgccctgtatttttgtgctcgggatctccgcgagagcgaatgcgaggagtgggaatcttactattacgacttcggcaagaaggggccctgtgttaaacctagaggagtggtcggcgtgctggatatctgggggcagggaacactggttaccgtgtccagc

SEQ ID NO: 40005 - RNA, 432 nt, synthetic construct
  misc_feature 1..432: note = derived and/or modified sequence opt5 from anti-HIV_cap256-119-140090_VR-Chain
  source 1..432: mol_type = other RNA
gaggtgcagctggtcgaaagcggcgggggactcgttcaacccggcgggtccctgagactttcttgcgccgctagcggattcgccttttcctcttactggatgacctgggtgcggcaggcgcctggcaaggggctggagtgggtggctgtcatcagctatgacggatccaacaaatactatgccgattctgtgcgcggcagattcacaattagccgggactccagcaagaatacgctctacctggaaatgaactctcttcgcccggaggataccgccctgtattactgtgctaaagacatgagaggctatgaatgcgaggagtggacatccgattactacgactttgggcggccccagccttgtatcgatagccgcggagttgtgggcaccttcgacgtctgggggcagggaacaatggtgaccgtttcttcc

SEQ ID NO: 40006 - RNA, 438 nt, synthetic construct
  misc_feature 1..438: note = derived and/or modified sequence opt5 from anti-HIV_cap256-119-140037_VR-Chain
  source 1..438: mol_type = other RNA
caggtgcaactggtcgagagcggcgggggactcgttcagcccggcagatccctgcggctttcttgcgccgctagcgggttcacctttgacgattacgtgatgcactgggtgcgccaggcccctggaaagggcctggaatgggtcgcgtccatctctaacgacgggacgaaaaagtatcatgaggaaagcgtgtggggaagattcacaatttccaaagataattctaagagcaccctctttctgcagatgaactcccttcggatcgaggacacagctctgtacttctgtgttaaagatcaacgcgaagacgagtgcgaggaatggtggagcgattattacgactttggcagagagctcccgtgtcggaagtctcgcggcctggggctggccggaattttcgatatgtggggccacgggaccatggtgacagtctccagc

SEQ ID NO: 40007 - RNA, 432 nt, synthetic construct
  misc_feature 1..432: note = derived and/or modified sequence opt5 from anti-HIV_cap256-119-139135_VR-Chain
  source 1..432: mol_type = other RNA
gaggtgcagctggtcgaaagcggcgggggagttgtgagacccggcgggtccgtgcggctctcttgcgtcgccagcggattctcctttcgctcttacggcatgcactgggtgagacaagctcctgggaagggactggagtgggttgccagcatctcctatgacggccgggatttctaccacgcgcgctctgtgtggggcagatttaccattagccgggacaactccaaaaatacacttcatctgcagatgaacagcctccgcccggaagatacggctctgtatttctgtgccagagaccttcgggagtctgaatgcgaggagtgggaatcctactattacgattttgggaagaaaggaccctgtgtcaagcctcgcggcgtggttggggtgctggacatctggggacagggcaccctcgtcacagtgagctct

SEQ ID NO: 40008 - RNA, 438 nt, synthetic construct
  misc_feature 1..438: note = derived and/or modified sequence opt5 from anti-HIV_cap256-119-137881_VR-Chain
  source 1..438: mol_type = other RNA
caggtgcaactggtcgagagcggcgggggactcgttaagcccggcagatccctgaccctttcttgcgccgctagccagttcacattttccaactacgggatgcactgggtgcggcaggcccctggaaaaggcctggaatgggtggcgtctatcagcaatgacgggaacaagaaatatcatggagattccgtctgggctcgcttcacgatttctagagacaatagcaagaacaccctctttctgcagatgtccagccttcggacagaggataccgccctgtacttctgtgtgcgcgacagacgggaagatgagtgcgaagagtggtggtctgactattacgattttggccgcgagctcccgtgtagaaaattccggggcctggggctggccggaatctttgacatttggggccacgggacaatggttaccgtgtccagc

SEQ ID NO: 40009 - RNA, 432 nt, synthetic construct
  misc_feature 1..432: note = derived and/or modified sequence opt5 from anti-HIV_cap256-119-137643_VR-Chain
  source 1..432: mol_type = other RNA
gaggtgcagctggtcgaaagcggcggggacctcgttcaacccggaggctccctgagactttcttgcgccgctagcgggttctccttttctagctacggaatgcactgggtgcggcaggcccctgataagggcctggagtgggtgaccgtcatctcctatgacgggtctaacaaacattacgcggatagcgtgaagggacgcttcacaatttccagagacaatagcaaaaacacgctctatctggaaatgaatacccttcgggctgaggatacagccctgtactattgtgccaaggacctccgcgaatacgagtgcgaggaatggacctctgattattacgactttggcagaccgcagccctgtatcgattcccggggcgttgtggggattctggacatctggggacagggcacaatggtcagcgtgtcttcc

SEQ ID NO: 40010 - RNA, 438 nt, synthetic construct
  misc_feature 1..438: note = derived and/or modified sequence opt5 from anti-HIV_cap256-119-137170_VR-Chain
  source 1..438: mol_type = other RNA
caggtgcaactggtcgagagcggcgggggagttgtgcagcccggcagatccctccggctgtcttgcgccgctagcgagttcaccttttcccgctactctatgcactgggtgagacaggcccctgggaagggacttgaatgggtcgcggtgatcagctccgacggctctaatcagttccatgctgatagcgtttgggggcggtttacaatttccaaagacaatagcaagaacacgctgttcctccaaatgaactctctgcgcatcgaagataccgccctttatttttgtgtgaaagaccagagagaggatgaatgcgaggagtggtggtccgactactatgatttcggacgggaactgccgtgtcgcaagagcagaggcctcggcctggccgggatttttgacatgtggggacacggcacaatggtcaccgtgtcttcc

SEQ ID NO: 40011 - RNA, 432 nt, synthetic construct
  misc_feature 1..432: note = derived and/or modified sequence opt5 from anti-HIV_cap256-119-136616_VR-Chain
  source 1..432: mol_type = other RNA
caggtgcaactggtcgagagcggcgggggagttgtgcagcccggcagatccctccggctgtcttgcgccgctagcgggttcaccttttcccgcaacgccatcaattgggtgagacaggcgcctggacggggccttgaatgggtcgctgtgatttctgacgatgggagcctgaagtactatgccgactccgttaaaggacgcttcacaatctctagagataacagcaagaatacgctctacctgcagatgaacaatcttcggccggaggacaccgccctgtattactgtgtgcgcgatagacgggaatccgagtgcgaggaacgctggagcgactattacgattttggcaaacaactcccctgtgtcaagcctagaggcgtggctgggattttcgacatctggggacagggcacaatggttaccgtgtcttcc

SEQ ID NO: 40012 - RNA, 432 nt, synthetic construct
  misc_feature 1..432: note = derived and/or modified sequence opt5 from anti-HIV_cap256-119-136206_VR-Chain
  source 1..432: mol_type = other RNA
caggtgcaactggtcgagagcggcgggggagttgtgcagcccggcagatccctccggctgtcttgcgccgctagccagttcacctttgggcgctacggaatgcactgggtgagacaggcccctggcaaggggcttgaatgggtcgcggctatctccttcgccggaacgaaaaagtattacggcgactctgcccggggccgctttacaattagcagagataactccaaaaatatgctgttcctccaaatgaactctctgcgggctgaggacaccgccctttattactgtgctcgcgatctgagagactatgaatgcgaggaatgggaggcctactattacgattttgggcgggtgggaccgtgtacagacccccgcggcgttgtggggatcctcgatgtctggggacagggcaccctggtgacagttagctcc

SEQ ID NO: 40013 - RNA, 438 nt, synthetic construct
  misc_feature 1..438: note = derived and/or modified sequence opt5 from anti-HIV_cap256-119-135565_VR-Chain
  source 1..438: mol_type = other RNA
caggtgcacctggtcgagagcggcgggggagttgtgcaacccggcaagtccctcagactgtcttgcgccgctagccagttcacctttgaccggtacgggatgcattgggtgcgccaggcccctggaaaaggccttgaatgggtcgcgtccatctctaacgatgggacagacaagtatcacgctgataatgtgtggggaagattcacgattagccgggacaactccaaaaataccctgtacctcgagatgaactctctgcgcggcgaagatacagccctttatttttgtgttaaggaccagagagaggatgaatgcgaggagtggtggagcgactactatgatttcggccgggaactgccgtgtcgcaaatccagagggctcggactggccggcatctttgacatgtgggggcatggaaccatggtgacagtcagctct

SEQ ID NO: 40014 - RNA, 432 nt, synthetic construct
  misc_feature 1..432: note = derived and/or modified sequence opt5 from anti-HIV_cap256-119-135025_VR-Chain
  source 1..432: mol_type = other RNA
gaggtgcagctggtcgaaagcggcgggggactcgttcaacccggcgggtccctgagactttcttgcgaggccagcggattcacctttaacacatacgaaatgaattgggtgcggcagcctccgggccgcgggctggagtgggtggctggaatctccttcgccgcgacgaagacctattacggcggctctgtcaaagggagatttacagtgagccgggacatttccaagaacaccctctatctgcagatggatggacttcgcggcgaagacacagctctgtactattgtgccaaagatctcagagagctggagtgcgaagagtgggcctctgactactatgatttcgggcggccccagccttgtctggacccccgcggagttagcggcatctccaatgtgtgggggcaaggaaccatggtcacagtgagctct

SEQ ID NO: 40015 - RNA, 432 nt, synthetic construct
  misc_feature 1..432: note = derived and/or modified sequence opt5 from anti-HIV_cap256-119-133983_VR-Chain
  source 1..432: mol_type = other RNA
cagatgcaactggtggagagcggcgggggagtcgttcagcccggcagatccctcaccctgtcttgcgccgctagccagttcaactttgccaattacgggatgcactgggtgcggcaggcgcctggaaagggccttgaatgggtggcttccatctctaacgacgggacgaaaaagtatcatgaggaaagcgtctggggacgcttcacaatttccaaagataattctaagaacaccctgtttctccaaatgaatagcctgagaccggaggacacagccctttactattgtgccaaagatctgcgggaagacgagtgcgaggaacgctggtccgattactatgacttcggcaagcagctcccctgtagaaagagccggggcgtggctggggtttttgataactggggacagggcaccatggtgacagtctcttcc

SEQ ID NO: 40016 - RNA, 438 nt, synthetic construct
  misc_feature 1..438: note = derived and/or modified sequence opt5 from anti-HIV_cap256-119-133917_VR-Chain
  source 1..438: mol_type = other RNA
cagatgcaactggtggagagcggcgggggagtcgttcagcccggcagatccctcaccctgtcttgcgccgctagccagttcacattttccaactacgggatgcactgggtgcggcaggcccctggaaagggccttgaatgggtggcgtctatcagcaatgacgggtccaaaaagtatcatggagattctgtctgggctcgcttcacgattagcagagacaactccaaaaataccctgtttctccaaatgagctctctgcgggtggaggatacagccctttacttctgtgttcgcgaccagagagaagatgagtgcgaagagtggtggtccgactattacgattttggccgggagctgccgtgtcgcaagttcagaggcctcgggctggccggaatctttgacatttggggccacgggaccatggtgacagtcagctct

SEQ ID NO: 40017 - RNA, 432 nt, synthetic construct
  misc_feature 1..432: note = derived and/or modified sequence opt5 from anti-HIV_cap256-119-132663_VR-Chain
  source 1..432: mol_type = other RNA
caggcccaactggtggagagcggcgggggagtcgttcagcccggcagatccctccggatctcttgcgctgtgagccagttcaccttttcccgctacgggatgcactgggtgagacaggcccctggaaagggcctggaatgggtcgcgtctattagcttcgacgggcgggataaatatcattccccgcttgtgtggggacgcctgacaatctctagagacaacagcaagaatacgctctttctggagatgaactcccttcgggctgaagataccgccgtttactattgtgcccgcgacctgagagagagcgaatgcgaggagtggcaatctgattactatgctttctacaaaaagctcccctgtgtgaaacctcggggcgtcgccggctccctggacatttgggggcagggaacagtggttaccgtgagctct

SEQ ID NO: 40018 - RNA, 438 nt, synthetic construct
  misc_feature 1..438: note = derived and/or modified sequence opt5 from anti-HIV_cap256-119-132113_VR-Chain
  source 1..438: mol_type = other RNA
caggtgcaactggtcgagagcggcgggggactcgttaagcccggcgggtccctgagactttcttgcgccgctagccagttcaactttgccaattacggaatgcactgggtgcggcaggcgcctggcaaagggctggaatgggtggcttccatctctaacgacggaaccaagaaatatcatgaggaaagcgtctggggccgcttcacaatttccaaggataattctaaaagcacgctctttctgcagatgaactcccttagaatcgaggacaccgccctgtacttctgtgtgaaggatcaacgggaagacgagtgcgaggaatggtggagcgattattacgactttggccgcgagctcccgtgtagaaagtctcgggggctgggactggccggcattttcgatatgtgggggcacggaacaatggttaccgtgtccagc

SEQ ID NO: 40019 - RNA, 432 nt, synthetic construct
  misc_feature 1..432: note = derived and/or modified sequence opt5 from anti-HIV_cap256-119-131839_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacaaatactatgccgattctgttaagggaagattcacaattagccgggacaattccaaaaacacgctgtacctccagatgaatagcctgcgcgccgaggataccgctgtgtattactgtgccagagaccaacggtattacgaatgcgaggaatgggcttctgattactatgactttggccgcgagcagccgtgtcaggatcccagaggcgtcgtgggggttttcgacatgtggggacagggcacaatggtgaccgtctccagc

SEQ ID NO: 40020 - RNA, 435 nt, synthetic construct
  misc_feature 1..435: note = derived and/or modified sequence opt5 from anti-HIV_cap256-119-130626_VR-Chain
  source 1..435: mol_type = other RNA
gaggtgcagctggtcgaaagcggcgggggactcatccaccccggcgggtgcctgagactttcctgtgccgtttctggattcacctttagcgactaccctatgcattgggtgcggcaatccccgggcaaggggctggagtgggtggctgtcatttcttatgatggaatcaactactattacgccgacagcgtgaaaggccgcttcacaatttccagagataattctaagaacaatctctttctgcagatgaacagccttcggctggaagacacggcgctctattactgcgctcgcgatctgagagagctggactgtgaagagtggaccctctataattactacgatttcggctcccgggggccctgcgttgaccctcgcggagtgggcgggagctttgatgtctggggacagggcacaatggtgaccgtttcttcc

SEQ ID NO: 40021 - RNA, 438 nt, synthetic construct
  misc_feature 1..438: note = derived and/or modified sequence opt5 from anti-HIV_cap256-119-130191_VR-Chain
  source 1..438: mol_type = other RNA
gaggtgcagctggtcgaaagcggcgggggactcatccaacccggcagatccctgcggctttcttgcgccgctagcgggttcaccgtttcctctaactttatgacatgggtgcgccaggcccctggaaagggcctggagtgggtggcgagcatttccaatgacgggacgaaaaagtaccacgctgaatctgtctgggatagattcagcatctccaaagacaacagcaagaataccctctttctgcagatgaactctcttcgggtggaggatacagccctgtatttctgtgttaaagaccagcgcgaagatgagtgcgaggaatggtggtccgactactatgattttggaagagagctcccgtgtcgcaagagccggggcctgggcctggccgggattttcgacatgtggggacatggcaccatggtgacagtctcttcc

SEQ ID NO: 40022 - RNA, 438 nt, synthetic construct
  misc_feature 1..438: note = derived and/or modified sequence opt5 from anti-HIV_cap256-119-129798_VR-Chain
  source 1..438: mol_type = other RNA
caggtgcaactggtcgagagcggcgggggagttgtgcagcccggcaagtccctcagactgtcttgcgccgctagcgggttcatcttttcctcttacttcatgcactgggtgcggcaggcccctggaaaaggccttgaatgggtcgcggtggttaccgacgatgggagcaagaaatattacgctgactccgtgaagggacgctttacaatttctagagattatagcaaaaacacgctgttcctccagatgaatcggctgcgcgtcgaggacaccgccctttacttttgtgtgaaggatcaaagagaagacgagtgcgaagagtggtggtccgattattacgacttcggccgggagctgccgtgtcgcaagtttagaggcctcgggctggccggaatcttcgatatgtggggccatgggacaatggttaccgtgagctct

SEQ ID NO: 40023 - RNA, 432 nt, synthetic construct
  misc_feature 1..432: note = derived and/or modified sequence opt5 from anti-HIV_cap256-119-128745_VR-Chain
  source 1..432: mol_type = other RNA
caggtgcaactggtcgagagcggcgggggagttgtgcagcccggcagatccctccggctgtcttgcgccgctagcgggttcaccttttccaactacgccatgcactgggtgcgccaggcgcctggaaagggccttgaatgggtcgcttctatcagcttcgccgggacaaaaacgcattatggaaattccgtgaagggcagattttctattagccgggacaactccatcaataccgtttacctgcagatgaacagcctccgcgccgaggatacagctctgtattactgtgccaaagaccttagagaatatgagtgcgaagagtggacctctgattactatgacttcggccggccgcaaccctgtattgattcccgcggggtggtcggaatcctggacatttggagccagggcacaatggtgaccgtttcttcc

SEQ ID NO: 40024 - RNA, 438 nt, synthetic construct
  misc_feature 1..438: note = derived and/or modified sequence opt5 from anti-HIV_cap256-119-128593_VR-Chain
  source 1..438: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctagcatctcctatgacgggagagatttctaccatgcccggtctgtgtggggacgctttacaattagcagagacaactccaaaaatacgctgcacctccagatgaacagcctgcgggttgaggataccgccctttatttctgtgtgaaggaccaacgcgaagatgagtgcgaagagtggtggtctgactactatgattttggcagagagctgccgtgtcggaaatcccgcggcctcgggctggctggaatcttcgacatttggggccatgggacaatggtcaccgtgagctct

SEQ ID NO: 40025 - RNA, 438 nt, synthetic construct
  misc_feature 1..438: note = derived and/or modified sequence opt5 from anti-HIV_cap256-119-128152_VR-Chain
  source 1..438: mol_type = other RNA
caggtgcaactggtcgagagcggcgggggagttgtgcagcccggcagatccctccggctgtcttgcgccgtgagcgggttcacctttacatcctaccctatgcactgggtccgccaggctccgggaaagggccttgaatgggtggcctctgttagcaacgacgggacgaaaaagtatcatggagattccgtgtgggacagattcaccatctctcgggataatagcaaaaacacactgtttctccagatgtccagcctgcgcgcggaggacaccgctgtctacttctgtgtgagagatgaacgggaggacgaatgcgaggagtggtggtctgattattacgactttggccgcgaacttccctgtagaaagttccggggcctggggctcgccggaatttttgatatctggggccacgggacactggttaccgtgtccagc

SEQ ID NO: 40026 - RNA, 438 nt, synthetic construct
  misc_feature 1..438: note = derived and/or modified sequence opt5 from anti-HIV_cap256-119-127693_VR-Chain
  source 1..438: mol_type = other RNA
gaggtgcagctgctcgaaagcggcgggggactggtccaacccggcgggtcccttagactgtcttgcgccgctagcggattcaccttttcctcttacgccatggcgtgggttcggcaggctcctggcaaggggctcgagtgggtggccagcatctccaacgacggatctaaaaagtatcacggcgatagcgtgtgggcccgcttcattatctccagagacaatagcaaaaacacactgtttcttcagatgtcttccctgcgggtcgaagatacggctctctacttctgtgtgcgcgaccatagagaggatgaatgcgaggagtggtggagcgactattacgattttggccgggaactgccgtgtcgcaagttcagagggctgggactcgccggcatttttgacatctgggggcacggaaccatggttacagtgtcttcc

SEQ ID NO: 40027 - RNA, 432 nt, synthetic construct
  misc_feature 1..432: note = derived and/or modified sequence opt5 from anti-HIV_cap256-119-126684_VR-Chain
  source 1..432: mol_type = other RNA
caggtgcaactggtcgagagcggcgggggagccgttagacccggccggtccctccgcctgtcttgcgctaccagcgggttcacattttccaactacgccatgcactgggtgagacaggcgcctggaaagggccttgaatgggtgacggggatctctttcgctggaaccaaaacatattacggcgacagcgtccggggccgctttaccgtgtccagagatatttctaagaatacactgttcctccagatgaacagcctgcggccggacgataccgccatgtattactgtgcccgcgaccagagatattacgagtgcgaagagtgggcttccgattattacgactttgggcgggaacaaccctgtcttgatcctcgcggagttgtgggcatcttcgacctgtgggggcagggaacaatggtcaccgtgagctct

SEQ ID NO: 40028 - RNA, 438 nt, synthetic construct
  misc_feature 1..438: note = derived and/or modified sequence opt5 from anti-HIV_cap256-119-126056_VR-Chain
  source 1..438: mol_type = other RNA
gaggtgcagctggtcgaaagcggcgggggactcgttcaacccggcgggtccctgagactttcttgcgccgacagcggattcaccttttcctcttactggatgagctgggtgcggcaggctcctggcaaggggctggagtgggtggcctccatctctaatgatggaacgaaaaagtatcacgcggaaagcgtctgggaccgcttctccattagcaaagataattctaagaacacactctttctgcagatgaactcccttagagtggaggacaccgctctgtacttctgtgttaaagatcagcgggaagacgagtgcgaggaatggtggagcgattattacgactttggccgcgagctcccgtgtagaaagtctcggggcctggggctggccggaatcttcgatatgtggggccatgggacaatggtgaccgtctccagc

SEQ ID NO: 40029 - RNA, 432 nt, synthetic construct
  misc_feature 1..432: note = derived and/or modified sequence opt5 from anti-HIV_cap256-119-125765_VR-Chain
  source 1..432: mol_type = other RNA
caggtgcaactggtccagagcggcgggggagttgtgcagcccggcagatccctccggctgtcttgcgccgctagcgggttcaccttttcctcttacgtgatgcactgggtccgccaggcccctggaaagggccttgagggggtggcggttatcagcttcgacggaaacaatgaatattacgctgattccgtgaaaggcagatttacaatttctcgggacaacagcaagaatacggtctatctgcaaatgaactccctccgcgtggaggataccgccctgtactattgtgccaaagacatgagagaatacgagtgcgaagagtggacaagcgattattacgacttcggccggccgcagccctgtatcgattctcgcggggttgtgggcattcttgacatctggggacaggggattatggtcaccgtgtccagc

SEQ ID NO: 40030 - RNA, 438 nt, synthetic construct
  misc_feature 1..438: note = derived and/or modified sequence opt5 from anti-HIV_cap256-119-125106_VR-Chain
  source 1..438: mol_type = other RNA
caggtgcaactggtcgagagcggcgggggagttgtgcagcccggcagatccctccggctgtcttgcgccgctagcgggttcatctttcgctcctacggaatgcactgggtgagacaggcccctggcaaggggcttgaatgggtcgcgtctattagcaacgacggaaccaaacggtatcatgctgagtccgtgtgggatcgcttctctatcagcaaggacaattccaaaaacacactgtttctccagatgaatagcctgagagttgaagatacggccctttacttctgtgtgaaggaccaacgggaggatgaatgcgaggagtggtggtctgactattacgattttggccgcgaactgccgtgtagaaaatcccggggcctcgggctggccggaattttcgacatgtggggccacgggaccatggtcacagtgagctct

SEQ ID NO: 40031 - RNA, 435 nt, synthetic construct
  misc_feature 1..435: note = derived and/or modified sequence opt5 from anti-HIV_cap256-119-124026_VR-Chain
  source 1..435: mol_type = other RNA
caggtgcaactggtcgagagcggcgggggagttgtgcagtccggccggtctctccggctgacctgcagcgggtccgccttccgcttttctagctacacagtgcactgggtcagacaggctcccggaaagggccttgaatggctggccctcatctcctatgacgggcagaaaaagcatttcgcggattctgtgaaaggacggtttacgattagccgcgacaactccaagaataacctgttccttcaaatgaatagcctgagactcgaggataccgctctgtactattgtgcccgggacctgcgcgaactcgattgcgaggaatggacactgtacaactattacgactttggctctagaggcccttgtgttgatccgagaggggtgggaggctccttcgacgtctgggggcagggaaccatggtgacagttagctct

SEQ ID NO: 40032 - RNA, 432 nt, synthetic construct
  misc_feature 1..432: note = derived and/or modified sequence opt5 from anti-HIV_cap256-119-121783_VR-Chain
  source 1..432: mol_type = other RNA
ctgggcagactcgtggccagcgggggaggcgtcgttccccctgggggatccctgaccctttcttgcgtgacaagccagttcacgttttccggctgtgggctgcactgggtgcggcaagctccgggaaagggcctcgagtgggtcgcctctatcagcttcgcgggcaccaaaaagcattacgggtcctctgtgcgcggaagatttagcatttcccgggacaacagcaaaaatacactgtatcttcagatgaactctctgcgcaccgaagatacagctctctacttctgcgccaaggacctgagagagtatgaatgtgaggaatggacctccgattactatgactttggccggccccagccttgcatcgatagccgcggggttgtgggcattctggacatctggggacaggggacaatggtcaccgtgtcttcc

SEQ ID NO: 40033 - RNA, 432 nt, synthetic construct
  misc_feature 1..432: note = derived and/or modified sequence opt5 from anti-HIV_cap256-119-121208_VR-Chain
  source 1..432: mol_type = other RNA
ctgggcagactcgtggccagcgggggaggcgtcgttccccctgggaagtccctgaccctttcttgcgtggctagccagttcacattttccggatgtggcctgcactgggtgcggcaagccccggggaaaggactcgagtgggtcgcgtctatcagcttcgctggcacgaagaaacattacggcaactttgtgcgcgggagattcaccatttcccgggacaattctaagaacacactgtatcttcagatgaatagcctgcgcgccgaagataccgccctctactattgcgctaaagacctgagagagtacgaatgtgaggaatggacatccgattattacgactttggacggccccagccttgcatcgatagccgcggcgttgtggggattctggacatctggggacagggcaccatggtcacagtgtcttcc

SEQ ID NO: 40034 - RNA, 432 nt, synthetic construct
  misc_feature 1..432: note = derived and/or modified sequence opt5 from anti-HIV_cap256-119-120945_VR-Chain
  source 1..432: mol_type = other RNA
caggtgcaactggtcgagagcggcgggggagttgtgcagcccggcgggtccctcagactgtcttgcgtggccagcggattcaccttttccaactacggcatgcactgggtccggcaggctcctgggaagggacttgcctgggtggcgttcatccgctatgacggctctaataaatactatgttgatagcgtgtggggcagatttacaatttcccgggacaactctaagaatacgctgcatctccagatgaacagcctgcgcccggaagataccgctctttacttctgtgccagagacctgcgggagtccgaatgcgaggaatgggagagctattactatgattttgggaataaaggaccctgtgtcaagcctcgcggcgtggttggggtgctcgacatctggggacaaggcacactggtcaccgtgtcttcc

SEQ ID NO: 40035 - RNA, 432 nt, synthetic construct
  misc_feature 1..432: note = derived and/or modified sequence opt5 from anti-HIV_cap256-119-118229_VR-Chain
  source 1..432: mol_type = other RNA
caggtgcaagtcgttgagagcggcgggggagtggtgcagcccggcagatccctgcggctctcttgcgccgctagcgggttcaccttttccaactacgccatccactgggtccgccaggcgcctggaaagggcctggaatgggtggctcttatttcttatgacgggtacaataaatattacgccgatagcgttagaggacggttcacaatctcccgcgacaactctaataacacggtgtatctgcagatgaatagcctcaagccggaggataccgccgtctactattgtgctagagacctgcgggaatccgagtgcgaagagtgggagagctactactatgattttggcaaaaagggcccctgtgtgaaacctcgcggggttgtgggagtccttgacatttggggccaagggacactggtgaccgtgtcttcc

SEQ ID NO: 40036 - RNA, 432 nt, synthetic construct
  misc_feature 1..432: note = derived and/or modified sequence opt5 from anti-HIV_cap256-119-118025_VR-Chain
  source 1..432: mol_type = other RNA
gaggtgcagctggtcgaaagcggcgggggagttgtgcaacccggcaagtccctcagactgtcttgcaccgccagccagttcacattttccaatttcgggatgcactgggtgcggcaggctcctggaaaaggccttgagtgggtcgcctctatcagctttgtggggattaagacgcattacgctaattccgttcgcggaagattcaccatctctcgggaccagagcaaaaacacactgtatctccaaatgaactccgtgcgcattgaagataccgcgagatacttttgtgcccgggacatgcgcgagtatgaatgcgagctgtgggccagcgattactatgacttcggcaagccgcagccctgtgaggatcctagaggcgtcgtggggacatttgacatgtggggacttggcaccctggttacagtgtcttcc

SEQ ID NO: 40037 - RNA, 432 nt, synthetic construct
  misc_feature 1..432: note = derived and/or modified sequence opt5 from anti-HIV_cap256-119-117418_VR-Chain
  source 1..432: mol_type = other RNA
caggtgcaactggtcgagagcggcgggggagttgtgcagcccggcagatccctccggctgtcttgcgccgctagcgggttcaactttcgcaattacgacatcaactgggtgagacaggtccctggaaagggccttgaatgggtggccgcgatttccttcgatggggctgacaaatatcacgccgataatgtttggggacggctgtctatcagccgcgacaactccaagtctaccctctacctgcagatgaatagccttagaccggaggatacagccgtgtatttttgtgctaaagacctgcgggaagatgagtgcgaggaacgctggtccgactactatgatttcggcaagcaactcccctgtagaaaaagccggggcgtcgccgggatttttgacaactggggacagggcacgatggtgaccgtttctgct

SEQ ID NO: 40038 - RNA, 432 nt, synthetic construct
  misc_feature 1..432: note = derived and/or modified sequence opt5 from anti-HIV_cap256-119-117250_VR-Chain
  source 1..432: mol_type = other RNA
caggtgagactggtcgagagcggcgggggagttgtgcaacccggcgggtccctccggctgtcttgcgccgctagccagttcaccttttccgcctacggaatgcactgggtgcgccaggcgcctggcaaggggcttgaatgggtcgcttctatcagcttcgacggaacagataaatttcatgccgacaaggtgtggggcagactggttatttcccgggataactctaaaaatacgctctatctgcagatgaacagccttcgcccggaggacaccgccgtgtactattgtgctaaggatctgagagaagacgagtgcgaggaacggtggtccgattactatgacttcggcaaacaactcccctgtcgcaagagcagaggggtcgccggagtgtttgataattggggccaggggacaatggttaccgtgtcttcc

SEQ ID NO: 40039 - RNA, 432 nt, synthetic construct
  misc_feature 1..432: note = derived and/or modified sequence opt5 from anti-HIV_cap256-119-117230_VR-Chain
  source 1..432: mol_type = other RNA
caggtgcaactggtcgagagcggcgggggaggcgttcagcccgggagatccctccggctgtcttgcgccgctagcggattcaccctttcctcttacggcatgcactgggtgcgccaggcccctgggaagggactggaatgggtggcgagcatctcctttgacggcagagattattaccattctccgcacgtctggggccggctcacaattagccgcgacaactccaaaaatacgctgtatcttcagatgaacagcctgagagctgaggataccgccctctactattgtgcccgggacctgcgcgaatctgagtgcgaagagtgggagtccgattactatgacttcgggaagaaaggaccctgtgtgaagcctagaggcgttgctgggagcctggatatgtggggacaaggcacaatggtgatcgtctcttcc

SEQ ID NO: 40040 - RNA, 432 nt, synthetic construct
  misc_feature 1..432: note = derived and/or modified sequence opt5 from anti-HIV_cap256-119-116999_VR-Chain
  source 1..432: mol_type = other RNA
caggtgcaactggtcgagagcggcgggggagttgtgcagcccggcacctccctccggatctcttgcgccgctagccagttcacattttcccggtacgggatgcactgggtgcgccaggcccctggaaagggcctggaatgggtcgcgtctattagctatgacgggagagattactatcatgctggacgggtgtggggccgcttcacgatctccagagacaactctaaaaataccctttacctgcaaatgaacagcctccggccggaggatacagccctgtatttttgtgttcgcgactccagagaaagcgagtgcgaagagtgggagtctgattactatgacttcggcaagaaacttccctgtgtgaagcctagaggggtcgtgggagttctggatctctggggccaggggaccctggtgacagtctccagc

SEQ ID NO: 40041 - RNA, 432 nt, synthetic construct
  misc_feature 1..432: note = derived and/or modified sequence opt5 from anti-HIV_cap256-119-116558_VR-Chain
  source 1..432: mol_type = other RNA
caggtgcaactggtcgagagcggcgggggagttgtgcagcccggcagatccctccggctgtcttgcgccgctagcgggttcacctttaaccgctactcccttcactgggtgagacaggcccctggaaagggcctggaatgggtcgcgttcacatcttatgacgggagcaataaatactatccggattccgtgaagggacggtttacgatctctcgcgacagctccaaaaacaccctctacctggagatgaatagccttagacccgaagatacagctctgtattactgtgccaaggacatgcggggctatgagtgcgaagagtggacctctgattactacgacttcggccgccctcagccctgtattgattccagaggggttgtgggaacatttgacgtctggggccaagggaccatggtgacagttagctct

SEQ ID NO: 40042 - RNA, 432 nt, synthetic construct
  misc_feature 1..432: note = derived and/or modified sequence opt5 from anti-HIV_cap256-119-116484_VR-Chain
  source 1..432: mol_type = other RNA
gacgtgcagctgctcgagagcggcggggatctggtccaacccggaggctcccttagactgtcttgcgccgctagcgggttcacctttacaaagtacgaaatgacgtgggttcggcaggcccctggaaaaggcctcgagtgggtggcgtccatctcttatgacgggagcgataagtaccacacctcctctctgtggggacgcttcattgtgagcagagacaactccaaaaatacactttatctgcagatgaacagcctccggccggaagataccgctctgtactattgtgtccgcgacagacgggagtctgaatgcgaggagcgctggtccgattactatgactttggcaagcagctgccctgtgtgaaacctagaggcgttgccgggatcttcgatatttggggacaaggcacaatggtgaccgtcagctct

SEQ ID NO: 40043 - RNA, 438 nt, synthetic construct
  misc_feature 1..438: note = derived and/or modified sequence opt5 from anti-HIV_cap256-119-114844_VR-Chain
  source 1..438: mol_type = other RNA
gaggtgcagctggtcgaaagcggcggggacctcgttcaacccggaagatccctgcggctttcttgcgccgctagcggcttcaccttttcctcttactggatgagctgggtgcgccaggcccctgggaagggactggagtgggtggcgtccatctctaacgatggcacgaaaaagtatcacgaagagagcgtctgggggagattcacaatttccaaagacaatagcaagtctaccctctttctgcagatgaactcccttcgggtggaagatacagctctgtacttctgtgttaaagaccagcgcgaggatgagtgcgaagagtggtggagcgactattacgattttggaagagaactcccgtgtcggaagtctcgcggcctgggcctggccgggatcttcgacatgtggggacatggcaccatggtgacagtctccagc

SEQ ID NO: 40044 - RNA, 438 nt, synthetic construct
  misc_feature 1..438: note = derived and/or modified sequence opt5 from anti-HIV_cap256-119-114141_VR-Chain
  source 1..438: mol_type = other RNA
ggcgggagaagcggaggcgggggagtgggcaccacaccccggcgcgggcctctgagactctcctgcgccgcttctggattcacgctggacgattacgccatgcactgggtccggcaggcgccgggcaagggccttgagtgggttgctagcatctccaacgacgggaccaaaaagtatcatgccgaatctgtgtgggatcgctttagcatttccaaagacaattctaagaacacactgttcctccaaatgaatagcctgagagtggaggataccgccctttacttttgtgtcaaagaccagcgggaagatgagtgcgaagagtggtggtccgactattacgtgttctgggagcgcgctccctgtagaacagttcctggacggggccccgggtggtattttgatatggtgggacgcagaaccatggtcacagtgagctct

SEQ ID NO: 40045 - RNA, 432 nt, synthetic construct
  misc_feature 1..432: note = derived and/or modified sequence opt5 from anti-HIV_cap256-119-111917_VR-Chain
  source 1..432: mol_type = other RNA
gaggtgcacctggtcgaaagcggcgggggactcgttcagcccggcgggtccctgagactttcttgcgccgctagcggattcaccttttcctcttacggcatgcattgggtgcggcaagcccctgggaagggactggagtgggtggcgacaatcagcttcgacggcgctgataaatatcacgccgacgatgtctggggccgcttttccatttctagagacaacagcaagaatacgctctacctgcagatgaacaatcttcggccggaagataccgccctgtattactgtgctaaagacctccgcgaggatgaatgcgaggagagatggtccgactattacgatttcgggaagcagctgccctgtcggaaaagccgcggagtggccggcgtttttgacaactgggggcagggaacaatggtgaccgtctcttcc

SEQ ID NO: 40046 - RNA, 432 nt, synthetic construct
  misc_feature 1..432: note = derived and/or modified sequence opt5 from anti-HIV_cap256-119-111862_VR-Chain
  source 1..432: mol_type = other RNA
caggtgcaactggtcgagagcggcgggggagttgtgcagcccggcgggtccctcagactgtcttgcgccgctagcggattcacctactccgactatggcatgcactgggtgcggcaggcccctgggaagggacttgaatgggtcgcgtctatcagctttgctggcacaaaacagcattacggcaattccgtgaaggggcgcttcacgatttctagagataatagcaaaaacaccgtttatctgcaaatgaactccctccgggtggaggacacagccctgtactattgtgccaaggatatgcgcgaatacgagtgcgaagagtggaccagcgactattacgattttggaagaccgcagccctgtatcgactctcggggcgtcgtggggattcttgatatctggggacagggcattatggttacagtgtccagc

SEQ ID NO: 40047 - RNA, 432 nt, synthetic construct
  misc_feature 1..432: note = derived and/or modified sequence opt5 from anti-HIV_cap256-119-110064_VR-Chain
  source 1..432: mol_type = other RNA
ctgggcagactcgtggccagcgggggaggcgtcgttccccctgggcggtccctgcgcctttcttgcgtggctagccagttcaccttttccggatgtggcctgcactgggtgagacaagccccggggaagggactcgagtgggtcgcgtctatcagcttcgctggcacaaaacagcattacggcaattccgtgaaggggcggtttacgatttctcgcgacaatagcaaaaacaccgtttatctgcagatgaactcccttagagtggaagatacagccctgtactattgcgccaaggacatgcgggagtacgaatgtgaggaatggaccagcgattattacgacttcggacgcccccagccttgcatcgattctagaggcgtcgtggggattctcgacatctggggacaaggcacaatggttaccgtgtccttt

SEQ ID NO: 40048 - RNA, 432 nt, synthetic construct
  misc_feature 1..432: note = derived and/or modified sequence opt5 from anti-HIV_cap256-119-109192_VR-Chain
  source 1..432: mol_type = other RNA
caggtgcaactggtcgagagcggcgggggagttgtgcagcccggcagatccctccggctgtcttgcgccgctagcgggttcaccttttccaactacgccatgcactgggtgcgccaggcgcctggaaagggccttgaatgggtcgctgtgatcgcctatgacggggataataaatactatgccgactctgttaagggaagattcacaattagccgggataactccaaaaatacgctgtacctccagatgaactctctgcgcgctgaggacaccgccctttattactgtgctaaggatctgagagaagacgagtgcgaagagtggtggagcgattattacgacctcggcaaacaactgccgtgtcggaagtcccgcggcgtggccggggtcctggataagtggggactcggcacaatggtgaccgttagctct

SEQ ID NO: 40049 - RNA, 435 nt, synthetic construct
  misc_feature 1..435: note = derived and/or modified sequence opt5 from anti-HIV_cap256-119-108793_VR-Chain
  source 1..435: mol_type = other RNA
cagttccaactggtggagagcggcgggggagtcgttcagcccggcagatccctccggctgtcttgcgccgctagcgggtttaccttctcctcttaccctatgcactgggtgcgccaggccccgggaaagggccttgaatgggtggcgctgatcagctatgacgggacagataaatactatgctgactccgtcaagggaagatttacgatttctcgggataacagcaaaaataccctctacctgcagatgaactcccttcgcgtggaggacacagccgtttatcattgtgccaaggatctgggcggcagcaaatctgacgaatgggctaccgattactattacgactggtccaaggcctaccccgtgcacgatcctagagctgtcgtgggggttttcgacatctggggacaaggcacactcgtgaccgtcagctct

SEQ ID NO: 40050 - RNA, 432 nt, synthetic construct
  misc_feature 1..432: note = derived and/or modified sequence opt5 from anti-HIV_cap256-119-108127_VR-Chain
  source 1..432: mol_type = other RNA
caggtgcaactggtcgagagcggcgggggagttgtgcagcccggcagatccctccggatctcttgcgccgctagccagttcacctttaaccgctacgggatgcactgggtgagacaggcccctggaaagggcctggaatgggtcgcgtccatttcttatgacgggagcgataaataccatgctggacttgtgtggggccggttcatcatttcccgcgacaattctaagaacacactgtatctccaaatgaatagcctgagagccgaggatacggccctttactattgtgttcgggaccgcagagaatccgagtgcgaggaacggtggagcgattactatgactttggcaaacagctgccgtgtgtgaagccccgcggggtcgctggaatcttcgatatttggggccaggggaccatggtgacagtttcttcc

SEQ ID NO: 40051 - RNA, 438 nt, synthetic construct
  misc_feature 1..438: note = derived and/or modified sequence opt5 from anti-HIV_cap256-119-107758_VR-Chain
  source 1..438: mol_type = other RNA
gaggtgcagctggtcgaaagcggcgggggactcgttaagcccggcgggtccctgagactttcttgcgccgctagcggattcaccttttccaacgcctggatgtcttgggtgcggcaagcgcctggcaaagggctggagtgggtggctagcatctccaatgacggaacaaagaaataccacgaagagtctgtctggggccgcttcacgattagcaaggataactccaaaaataccctctttctgcagatgaacagccttagaatcgaagacacagccctgtatttctgtgtgaaggatcagcgggaggacgagtgcgaagagtggtggtctgattactatgactttggccgcgaactcccgtgtagaaagtcccgggggctgggactggccggcattttcgatatgtgggggcatggaaccatggttacagtgagctct

SEQ ID NO: 40052 - RNA, 432 nt, synthetic construct
  misc_feature 1..432: note = derived and/or modified sequence opt5 from anti-HIV_cap256-119-107209_VR-Chain
  source 1..432: mol_type = other RNA
gaggtgcagctggtcgaaagcggcgggggactcgttcaacccggcagatccctgcggctttcttgcaccgccagcgggttcacatttggagactacggcatgcactgggtgcgccaggctcctgggaagggactggagtgggtggccgcgatctccttcgatggcgctgacaaatatcatgccgataacgtctggggcagactctctattagccgggacaattccaagtctacgctgtaccttcagatgaacagcctgcgcccggaagataccgccgtgtatttttgtgctaaagacctcagagaggatgaatgcgaggagcggtggtccgactactatgatttcgggaagcagctgccctgtcgcaaaagcagaggagttgccggcatctttgacaattgggggcaaggaacaatggtgaccgtctctgct

SEQ ID NO: 40053 - RNA, 432 nt, synthetic construct
  misc_feature 1..432: note = derived and/or modified sequence opt5 from anti-HIV_cap256-119-107184_VR-Chain
  source 1..432: mol_type = other RNA
caggcccaactggtggagagcggcgggggagtcgttcagcccggcagatccctcgggctgtcttgcgctgccagcaagttctccctttctagctacggaatgcactgggtgcggcaggcgcctggccgcgggctggaatgggtggctggaatctcctttgccggcaccaaaaagtattacgccgactctgtcagaggccggttcagcgtgtccacagatattagcaaaaatacgctctatctgcagatgaactctcttcgcccggctgacaccgccctgtacttttgtgctagagatctccggtattacgagtgcgaagagtgggcctccgactattacgatttcgggaaggaacaaccctgtctggaccctcgcggagttgtgggcatctttgatctgtgggggcagggaacaatggtcaccgtgagctct

SEQ ID NO: 40054 - RNA, 438 nt, synthetic construct
  misc_feature 1..438: note = derived and/or modified sequence opt5 from anti-HIV_cap256-119-106827_VR-Chain
  source 1..438: mol_type = other RNA
gccgtgcagctggtcgagagcggcgggggactcgttcaacccggcgggtccctgagactttcttgcagcgtgtcccagttcacctttggacggtacggcatgtattgggtgcgccaggctcctgggaagggactggaatgggtcgccgtgatctcttacgacggcggcaacagatattacgcggatagcgttaaaaatcggttctccatttctcgcgacaacagcaagaatacactctttctgcagatgtccagccttagagctgaggatacggccctgtatttctgtgtgcgggaccaccgcgaagatgagtgcgaagagtggtggtctgactactatgattttgggagagagctcccgtgtcggaaattccgcggactgggcctggccgggatctttgacatttggggacatggcaccatggtcacagtgtccagc

SEQ ID NO: 40055 - RNA, 432 nt, synthetic construct
  misc_feature 1..432: note = derived and/or modified sequence opt5 from anti-HIV_cap256-119-106511_VR-Chain
  source 1..432: mol_type = other RNA
caggtgcaactggtcgagagcggcgggggagttgtgcagcccggcagatccctccggctgtcttgcgtggccagccagttctcctttgaccgctacgggatgcactgggtcagacaggctcctggaaagggccttgaatgggtggcctctatcagcttcgatgggaccgacaaatatcatgcggataaggtttggggacggtttacaatttcccgcgacaactctaaaaatacgctgtacctccaaatgaacagcctgagaccggaggataccgctctttattactgtgccaaggacatgcgggaagatgagtgcgaagcctggtggtccgactattacgatctgggcaaacagctcccctgtcgcgagagcagaggcgtggctgggatcttcgacgagtggggacagggcacaatggtcaccgtgtcttcc

SEQ ID NO: 40056 - RNA, 432 nt, synthetic construct
  misc_feature 1..432: note = derived and/or modified sequence opt5 from anti-HIV_cap256-119-106327_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgccatcagcgggggaggcggcaatacatatgtggccgactccgttaaagggagattcacgatttctcgggataatagcaagaacaccgtgtacctgcagatgaactccctccgcctggaggacacagctctttattactgtgccaaagatctgagagaatatgagtgcgaagagtggaccagcgactactatgattttggacggccgcaaccctgtatcgactctcgcggcgtcgtggggattctcgatatctggggacagggcacaatggttaccgtgtccagc

SEQ ID NO: 40057 - RNA, 438 nt, synthetic construct
  misc_feature 1..438: note = derived and/or modified sequence opt5 from anti-HIV_cap256-119-105486_VR-Chain
  source 1..438: mol_type = other RNA
caggtgcaactggtcgagagcggcgggggagttgtgcagcccggcgggtccctcagactgtcttgcgccgctagcggattcaccgtgtccggctacgggatgcactgggtccggcaggcccctgcgaagggacttgactgggtggcttttatctctcatgatggcagcaacaaatattacgccgactccgttcgcggcagattcattatctctcgggataatagcaacaatacactgtatgtgcagatgtccagcctccgcgccgaagacacggctctgtacttttgtgtcagagatcaccgggaggacgaatgcgaggaatggtggtctgattattacgacttcgggcgcgagcttccgtgtagaaagtttcggggactgggcctcgccgggattttcgatatctggggacatggcaccatggtgacagtttccagc

SEQ ID NO: 40058 - RNA, 432 nt, synthetic construct
  misc_feature 1..432: note = derived and/or modified sequence opt5 from anti-HIV_cap256-119-105197_VR-Chain
  source 1..432: mol_type = other RNA
caggtgcaactggtcgagagcggcgggggagttgtgcagcccggcagatccctccggctgtcttgcgccgtgagccagttcacctttgggcgctacggaatgcactgggtcagacaggctcctggcaaggggcttgaatgggtgggatccatctcttatgacggcagcgataaataccatacaaactccctgtggggccggttcattgtttctcgcgacaatagcaagaacacgctctatctgcaaatgaataaccttagaccggaggataccgccctgtactattgtgtgcgggaccgcagagaatccgagtgcgaggaacggtggagcgattactatgactttgggaaacagctcccctgtgtcaagcctcgcggagtggttggcgtgctggatatctgggggcagggaacactggtcaccgtgtcttcc

SEQ ID NO: 40059 - RNA, 432 nt, synthetic construct
  misc_feature 1..432: note = derived and/or modified sequence opt5 from anti-HIV_cap256-119-104946_VR-Chain
  source 1..432: mol_type = other RNA
caggagcaactggtggaaagcggcgggggagtcgttcagcccggcagatccctccggctgtcttgcgtggccagccgcttcaccttttccgctttcgggatgcactgggtgagacaggcccctggaaagggccttgagtgggtcgcgtctatcagctttgctgggattaaaaagtactatggagactccgtgaaaggccggttcacaatctctcgcgataacagcaagaatacgctgtacctccagatggacggcctgagaggggaagataccgccctttattactgtgccaaagacctgcgggagctcgaatgcgaggagtgggcttccgattattacgactttggacgcccgcaaccctgtattgatagcagaggcgttgtggggatcctggacatttggggacagggcatcatggtcacagtgtcttcc

SEQ ID NO: 40060 - RNA, 432 nt, synthetic construct
  misc_feature 1..432: note = derived and/or modified sequence opt5 from anti-HIV_cap256-119-103667_VR-Chain
  source 1..432: mol_type = other RNA
caggtgcacctggtcgagagcggcgggggagttgtgcaacccggcaagtccctccggctgtcttgcgccgctagccagttcacctttaatcggttcgggatgcattgggtgcgccaggcccctggaaaaggccttgaatgggtcgcggggatctcctacgacggatctgataagtatcacgctgacaaagtgtggggcagatttacaattagccgggataattccaagaacacgctgtacctccagatgaactctctgcgcgccgaggacaccgccctttattactgtgctaaagatctgagagaagacgagtgcgaagagtgggccagcgattattacgacttcggcaaggagcaaccgtgtctcgatcccagaggggttgtgggaatctttgacatttggggccaggggacaatggtcaccgtgtccagc

SEQ ID NO: 40061 - RNA, 438 nt, synthetic construct
  misc_feature 1..438: note = derived and/or modified sequence opt5 from anti-HIV_cap256-119-103385_VR-Chain
  source 1..438: mol_type = other RNA
gaggtgcagctggtcgaaagcggcgggggactcgttcaaaccggcgggtccctgagactttcttgcgccgctagcggattcacattttcccggtacgacatgaactgggtgcgccaggcccccggcaaggggctggagtgggtggcgtctatcagcaatgatggatccaaaaagtatcacggcgactctgtctgggctagattcacgattagccgggataactccaaaaataccctctttctgcagatgagctctcttcgcgtggaagacacagccctgtacttctgtgttagagatcagcgggaggacgaatgcgaggagtggtggtccgattattacgactttggccgcgaactcccttgtagaaagttccgggggctgggactggccggcatctttgatatttgggggcatggaaccatggtgacagtcagctct

SEQ ID NO: 40062 - RNA, 438 nt, synthetic construct
  misc_feature 1..438: note = derived and/or modified sequence opt5 from anti-HIV_cap256-119-103267_VR-Chain
  source 1..438: mol_type = other RNA
gaggtgcccagcgtcgaatccggcgggggactggttcagaccggcgggtctctcacactgagctgcgccgcttcccaattcacgttttctaactacggaatgcactgggtgagacaggcccctggcaaggggcttgagtgggtggcgagcatctccaatgacggatctaaaaagtatcatggcgatagcgtctgggctcggttcattatctcccgcgacaacagcaaaaataccctgtttctccagatgtcttccctgagagccgaagatacagccctttacttctgtgtgcgggaccaccgcgaggatgaatgcgaggagtggtggagcgactattacgattttggcagagaactgccgtgtcggaagttccgcgggctcggactggctggcatttttgacatctgggggcatggaaccatggttacagtgtcttcc

SEQ ID NO: 40063 - RNA, 432 nt, synthetic construct
  misc_feature 1..432: note = derived and/or modified sequence opt5 from anti-HIV_cap256-119-103011_VR-Chain
  source 1..432: mol_type = other RNA
caggtgcaactggtcgagagcggcgggggagttgtgcagcccggcgggtccctcagactgtcttgcgccaccagcggattcacatttggcacgttcgggatgcactgggtgcggcaggctcctggaaagggccttgactgggtcgccgcgatctcctttgctggcaccaaaaagaactacgccgattctgtgcgcgggagattcacaattagccgggactcctctaaaaataccctgtatctccagatgaacagcctgcgcccggaagatacagccctttactattgtgttaaggacatgagaggatacgagtgcgaagagtggacctccgattattacgactttggccggccccaaccttgtatcgatagccgcggggtggtcggaacattcgacgtgtggggccaggggaccatggttacggtgtcttcc

SEQ ID NO: 40064 - RNA, 438 nt, synthetic construct
  misc_feature 1..438: note = derived and/or modified sequence opt5 from anti-HIV_cap256-119-102072_VR-Chain
  source 1..438: mol_type = other RNA
gaggtgcagctggtcgaaagcggcgggggactcgttcaacccggcgggtccctgagagtgtcttgcgccgtgagcggattcaccttttccaactacgagatgaattgggtccggcaggctcctggcaaggggcttgaatgggtggcctctatcagcaacgacggaacgaaaaagtatcacgcggagtccgtttgggatcgcttctctattagcaaagacaattccaagaacacactgtttctccagatgaatagcctgagagtggaagataccgctctttacttctgtgtcaaagaccagcgggaggatgagtgcgaagagtggtggtctgactattacgattttggccgcgaactgccgtgtagaaagtcccggggcctcgggctggccggaatcttcgacatttggggccatgggacaatggtgaccgttagctct

SEQ ID NO: 40065 - RNA, 438 nt, synthetic construct
  misc_feature 1..438: note = derived and/or modified sequence opt5 from anti-HIV_cap256-119-101945_VR-Chain
  source 1..438: mol_type = other RNA
gaggtgcagctggtcgaaagcggcgggggactcgttcaacccggcgggtccctgagactttcttgcgccgctagcggattcaccttttcctcttacgtgatgcactgggtgcggcaggcccctggcaaggggctggagtgggtcgcgagcatctccaacgacggaacgaaaaagtatcatgaagagtctgtgtggggccgcttcacaattagcaaagataattccaagaacaccctctttctgcagatgaatagccttagaatcgaagacacagctctgtacttctgtgttaaagatcagcgggaggacgagtgcgaagagtggtggtctgattattacgactttggccgcgaactcccgtgtagaaagtcccgggggctgggactggccggcattttcgatatgtgggggcacggaaccatggtgacagtcagctct

SEQ ID NO: 40066 - RNA, 432 nt, synthetic construct
  misc_feature 1..432: note = derived and/or modified sequence opt5 from anti-HIV_cap256-119-101319_VR-Chain
  source 1..432: mol_type = other RNA
caggtgcaactggtcgagagcggcgggggagttgtgcagcccggcaagtccctcagactgtcttgcgtggggagcggattcacctttgacgattacggcatgcactgggtccggcaggcccctgggaaaggacttgaatgggtggcttccatctcttatgacggccgcgatttctaccatgccagaagcgtttggggccggtttacaatttcccgcgacaactctaagaatacgctgcacctccagatgaacagcctgagaccggaggataccgcgctttatttctgtgctcgggacctgcgcgaatccgagtgcgaagagtgggagagctactattacgattttgggaaaaagggaccctgtgtgaaacctagaggcgtcgtgggggttctcgacatctggggacaaggcacactggtgaccgtctcttcc

SEQ ID NO: 40067 - RNA, 432 nt, synthetic construct
  misc_feature 1..432: note = derived and/or modified sequence opt5 from anti-HIV_cap256-119-100871_VR-Chain
  source 1..432: mol_type = other RNA
caggtgcaactggtcgagagcggcgggggagttgtgcagcccggcgaatccctcagaatctcttgcgccgctagccagttcaccttttcccggtacgggatgcactgggtgcgccaggcccctggaaagggcctggagtgggtcgcgtctattagcttcgacgggagagataaatatcattcctctcttgtgtggggacggctgacaatcagccgcgacaattccaagagcacgctctttctgcaaatgaactctcttagagctgaagataccgccctgtactattgtgcccgggacctccgcgagtccgaatgcgaggagtgggaaagcgattactatgacttcggcaaaccgcagccctgtgaggatcctagaggcgttgtggggacatttgacatgtggggactgggcaccctggtcacagtgtcttcc

SEQ ID NO: 40068 - RNA, 432 nt, synthetic construct
  misc_feature 1..432: note = derived and/or modified sequence opt5 from anti-HIV_cap256-119-100838_VR-Chain
  source 1..432: mol_type = other RNA
gaggtgcagctggtcgaaagcggcgggggagttgtgcaacccggcgggtccctcagactgtcttgcgccgctagcggattcaccttttcctcttacggcatgcactgggtgcggcaggcccctgggaagggacttgagtgggtcgcgttcatccgctatgacggcagcaacaaatactatgctgattccgtgaagggcagatttacaatttctcgggacaatagcaaccatacgctgtacatgcagctcgattccctgcgcgccgaagacaccgccctttattactgtgctaaagatctgagagagtatgaatgcgaggagtggacaagcgactactacgatttcgggcggccgcagccctgtatcgactctcgcggagttgtgggcattctcgatatctggtcccaagggaccatggtcacagtgagctct

SEQ ID NO: 40069 - RNA, 438 nt, synthetic construct
  misc_feature 1..438: note = derived and/or modified sequence opt5 from anti-HIV_cap256-119-100025_VR-Chain
  source 1..438: mol_type = other RNA
caggtgcaactggtcgagagcggcgggggagttgtgcagcccggcagatccctccggctgtcttgcgccgctagcgtgttcaccttttcctactatgggatgcactgggtccgccaggcccctggaaagggccttgaatgggtggcgttcatctctcatgacgggagcaacaaatactatgctgattccgttagaggacggtttattatctctcgcgacaatagcaacaatacactgtacgtgcagatgaactccctcagagccgaggatacggccctgtatttctgtgtcaaggaccaacgggaagatgagtgcgaagagtggtggagcgactactatgattttggccgcgagcttccgtgtagaaaattccggggcctggggctcgctggaacctttgacatttggggccacgggacaatgctgatcgtgtcttcc

SEQ ID NO: 40070 - RNA, 432 nt, synthetic construct
  misc_feature 1..432: note = derived and/or modified sequence opt5 from anti-HIV_cap256-119-100000_VR-Chain
  source 1..432: mol_type = other RNA
cagatgcaactggtggagagcggcgggggagtcgttcagcccggcagatccctcaccctgtcttgcgccgctagccagttcacattttccaactacgggatgcactgggtgcggcaggcccctggaaagggccttgaatgggtggcgtctatcagcaatgacgggaacaaaaagtatcatggagattccgtctgggctcgcttcacgatttctagagacaatagcaaaaacaccctgtttctccaaatgtccagcctgcggacagaggataccgccctttacttctgtgtgcgcgacagacgggaatctgagtgcgaggaacgctggtccgattattacgactttggcaagcagctgccgtgtgttaaacccagaggcgtggccgggatcttcgatatttggggacagggcacaatggtcaccgtgagctct

SEQ ID NO: 40071 - RNA, 432 nt, synthetic construct
  misc_feature 1..432: note = derived and/or modified sequence opt5 from anti-HIV_cap256-119-098890_VR-Chain
  source 1..432: mol_type = other RNA
caggtgcaactggtcgagagcggcgggggagttgtgcagcccggcgaatccctcagaatctcttgcgtggccagccagttcacctttgggcggtacggaatgcactgggtccgccaggctcctggcaaggggctggagtgggtggcctccatttctttcgacggaagagataaatatcatagcccgcttgtttggggccggctgacaatctcccgcgacaactctaagaatacgctctttctgcaaatgaacagccttagaaccgaagatacagcgctgtactattgtgctcgggacctccgcgagtccgaatgcgaggagtgggaaagcgattactatgccttctggagaaaactgccctgtgtgaagcctcggggcgtcgccgggaccctggacatttggggacagggcacaatggtgtctgtttccagc

SEQ ID NO: 40072 - RNA, 435 nt, synthetic construct
  misc_feature 1..435: note = derived and/or modified sequence opt5 from anti-HIV_cap256-119-098715_VR-Chain
  source 1..435: mol_type = other RNA
caggtgcaactggtcgagagcggcgggggagttgtgcagcccggcagatccctccggctgtcttgcgccgctagcgggttctcctttaacaatcacggaatgcattgggtgcgccaggcccctggcaaggggcttgaatgggtcgcgggaatctctttcgctggcattaaaaagtactatggcaccagcgtgaaagggagatttacaatctcccgggacaactctaagaataacctgttcctccagatgaatagcctgcgcgttgaggatacggccctttactattgtgccagagacctgcgggaaatggagtgcgaagagtggaccctctacaactattacgattttggatcccgcggcccgtgtgtggaccccagaggggtcgtgggcagcttcgatgtttggggacaagggacaatggtgaccgtctcttcc

SEQ ID NO: 40073 - RNA, 438 nt, synthetic construct
  misc_feature 1..438: note = derived and/or modified sequence opt5 from anti-HIV_cap256-119-098632_VR-Chain
  source 1..438: mol_type = other RNA
cagatgcaactggtggagagcggcgggggagtcgttcagcccggcagatccctcaccctgtcttgcgccgctagccagttcaattttgccaattacgacatgcactgggtgcggcaggcgcctgggaagggacttgaatgggtggctttcatccgctatgatggcaacaataaatactatgccgactccgtcaaggggagatttacaatttctcgggataacagcaaatccacgctgttcctccaaatgaactctctgcgcatcgaggacaccgccctttacttttgtgtgaaggatcagagagaagacgagtgcgaagagtggtggagcgattattacgacttcggacgggagctgccgtgtcgcaaatccagaggcctcggcctggctgggatttttgatatgtggggacatggcacaatggttaccgtgagctct

SEQ ID NO: 40074 - RNA, 432 nt, synthetic construct
  misc_feature 1..432: note = derived and/or modified sequence opt5 from anti-HIV_cap256-119-097199_VR-Chain
  source 1..432: mol_type = other RNA
caggtgcaactggtcgagagcggcgggggagttgtgcagcccggccggtccctccggctgtcttgcgccgctagcgggttcgccttttcctcttacgcgttccactgggtgcgccaggctcctggaaagggccttgaatgggtcgcctatatcccgtttcatgggaaccagcaatactatggagacagcgtgaaaggcagattcaccatttcccgggataattctcgcgacacactgtttctcgagatgaacagcctgagacccgaagatacggccctttacttctgtgctcgggaccagcgctattacgagtgcgaagagtgggcctccgattattacgactttggcagagagcagccttgtctggatcccagaggggttgtgggaatcttcgacctctggggccaggggaccatggtcacagtgagctct

SEQ ID NO: 40075 - RNA, 432 nt, synthetic construct
  misc_feature 1..432: note = derived and/or modified sequence opt5 from anti-HIV_cap256-119-096189_VR-Chain
  source 1..432: mol_type = other RNA
caggtgcaactggtcgagagcggcgggggagttgtgcagcccggcagatccctccggctgtcttgcgccgctagcgggttcaagtttggatccttcggcatgcactgggtgcgccaggcccctgggaaaggacttgaatgggtcgcggtgatctcttacgacggcagcgataagtattacggctcctctgttagagggcggtttagcatttcccgcgacaacagcaaaaataccctgtatctccagatgaactctctgagaacagaggatacggctctttacttctgtgccaaggacctgcgggaatatgagtgcgaagagtggacctccgattactatgactttggacgcccgcaaccctgtatcgatagcagaggcgtggtcgggattctcgacatctggggacagggcacaatggtgaccgtttcttcc

SEQ ID NO: 40076 - RNA, 432 nt, synthetic construct
  misc_feature 1..432: note = derived and/or modified sequence opt5 from anti-HIV_cap256-119-094581_VR-Chain
  source 1..432: mol_type = other RNA
caggtgcacctggtcgagagcggcgggggagttgtgcaacccggcagatccctccggctgtcttgcgccgctagcgggttcaacttttccaattacgccatccattgggtgcgccagacccctggaaagggccttgaatgggtcacactgatttctaacgacgggagcaataaatattacgcggattccctcaagggaagattcacgatctctcgggacaacagcaaaaataccctgtatcttcagatgaactccctgcgcgctgaggatacagccctctactattgtgccaaggacctgagagaagatgagtgcgaagagtggtggagcgactactatgattttggcaaacagctgccgtgtcggaagtctcgcggcgtggctgggattttcgacggatggggccaagggaccatggttacagtgtccagc

SEQ ID NO: 40077 - RNA, 432 nt, synthetic construct
  misc_feature 1..432: note = derived and/or modified sequence opt5 from anti-HIV_cap256-119-094200_VR-Chain
  source 1..432: mol_type = other RNA
gaggtgcagctggtcgaaagcggcgggggactcgttcaacccggcgggtccctgagactttcttgcgccgctagcggattcatcttttcctcttacgccctgcactgggtgcggcaggcgcctggcaaggggctcgagtgggtggctagcatttccttcgccggaaccaaaaaccattatggcaattctgtcaagggccgctttacaatcagcagagacaactccaaaaatacggtgtacctgcagatgaacagccttcgggccgaagataccgctctgtattactgtgccaaggacctccgcgagtatgaatgcgaggagtggacatctgattactatgacttcgggagaccgcagccctgtattgattcccggggagttgtgggcatcctggacatttggagccaagggaccatggtcacagtgtcttcc

SEQ ID NO: 40078 - RNA, 432 nt, synthetic construct
  misc_feature 1..432: note = derived and/or modified sequence opt5 from anti-HIV_cap256-119-094158_VR-Chain
  source 1..432: mol_type = other RNA
cagatgcaactggtggagagcggcgggggagtcgttcagcccggctcctctctcaccctgagctgcgccgcttcccagttcacattttctaactacgggatgcactgggtgagacaggcccctggaaagggccttgaatgggtggcgagcatctccaatgacgggacgaaaaagtatcatggagattctgtctgggaccggttcaccattagccgcgataactccaaaaatacactgtttctccaaatgaacagcctgagagctgaggacaccgccctttacttctgtgtgaaggatcagcgggaagacgagtgcgaagagtggtggtctgattattacgactttggcaaacagctgccgtgtcgcaagtccagaggcgttgccgggatcttcgatagctggggacagggcacaatggtgaccgtctcttcc

SEQ ID NO: 40079 - RNA, 432 nt, synthetic construct
  misc_feature 1..432: note = derived and/or modified sequence opt5 from anti-HIV_cap256-119-092814_VR-Chain
  source 1..432: mol_type = other RNA
caggtgcaactggtcgagttcggcgggggagttgtgcagcccggcgggagcctcagactgtcctgcgccgcttctggattttacttcaccgactatggcatgcactgggtgcggcaggcccctggggaaggacttcagtgggtcgcgtttatcagctacgatggcaatacaaagacgaccgctgactccgtgcgcggcagattcacactgtctcgggataatagcaaaaacaccctctatctgcaaatgaactccgttcgcgtggaggacacagccagatacttttgtgcccgggatatgcgcgaatatgagtgcgaactttgggcttctgactactatgatttcgggaagccgcagccctgtgaggaccctagaggagtcgtgggcacctttgatatgtgggggctgggaacactcgttaccgtgagctcc

SEQ ID NO: 40080 - RNA, 432 nt, synthetic construct
  misc_feature 1..432: note = derived and/or modified sequence opt5 from anti-HIV_cap256-119-092808_VR-Chain
  source 1..432: mol_type = other RNA
caggtgcaactggtcgagagcggcgggggagttgtgcagcccggcagatccctccggctgtcttgcgccgctagccagttctcctttgggaactacggaatgcactgggtgcgccaggcccctggcaaggggcttgaatgggtcgcggctatctctttcgccggaaccaaaacaaattatgccgacagcgtgaagggcagatttacgatttcccgggataactctaaaaataccgtttacctgcaaatgaacagcctccgcgctgaggacacagccctgtatttctgtgctaaggatatcagagaatacgagtgcgaatattggacctccgactactatgattttggccggccgcagccctgtattgacagccgcggggtggtcggaacattcgatgtgtggggccaggggaccatggttacagtgtcttcc

SEQ ID NO: 40081 - RNA, 432 nt, synthetic construct
  misc_feature 1..432: note = derived and/or modified sequence opt5 from anti-HIV_cap256-119-092573_VR-Chain
  source 1..432: mol_type = other RNA
caggagcaactggtggaaagcggcgggggagtcgttcagcccggcacctccctcagactgtcttgcagcgcctccgggttcacattttctaacttcgctatgaattgggtgcggcaggcccctggaaagggccttgagtgggtgagctttatctcctctgacgggaaaaacaagaattacgtcgatagcgtgaaaggacgcttcacgatttccagagacaactataagaataccctgtacctccagatgaacagcctgcggacagaagataccgcggtttattactgtgctaaagaccttggcggcacaaaggatgacgagtgggccaccgattattacgactggtctacagcctatccggtgcaagatccccgcgctgtcgccgggggatttgacctgtggggcctcgggaccatggtgacggtttccagc

SEQ ID NO: 40082 - RNA, 432 nt, synthetic construct
  misc_feature 1..432: note = derived and/or modified sequence opt5 from anti-HIV_cap256-119-090815_VR-Chain
  source 1..432: mol_type = other RNA
caggtgcaactggtcgagagcggcgggggagttgtggaacccggcagatccctccggctgtcttgcgccgctagccagttctccttttctagctacgggatgcactgggtgcgccaggcccctggaaagggccttgagtgggtcgcggctatctccttcgacggggccgataaatatcatgccgacaacgtgtggggaagactgtctattagccgggataattccaagagcaccctctacctgcagatgaactctcttcgcccggaagacacagctgtttatttttgtgccaaagatctgagagaggacgaatgcgaggagcggtggtccgattactatgacttcggcaagcaactcccctgtcgcaaaagcagaggcgtggctgggatctttgataattggggacagggcacgatggtcaccgtgtctgcc

SEQ ID NO: 40083 - RNA, 438 nt, synthetic construct
  misc_feature 1..438: note = derived and/or modified sequence opt5 from anti-HIV_cap256-119-090368_VR-Chain
  source 1..438: mol_type = other RNA
caggtgcaactggtcgagagcggcgggggagttgtgcagcccggcagatccctccggctgtcttgcgccgctagcgggttcgccttttcccactacggaatcttctgggtgcgccaggcgcctggcaaggggcttgaatgggtcgcttctattagcaacgacggaaccaaaaagtatcatgccgagtccgtgtgggatagattttctatcagcaaagacaattccaagaacacactgttcctccagatgaatagcctgcgggttgaagatacggccctttacttttgtgtgaaagaccaacgcgaggatgaatgcgaggagtggtggtctgactattacgatttcggcagagaactgccgtgtcggaagtcccgcggcctcgggctggctggaatttttgacatgtggggccacgggaccatggtcacagtgagctct

SEQ ID NO: 40084 - RNA, 432 nt, synthetic construct
  misc_feature 1..432: note = derived and/or modified sequence opt5 from anti-HIV_cap256-119-089710_VR-Chain
  source 1..432: mol_type = other RNA
caggtgcaactggtcgagagcggcgggggagttgtgcagcccggcagatccctccggctgtcttgcaccgccagcgggttcggattttccaactacgctatgcactgggtgcgccttgcccctggcaaggggctggaatgggtcgcgtctatcagctatgacggaagagattaccatcacgctggcgccgtgtggggccggttcattatctcccgcgacaattctaaaaacagcctccatctgcagatgaactcccttagaccggaggatacagccctgtatttttgtgctcgggacctccgcgaaagcgagtgcgaagagtgggagtctgattactataatttctggaagaaactgccctgtgttaagcctagaggggtggtcggcattctggacatctggggacaggggacggtggttaccgtgtccagc

SEQ ID NO: 40085 - RNA, 432 nt, synthetic construct
  misc_feature 1..432: note = derived and/or modified sequence opt5 from anti-HIV_cap256-119-088555_VR-Chain
  source 1..432: mol_type = other RNA
caggtgcaactggtcgagagcggcgggggagttgtgcaggccggcagatccctccggctgtcttgcgctgccagccagttcaccttttcccgctacgggatgcactgggtgagacaggcgcccggaaagggccttgaatgggtcgctgggatctcttatgacggacgggataaataccatgcccacttcgtgtggggccgctttattatcagcagagacaactccaagaatacactgtatctccaaatgaactctctgcgggccgaggatacggctctttactattgtgttcgcgacctgagagaaagcgagtgcgaactctgggagtccgattactatgacttcggcaaacggctgccttgtgtgaagccgcgcggggtcgccggaacctttgatctgtggggccaggggacaatggtgaccgttagctct

SEQ ID NO: 40086 - RNA, 432 nt, synthetic construct
  misc_feature 1..432: note = derived and/or modified sequence opt5 from anti-HIV_cap256-119-087962_VR-Chain
  source 1..432: mol_type = other RNA
gagatgcagctggtggaaagcggcgggggactcgtcaagcccggcagatccctgcggctttcttgcgccgctagcgggttcaccttttcctcttacgccatccactgggttcgccaagcgcctggaaaaggcctggagtgggtggctgtgattagctatgacgggtccaacaagtactatgccgattctgtcaaaggaagattcacaatcagccgggacaattccaagaacacggtgtacctccagatgaatagcctgcgcgttgaagataccgccctttattactgtgctaaagacctgagagagtatgaatgcgaggagtggacatctgattactacgactttggcaagccgcagccctgtattgattcccggggcgtggtcgggatcctcgacatttggggacagggcatcatggtgaccgttagctct

SEQ ID NO: 40087 - RNA, 432 nt, synthetic construct
  misc_feature 1..432: note = derived and/or modified sequence opt5 from anti-HIV_cap256-119-086903_VR-Chain
  source 1..432: mol_type = other RNA
caggtgcacctggtcgagagcggcgggggagttgtgcaacccggcaagtccctcagactgtcttgcgccgctagccagttcacctttgaccggtacgggatgcattgggtgcgccaggcccctggaaaaggccttgaatgggtcgcgtccatctctaacgatgggacagacaagtatcacgctgataatgtgtggggaagattcacgattagccgggacaactccaaaaataccctgtacctcgagatgaactctctgcgcggcgaagatacagccctttattactgtgccaaggacatgagagaggatgaatgcgaggagtggtggagcgactattacgattttggccggccgcagccctgtatcgactcccgcggggttgtgggaaccttccatgtctggggccaagggacaatggtgaccgttagctct

SEQ ID NO: 40088 - RNA, 432 nt, synthetic construct
  misc_feature 1..432: note = derived and/or modified sequence opt5 from anti-HIV_cap256-119-086804_VR-Chain
  source 1..432: mol_type = other RNA
gaggtgcagctggtcgaaagcggcgggggagttgtgcaacccggcagatccctccggctgttctgcgccgggtctggatttaccttcagctcctacggccttcactgggtgcgccaggctcctgggaagggactggagtgggtctcttttatcagctatgacggctccacaacgaaatacgccgattctctcaagggcagattcaccgtgagccgggacaactccaaaaatacagtttatctggaaatgaacagccttcgcgcggaggataccgctctgtactattgtgccaaggacctcagagaatacgagtgcgaggaatggacatctgattattacgactttgggcggccgcagccctgtattgattcccgcggagtggtcggcatcctggacatttgggggcagggaaccatggtgacagttagctct

SEQ ID NO: 40089 - RNA, 432 nt, synthetic construct
  misc_feature 1..432: note = derived and/or modified sequence opt5 from anti-HIV_cap256-119-085910_VR-Chain
  source 1..432: mol_type = other RNA
gaggtgcagctgctcgaaagcggcgggggactggtccaacccggcgggtcccttagactgtcttgcgccgctagcggattcaccttttcctcttacggcatgcactgggttcggcaggccgcggggaagggactcgagtgggtggctagcatctcctatgacggccgcgattaccatcacgccggcgccgtgtgggggagattcattatctctcgggacaacagcaaaaattccctgcatcttcagatgaacagcctgcgccctgaagatacagctctctatttttgtgccagagacctgcgggagtctgaatgcgaggagtgggaatccgattactataatttctggaagaaactgccgtgtgtcaagccccgcggagtggttggcattctcgacatctgggggcagggaacggtggtcaccgtgagctct

SEQ ID NO: 40090 - RNA, 432 nt, synthetic construct
  misc_feature 1..432: note = derived and/or modified sequence opt5 from anti-HIV_cap256-119-085772_VR-Chain
  source 1..432: mol_type = other RNA
gaggtgagactggtcgaaagcggcgggggactcatccagcccggcgggtccctgcggctttcttgcgccgctagcggactgaccgtttcctctaatcacatgagctgggtgcgccaagcccctggcaaggggctcgagtgggtggcggtcatttcctacgacggatctaatacattctatggcgatagcgtgaaaggcagatttacggtttcccgggacatcagcaagaacaccctgtaccttcagatgaactctctgcgcccggaagatacagctatgtattactgtgccagagaccagcggtattacgagtgcgaagagtgggcctccgattattacgacttcgggcgcgagcagccctgtcaagatcctagaggagtggtcggcgtgtttgacatgtgggggcagggaaccatggttacagtgagctct

SEQ ID NO: 40091 - RNA, 432 nt, synthetic construct
  misc_feature 1..432: note = derived and/or modified sequence opt5 from anti-HIV_cap256-119-084603_VR-Chain
  source 1..432: mol_type = other RNA
caggtgcaactggtcgagagcggcgggggagttgtgcagtccggccggtctctccggctgagctgcgccgcttccgggttccccttttctgacttcgccatgcactgggtgcgccaggcgcctggaaagggccttgaatgggtcgctagcatctcctttgtggggattaaaacccattacgccaactctgttagaggacggttcacaatcagccgcgatcagtccaagaatacgctgtatctccaaatgaacagcgtgagagtcgaggacaccggccggtactattgtgcccgcgatatgagagaatacgagtgcgaactgtgggcttctgactattacgattttggcaaaccgcagccctgtgaggaccctagaggggtggttggaacattcgatatgtggggccttgggaccctggtgacagtctccagc

SEQ ID NO: 40092 - RNA, 432 nt, synthetic construct
  misc_feature 1..432: note = derived and/or modified sequence opt5 from anti-HIV_cap256-119-084276_VR-Chain
  source 1..432: mol_type = other RNA
caggtgcaactggtcgagagcggcgggggagttgtgcagcccggcagatccctccggctgtcttgcgccgctagccgcttcaccttttcctcttacgccatgcactgggtgagacaggcgcctgggaagggacttgaatgggtcgctgtgatctggtatgacggcagcaacaaatactatgccgattccgttcgggggcgcttctctgtgagcacagacatttccaagaatacgctgtacctccagatgaacagcctgagaccggccgataccgctctttatttttgtgcccgggacctgcgctactatgagtgcgaagagtgggcttctgattactacgacttcggaaaagaacaaccctgtctcgatcctagaggcgtcgtgggcatctttgacctgtgggggcagggaacaatggttaccgtgtccagc

SEQ ID NO: 40093 - RNA, 432 nt, synthetic construct
  misc_feature 1..432: note = derived and/or modified sequence opt5 from anti-HIV_cap256-119-082288_VR-Chain
  source 1..432: mol_type = other RNA
caggtgtacctggtcgagagcggcgggggagttgtgcaacccggcagatccctccggctgtctagcgccgcttcccacttctctcttagctcctatgggatgcattgggtgcgccaggcccctggaaagggcctggaatgggtcgcggggatctcttttgctggaaccaaaacatactatggcgacagcgtgaagggcagattcacggtttccaccgatattagcaaaaacacactctacctgcaggtcaattctcttcggccggaggacaccgccatgtattactgcgcccgcgatcagagatattacgaatgtgaggaatgggcttccgactactatgattttgggaaggagcaaccctgcctggaccctcggggagtggtgggcatcttcgatatttgggggcagggaacaatggttaccgtgagctct

SEQ ID NO: 40094 - RNA, 432 nt, synthetic construct
  misc_feature 1..432: note = derived and/or modified sequence opt5 from anti-HIV_cap256-119-080383_VR-Chain
  source 1..432: mol_type = other RNA
caggtgcaactggtcgagagcggcgggggagttgtgcagcccggcagatccctccggatctcttgcgccgctagccagttcaccttttcccgctacgggatgcactgggtgagacaggcccctggaaagggcctggaatgggtcgcgtctattagctatgacgggacagataaataccatgctcggcttgtgtggggacgcttcacgatctccagagacaactctaagaataccctgtatctccaaatgaacagcctgcgggccgaggatacagccctttactattgtgttcgcgacgaaagagagtccgaatgcgagctgtgggagagcgattactatgactttggcaaaaagctcccgtgtgtgaaaccccggggcgtcaccgggtctctggatatgtggggacagggcacacaggtgaccgtttccagc

SEQ ID NO: 40095 - RNA, 438 nt, synthetic construct
  misc_feature 1..438: note = derived and/or modified sequence opt5 from anti-HIV_cap256-119-079333_VR-Chain
  source 1..438: mol_type = other RNA
gaggtgcagctggtcgaaagcggcgggagactcgttcaacccggatcccctctgcggctttcttgcgccgctagccagttcaactttgcctcctacggcatgcactgggtgcgccaggcgccggggaagggactggagtgggtggcttctatcagcaatgacggcaccaaaaagtatcatgccgaatccgtctgggatagattctctattagcaaagacaactccaagaatacactctttctgcagatgaacagccttcgggtggaggatacggccctgtacttctgtgttaaagaccaacgcgaagatgagtgcgaggaatggtggtctgactattacgattttgggagagagctcccctgtcggaagtcccgcggactgggcctggctggcatcttcgacatgtgggggcacggaaccatggtgacagtcagctct

SEQ ID NO: 40096 - RNA, 441 nt, synthetic construct
  misc_feature 1..441: note = derived and/or modified sequence opt5 from anti-HIV_cap256-119-078618_VR-Chain
  source 1..441: mol_type = other RNA
cagatgcaactggtggagagcggcgggggagtcgttcagcccggcagatccctcaccctgtcttgcgccgctagccagttcaactttgcctcctacgggatgcactgggtgcggcaggcgcctggaaagggccttgaatgggtggcttctatcagcaatgacgggacgaaaaagtatcatgccgagtccgtctgggatcgcttctctattagcaaagacaactccaagaatacactgtttctccaaatgaacagcctgagagtggaagataccacactttacttctgtgttaaagaccagcgggaggatgaatgcgaggagtggtggtctgactattacgattttggacgcgaactgccgtgtagaaagtcccggggcctcggcctggccgggaatttctgcatctgtggagctgacggcaccatggtgacagtcagctct

SEQ ID NO: 40097 - RNA, 432 nt, synthetic construct
  misc_feature 1..432: note = derived and/or modified sequence opt5 from anti-HIV_cap256-119-077466_VR-Chain
  source 1..432: mol_type = other RNA
caggtgcaactggtcgagagcggcgggggagttgtgcagcccggctcccctctcagaatctcttgcgccgtgagccagttcaccttttcccggtacgggatgcactgggtccgccaggctccgggaaagggcctggaatgggtggcctctattagcttcgacgggagagataaatatcattcctctcttgtttggggacggctgacaatcagccgcgacaattccaagagcacgctctttctgcaaatgaactctcttagagcggaggataccgctctgtactattgtgcccgggacctccgcgaatccgagtgcgaagagtgggagagcgattactatgccttctacagaaaactgccctgtgtgaagcctcggggcgtcgctggcacactggacatttgggggcagggaaccatggtgacagtttcttcc

SEQ ID NO: 40098 - RNA, 423 nt, synthetic construct
  misc_feature 1..423: note = derived and/or modified sequence opt5 from anti-HIV_cap256-119-076284_VR-Chain
  source 1..423: mol_type = other RNA
caggtgcaactggtcgagagcggcgggggagttgtgcagcccggcagatccctccggctgtcttgcgccgctagcaacacctacgccatgcactgggtgcgccaggcgcctgggaagggacttgaatggatggctctgatctcctatgagggctctgacaaatactatgtcgatagcgtgaaggggagattcacaatttcccgggacaattctaaaagcacgctctacctgcagatgaactcccttagcgccgaagataccgccgtttatttttgtgctaaggacctgggaggcaataaagatgacgagtggacaaccgattactattacgactggtctaaggcccgcccggtgcaagatcccagagtcgtggctggcacattcgacatctgggggcagggaaccatggttacagtgtccagc

SEQ ID NO: 40099 - RNA, 432 nt, synthetic construct
  misc_feature 1..432: note = derived and/or modified sequence opt5 from anti-HIV_cap256-119-074680_VR-Chain
  source 1..432: mol_type = other RNA
gaggtgcagctggtcgaaagcggcgggggactcgttcaacccggcagatccctgcggctttcttgcgccgggagcggattcacctttgtggactacgctatgcactgggtgcgccaggtccctggcaaggggctggagtgggtgggatccatctcttatgatggcagcgacaaataccatacaaattccgtttggggcagattcattgtgtctcgggataatagcaagaacacgctctatctgcagatgaactcccttcgcccggaagacaccgccctgtactattgtgtcagagatcggcgcgagagcgaatgcgaggagagatggtctgactactatgattttgggaaacagctcccctgtgtgaagcctcggggagttgcgggcatcttcgacatttgggggcaaggaacaatggtgaccgtctccagc

SEQ ID NO: 40100 - RNA, 432 nt, synthetic construct
  misc_feature 1..432: note = derived and/or modified sequence opt5 from anti-HIV_cap256-119-074081_VR-Chain
  source 1..432: mol_type = other RNA
gaggtgcagctggtcgaaagcggcgggggactcgttcaacccggcgggtccctgagactttcttgcgtggtgagcggagtcaccgtgtcctctaactacatgagctgggttcggcaggcccctggcaaggggctggagtgggtggcttccatctcttatgacggaagcgataaataccacgccgaccgcgtctggggcagattcacaatttcccgggataatagcaagaacacgctctatctgcagatgaactctcttcgcgcggaagacaccgctctgtactattgtgtgagagatgcccgggagtccgaatgcgagctctgggagagcgactactataattttggccgcaaactgccgtgtgttaagcccagaggggtggccggaacactggatatctggggccaggggaccatggtcacagtgtcttcc

SEQ ID NO: 40101 - RNA, 432 nt, synthetic construct
  misc_feature 1..432: note = derived and/or modified sequence opt5 from anti-HIV_cap256-119-071704_VR-Chain
  source 1..432: mol_type = other RNA
cagatgcaactggtggagagcggcgggggagtcgttcagcccggcgggtccctcagactgtcttgcgccgtgagccagttcacctttacatcctacggaatgcactgggtgcggcaggctcctggcaaggggcttgaatgggtcgccacgatctctagcgacggatccaaaaagtatcatggcgattctgtgtggggccgcctgaccattagcagagacaactccaaaaatacactcttcctgcaaatgaacaatcttcgggcggaggataccgctctgtacttttgtgttaaggaccagcgcgaagatgagtgcgaagagtggtggagcgactattacgatttcgggaaaaagctcccgtgtagaaagtctcccggactggccggcatctttgacgtgtgggggcacggaacaatggtcaccgtgtcccct

SEQ ID NO: 40102 - RNA, 432 nt, synthetic construct
  misc_feature 1..432: note = derived and/or modified sequence opt5 from anti-HIV_cap256-119-071266_VR-Chain
  source 1..432: mol_type = other RNA
caggtgcaactggtcgagagcggcgggggagttgtgcagcccggcgaatccctcagactgtcttgcgccgctagcgggttcaccttttcctctttcggaatgcactgggtgcggcaggcccctggcaaggggcttgagtgggtcggaagcatctcctacgacggctctgataaatatcatacaaatagcgtgtggggccgctttattgtttccagagacaatagcaagaacacgctgtacctccagatgaactctctgcggccggaagataccgcgctttattactgtgtgcgcgacagacgggagtccgaatgcgaggagcgctggagcgattattacgacttcgggaaacaactgccctgtgtcaagcctagaggagtggctggcatctttgatatttgggggcagggaacaatggttaccgtgtcttcc

SEQ ID NO: 40103 - RNA, 432 nt, synthetic construct
  misc_feature 1..432: note = derived and/or modified sequence opt5 from anti-HIV_cap256-119-069667_VR-Chain
  source 1..432: mol_type = other RNA
gaggtgcagctggtcgaaagcggcgggggactcgttcaacccggcagatccctgcggctttcttgcgccgctagcgggttctcctttaacacctacggaatgcactgggtgcgccaggcccctggcaaggggctggagtgggtggcgttcatcagatatgacggatctaataaatactatgctgatagcgtcaagggccggtttacaatttcccgcgacaactctaaaaatacgctctacctgcagatggatggccttagaggggaagacaccgccctgtattactgtgccaaggatctccgggagctggaatgcgaggagtgggctagcgactattacgatttcggacgcccgcagccctgtctggaccctagaggcgtgtccgggatcagcaacgtttggggacaaggcacaatggtgaccgtctcttcc

SEQ ID NO: 40104 - RNA, 432 nt, synthetic construct
  misc_feature 1..432: note = derived and/or modified sequence opt5 from anti-HIV_cap256-119-069591_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgggatcagctatgacggatccgataaataccatgccgacaaggtgtggggcagattcacaatttctcgggataacagcaaaaatacgctgtatctccagatgaactccctgcgcgccgaggacaccgctctttactattgtgccaaggatctgagagaagacgagtgcgaagagtggtggagcgattactatgactttggcaaacggctcccgtgtcgcaagtctagaggggttgctggagtgttcgataagtggggccaagggacaatggtcaccgtgtccagc

SEQ ID NO: 40105 - RNA, 432 nt, synthetic construct
  misc_feature 1..432: note = derived and/or modified sequence opt5 from anti-HIV_cap256-119-068691_VR-Chain
  source 1..432: mol_type = other RNA
cagggccacctggtggccagcgggggaggcgtcgttccccctgggagatccctcaccctgtcttgccttgctagccaattcacattttccggatacggcttccattgggtgcggcaggccccggggaagggactggagtgggtggcgtctatcagctttgctggcacgaaaaagcactatggcaattccgtcaaagggcgcttcaccatttctagagacaatagcaagaacacactctacctggaaatgaactcccttcggcccgaggataccgccctgtattactgtgccaaagaccgcagagaatatgagtgcgaagagtggacaagcgattactatgactttggacggcctcagccctgtatcgattctcgcggcgtggttgggattctcgacatctggggaagaggcaccatggtgacagtctccagc

SEQ ID NO: 40106 - RNA, 432 nt, synthetic construct
  misc_feature 1..432: note = derived and/or modified sequence opt5 from anti-HIV_cap256-119-068488_VR-Chain
  source 1..432: mol_type = other RNA
cagatgcaactggtggagagcggcgggggagtcgttcagcccggcatgtccctcaccctgtcttgcgccgctagccagttcacattttccaactacgggatgcactgggtgagacaggcccctggaaagggccttgaatgggtggcgtctatcagcaatgacgggtccaaaaagtatcatggagattctgtcaaaggccggttcacgattagccgcgacaactccaagaataccctgtacctccaaatggatggcctgagaggggaggacacagctctttattactgtgccaaagatctgcgggaactcgagtgcgaagagtgggccagcgactattacgattttggacgcccgcagccctgtctggaccctagaggcgtgtctgggatctccaacgtttggggacagggcaccatggtgacagtcagctct

SEQ ID NO: 40107 - RNA, 432 nt, synthetic construct
  misc_feature 1..432: note = derived and/or modified sequence opt5 from anti-HIV_cap256-119-067536_VR-Chain
  source 1..432: mol_type = other RNA
caggtgcaactggtcgagagcggcgggggagttgtgcagcccggcagatccctccggatctcttgcgccagctcccagttcaccttttctcgctacgggatgcactgggtgagacaggctcctggaaagggcctggaatgggtcgccagcatttcctatgacgggcgggattaccatcacgcgggagctgtgtggggccgcttcatcatttctagagacaacagcaaaaattcccttcatctgcaaatgaacagcctccggccggaggatacagccctgtatttttgtgcccgcgaccttagagaatctgagtgcgaagagtgggagtccgattactatgctttctaccggaagctgccctgtgttaaacctcgcggcgtggccgggacgctcgacatctggggacagggcaccatggtcacagtgagctct

SEQ ID NO: 40108 - RNA, 432 nt, synthetic construct
  misc_feature 1..432: note = derived and/or modified sequence opt5 from anti-HIV_cap256-119-065852_VR-Chain
  source 1..432: mol_type = other RNA
caggtgcacctggtcgagagcggcgggggagccgttccctccggcagatctctccggctgagctgcgtggcttccgggttcacctttggagtgtacgacatccattgggtccgccaagcccctggcaaggggcttgaatgggtggcgtctattagctatgatggaagagacaaataccactcctctctggtttggggccggctcacaatcagccgcgataattccaagagcacgctgttccttcagatgaactctctgagagctgaggacaccgccctctattactgtgcccgggatctgcgcgaatccgagtgcgaagagtggcagagcgactattacgctttttataaaaagctgccgtgtgtgaaacccagaggcgtcgccgggacactcgatatttggggacagggcaccatggtgacagtttcttcc

SEQ ID NO: 40109 - RNA, 432 nt, synthetic construct
  misc_feature 1..432: note = derived and/or modified sequence opt5 from anti-HIV_cap256-119-065457_VR-Chain
  source 1..432: mol_type = other RNA
ctgggcagactcgtggccagcgggggaggcgtcgttccccctgggcggtccccgcgcctgtcttgcgtggctagccagttcaccttttccggatgtggccttcactgggtgagacaagcccccgggaagggactggagtgggtcgcggctatctctttcgacggcacagataaataccatagcgacgatgtgtggggccggtttacgatttcccgcgacaactctaagaataccctctatctgcagatgaacagccttagacctgaagatacagccctgtactattgcgccaaagacctccaggaggatgaatgtgaggaatggtggtccgactactatgatttcgggaagcagctgccctgccggaaaagccgcggagttgctggcatctttgacgattgggggcaaggaaccatggtgacagtctcttcc

SEQ ID NO: 40110 - RNA, 432 nt, synthetic construct
  misc_feature 1..432: note = derived and/or modified sequence opt5 from anti-HIV_cap256-119-064501_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgggatcagctatgacggaagagataaataccatgcccactccgtgtggggccggctgtctattagccgcgacaactccaagaatacactctatctgcagatgaacagccttagaacggaggataccgccctgtaccattgtgttcgggacctccgcgaatctgagtgcgaactgtgggagtccgattattacgacttcggcaaaaagctgccgtgtgtgaaacccagaggggtcgctggaacatttgatctctggggccaagggaccatggtgacagttagctct

SEQ ID NO: 40111 - RNA, 432 nt, synthetic construct
  misc_feature 1..432: note = derived and/or modified sequence opt5 from anti-HIV_cap256-119-063568_VR-Chain
  source 1..432: mol_type = other RNA
caggtgcaacccgtcgagagcggcgggggagttgtgtggcctggcagatccctgcggctctcttgcaccacaagcgggttcacgttttccaactacgccatccactgggtgcgccaggctccgggaaagggcctgcagtgggtcgccgtgatttcttatgacgggagcaataaattctacgcggattccgttaagggaagatttaccatctctcgggacaacagcaaaaatacactttatctgcagatgaactccctccgccccgaagataccgctctgtactattgtgccaaggaccttagagaggatgaatgcgaggaacggtggagcgactactatgatttcggcaaacaactgccttgtcgcaagtctagaggcgtggccggggtctttgacaattggggacagggcacaatggtgaccgtttccagc

SEQ ID NO: 40112 - RNA, 435 nt, synthetic construct
  misc_feature 1..435: note = derived and/or modified sequence opt5 from anti-HIV_cap256-119-063103_VR-Chain
  source 1..435: mol_type = other RNA
caggtgcaactggtcgagagcggcgggggactcgttcagcccggcaagtccctgagactttcttgcgccgctagcgggttcaccttttccacatacggaatgcactgggtgcggcaggcccctggcaaagggctggaatgggtggcgctcatctcttatgacggaagctacacgtattacgctgattccgtcaagggccgcttcaccatttctagagacaacagcaaatccacactggatcttcagctgaataccctccggccggaggacacagccctgtattactgtgcccgcgatctgagagaaatggagtgcgaagagtggaagctctataactactacgactttcggacccgcggcccctgtgtggatcctagaggggttgtgggcagcttcgacgtctggggacaagggacagtggttaccgtgtcttcc

SEQ ID NO: 40113 - RNA, 432 nt, synthetic construct
  misc_feature 1..432: note = derived and/or modified sequence opt5 from anti-HIV_cap256-119-061027_VR-Chain
  source 1..432: mol_type = other RNA
caggtgcaactggtcgagagcggcgggggagttgtgcagcccggcagatccctccggctgtcttgcagcgcctccgggttcaccctttctagctacggaatccactgggtgcgccaggctcctggcaaggggctggaatgggtcgccgtgatgtccaatgacggatctaatcagttttatggcgatagcgttaaaggcagattcacaatttcccgggacatcagcaagaacacgctctacctgcaaatgaactctcttcgcccggaggataccgcgatgtattactgtgctagagaccagcggtattacgaatgcgaggaatgggcctccgattattacgactttgggcgcgagcagccctgtcaggatcctagaggagtggtcggcgtgttcgacatgtgggggcaaggaacaatggttaccgtgagctct

SEQ ID NO: 40114 - RNA, 432 nt, synthetic construct
  misc_feature 1..432: note = derived and/or modified sequence opt5 from anti-HIV_cap256-119-058232_VR-Chain
  source 1..432: mol_type = other RNA
caggtgcaactggtcgagagcggcgggggagttgtgcagcccggcaagtccctcagactgtcttgcaaagccagccagttcacctttaatcggtacgggatgcactgggtgcgccaggctcctggaaagggccttgaatgggtcgccgcgatctccttcgacgggacagataaatatcatgctgacaaggtgtggggaagatttacgatttctcgggatgacagcaaatccaccctgtacctccaaatgaactctctgcgcgccgaggatacagccctttattactgtgctaaggacctgagagaagatgagtgcgaagagtggtggagcgactattacgatttcggcaagcagctcccgtgtcggaaatcccgcggcgttgccgggatctttgacggatggggccaggggaccatggtgacagtcagctct

SEQ ID NO: 40115 - RNA, 432 nt, synthetic construct
  misc_feature 1..432: note = derived and/or modified sequence opt5 from anti-HIV_cap256-119-057341_VR-Chain
  source 1..432: mol_type = other RNA
caggtgcaactggtcgagagcggcgggggagttgtgcagcccggcagatccctccggctgtcttgcgccgctagccacttctccctttctagctacgggatgcattgggtgcgccaggcccctggaaagggcctggaatgggtcgcgggggagtcctttgctgccaccaacaaatattacgccgactctgtgaagggaagattcatcgttagccgggatatttccaaaaatacactctatctggaagtgaacagccttcgcgctgaggacacggccctgtactattgtgctagagatcagcggtactatgaatgcgaggagtgggcctctgactactacgattttggccgcgaacaaccgtgtcaggaccccagaggcgtcgcggggatcttcgatatttggggacagggcaccatggtgacagtttccagc

SEQ ID NO: 40116 - RNA, 438 nt, synthetic construct
  misc_feature 1..438: note = derived and/or modified sequence opt5 from anti-HIV_cap256-119-056895_VR-Chain
  source 1..438: mol_type = other RNA
cagatgcaactggtggagagcggcgggggagtcgttcagcccggcagatccctccggctgtcttgcgccgctagccagttcacctttgggtcctacggaatgcactgggtgcgccagatccctggcaaggggcttgaatgggtggccacaatttcttatgacggaacgaaaaagtaccatgcggatagcgtctgggacagattcatcatttcccgggataactctaaaaataccctgtttctccaaatgaacagcctgcgcccggaggacacagctctttatttctgtgtgaaggatcagagacaggacgaatgcgaggaatggtggtccgattactatgactttggccgggagctgccctgtcgcaaaagcagaggcctcgggctggccggaatcttcgatatgtggggccacgggaccatggttacagtgtcttcc

SEQ ID NO: 40117 - RNA, 432 nt, synthetic construct
  misc_feature 1..432: note = derived and/or modified sequence opt5 from anti-HIV_cap256-119-056402_VR-Chain
  source 1..432: mol_type = other RNA
caggtgaagctggtcgagagcggcgggggagttgtgcaacccggcaaatccctcagactgtcttgcaccgccagccagttcacattttccaatttcgggatgcactgggtgcggcaggctcctggaaagggccttgaatgggtcgcctctatcagctttgtggggattaaaaagcattacgctaattccgttcgcggaagattcacgatctctcgggaccagagcaaaaacaccctgtatctccaaatgaactccgtgcgcgtcgaggatacagcgagatacttttgtgcccgggacatgcgcgaatatgagtgcgaactgtgggccagcgattactatgacttcggcaagccgcagccctgtgaggatcctagaggcgtggttgggacctttgacatgtggggacttggcacactggtgaccgtctcttcc

SEQ ID NO: 40118 - RNA, 432 nt, synthetic construct
  misc_feature 1..432: note = derived and/or modified sequence opt5 from anti-HIV_cap256-119-056034_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgccatcagcttcgccgggacaaaaacgcattatgctgactccgtgaagggaagatttaccatttctcgggataacagcaaaaatgccctgtacctccagatgaacaatctgcgcgctgaggacacagccctttattactgtgcgaaggatctgagagaagacgagtgcgaggaacggtggtccgattattacgacttcggcaaacaactcccgtgtcgcaagagcagaggcgttgccggggtgtttgataactggggacagggcaccatggtcacagtgtcttcc

SEQ ID NO: 40119 - RNA, 432 nt, synthetic construct
  misc_feature 1..432: note = derived and/or modified sequence opt5 from anti-HIV_cap256-119-055042_VR-Chain
  source 1..432: mol_type = other RNA
caggtgcaactggtcgagagcggcgggggagttgcccagcccggccggtccctccggctgtcttgcgctgccagcgggttcacctttcgctcctacggaatgcactgggtgagacaggcgcctggcaaggggcttgaatgggtggctgtcatctctctggacggaagcaacaaatattacgccgattccgtgaagggccggttctctattagccgcgacaattccaaaaacacactctatctgcagatgaatagccttagaccggaggatacggccgtttactattgtgctaaggacctgcgggaagatgagtgcgaggaacgctggtctgactactatgattttggcaaacaactcccctgtagaaagtccagaggggtggccggagtcttcgacaactggggccaggggaccatggtgacagttagctct

SEQ ID NO: 40120 - RNA, 438 nt, synthetic construct
  misc_feature 1..438: note = derived and/or modified sequence opt5 from anti-HIV_cap256-119-054776_VR-Chain
  source 1..438: mol_type = other RNA
caggtgcaactgatggagagcggcgggggagtcgttcagcccggcagatccctccggctgtcttgcaccgccagcgggttcacattttcctcttacagcatgcactgggtgcgccaggctcctggaaagggccttgaatgggtggccatcatttcctatgacgagtctaacaaatactatgcggatagcgtccaggggagattcacgatctcccgggacaatagcaagaacaccctgtttctccaaatgtcttccctgcgcgctgaagatacagccctttacttctgtgtgagagaccatcgggaggatgaatgcgaggagtggtggagcgactattacgattttggacgcgaactgccgtgtagaaaattccggggcctcggcctggccgggatttttgacatctggggacacggcaccatggttacagtgtcttcc

SEQ ID NO: 40121 - RNA, 432 nt, synthetic construct
  misc_feature 1..432: note = derived and/or modified sequence opt5 from anti-HIV_cap256-119-054539_VR-Chain
  source 1..432: mol_type = other RNA
cagatgcaactggtggagagcggcgggggagtcgttcagcccggcgggtccctcagactgtcttgcgccgctagccagttcacctttggatcctacgccatgcactgggtgcggcagcctccgggcgaacgccccgagtgggtggcgacaatctctttcgacgggacgaagaaatatcatgctgatagcgtctggggaagatttaccatttcccgggacaactctaagaatacacttttcctgcaaatgaacagcctccgccctgaagataccgccctgtacttttgtgtgaaagaccagagagaggatgcctgcgaagagtggtggtccgactattacgatttcggcaagaattgtcttgctgagagccccggcgcctggctggaatttttctatgtttgggggcacggaacaatggtgaccgtctcttcc

SEQ ID NO: 40122 - RNA, 432 nt, synthetic construct
  misc_feature 1..432: note = derived and/or modified sequence opt5 from anti-HIV_cap256-119-054112_VR-Chain
  source 1..432: mol_type = other RNA
caggtgcaactggtcgagagcggcgggggagttgtgcaggccggcagatccctccggctgtcttgcgctgccagcgggttcaccttttccacatacgcgatgcactgggtgcgccaggctcccggaaagggccttgaatgggtcgccgtgatctcttatgacgggagcaataaatactatgccgattccgttagaggacggttcacgatttctcgcgacaatagcaagaacaccctgtacctccagatgaactccctgagagctgaggatacagccctttattactgtgctaaagacatgcgggaatatgagtgcgaagagtggaccagcgattactacgactttggccgccctcaaccgtgtatcgattctagaggcgtggtcgggacattccatgtgtggggacagggcaccatggttacagtgtccagc

SEQ ID NO: 40123 - RNA, 432 nt, synthetic construct
  misc_feature 1..432: note = derived and/or modified sequence opt5 from anti-HIV_cap256-119-053339_VR-Chain
  source 1..432: mol_type = other RNA
caggtgcacctggtcgagagcggcgggggagttgtgcaacccggcagatccctccggctgtcttgcgccgctagccatttctccctttctagctacgggatgcactgggtgcgccaggcccctggaaagggcctggaatgggtcaccgggatctcctttgcgggaacaaaaacgtattacggcgactctgtgagaggccggttcaccgttagccgcgatatttccaagaacacactcctgcttcagatgaatagcctgagaccggacgataccgctatctattactgtgcccgggaccagcgctattacgagtgcgaagagtgggcctctgattattacgactttgggaaagaacaaccctgtctcgatcctagaggagtggtcggcattttcgacctgtgggggcagggaacaatggtgaccgtttccagc

SEQ ID NO: 40124 - RNA, 432 nt, synthetic construct
  misc_feature 1..432: note = derived and/or modified sequence opt5 from anti-HIV_cap256-119-052404_VR-Chain
  source 1..432: mol_type = other RNA
cagatgcaactggtggagagcggcgggggagtcgttcagcccggcagatccctcaccctgtcttgcatcgccagccagttcaactttgcttcctacgggatgcactgggtgcggcaggcccctggaaagggccttgaatgggtggcgtctattagccatgacgggacgaaaaagtatcacgctgagtccgtctggggacgcttcacaatctctaaagataatagcaagaacaccctgtttctccaaatgaactccctgagagtggaagacacagccctttacttctgtgttaaagatcagcgggaggacgaatgcgaggagtggtggagcgattattacgactttggcaagcagctgccgtgtcgcaagtctagaggcgtggccggggtcttcgataattggggacagggcaccatggtgacagtttccagc

SEQ ID NO: 40125 - RNA, 432 nt, synthetic construct
  misc_feature 1..432: note = derived and/or modified sequence opt5 from anti-HIV_cap256-119-051123_VR-Chain
  source 1..432: mol_type = other RNA
caggtgcaactggtcgagagcggcgggggagttgtgcagcccggcgggtccctcagactgtcttgcgtgggaagccagttcatcctttaccggtatggcatgcactgggtccgccaggcccctgggaagggactggaatgggtggctgccgtttcctttgacggcaccgataaataccatgcggacgatgtgtggggcagattcacaatttctcgggacaacagcaagaatatcctctatctgcaaatgaactcccttcgcgctgaggatacggccctgtactattgtgccaaagacctcagagaagatgagtgcgaagagtggtggtctgactactatgatctggggaagcagctgccgtgtcggaaaagccgcggagtcgctggcgtgtttgacaagtgggggctcggaaccatggttacagtgtccagc

SEQ ID NO: 40126 - RNA, 438 nt, synthetic construct
  misc_feature 1..438: note = derived and/or modified sequence opt5 from anti-HIV_cap256-119-051077_VR-Chain
  source 1..438: mol_type = other RNA
gaggtgcagctggtcgaaagcggcgggggagttgtgcaatccggcagatctctccggctgagctgcgccgcttcccacttcaccttttctcgctacgggatgcattgggtgagacaggcccccggaaagggccttgagtgggtcgcgagcatctcctatgacgggcgggatttctaccacgctcgctctgtgtggggaagatttacaattagccgggacaactccaaaaatacgctgttcctccagatgaacagcctgcgcatcgaagataccgccctttatttttgtgttaaggaccagagagaggatgaatgcgaggagtggtggtctgactactatgatttcggccgggaactgccttgtcgcaaatccagaggcctcgggctggccggaatttttgacatgtggggccatgggacaatggtgaccgtcagctct

SEQ ID NO: 40127 - RNA, 432 nt, synthetic construct
  misc_feature 1..432: note = derived and/or modified sequence opt5 from anti-HIV_cap256-119-050442_VR-Chain
  source 1..432: mol_type = other RNA
caggcccaaatggtggagagcggcgggggagtcgttcagcccggcagatccctgcggctctcttgcgctgccagcgggttctccttttcttacttcgcgatgcactgggtgcgccaggctcctggaaagggcctggaatgggtggccgggatcagctttgccgctaccaaaacatattacggaggctccgtcaagggcagattcacggtgtctcgggacattagcaaaaataccctttatctgcagatgaactccctccgcccggaggatacagccatgtactattgtgctagagaccaacggtactatgaatgcgaggaatgggccagcgattactacgactttgggcgcgagcagccctgtcaggatcctagaggagttgtgggcgtcttcgacatgtgggggcagggaaccatggtgacagtttcttcc

SEQ ID NO: 40128 - RNA, 432 nt, synthetic construct
  misc_feature 1..432: note = derived and/or modified sequence opt5 from anti-HIV_cap256-119-049433_VR-Chain
  source 1..432: mol_type = other RNA
caggtgcaactggtcgagagcggcgggggagttgtgcagcccggcagatccctccgggtgtcttgccgcgccagcgggttcgctttttcctcttacgccatgcactgggtcagacaggcgcctgtgaagggactggaatgggttgctcttaccagctccgacggcgccgataaatatcatgccgacgatgtgtgggggcggttcacaatctctcgcgacaacagcaagaatacgctgtacctccagatgaactccctgagaccggaggataccgctctttattactgtgccaaagacctgcgggaagatgagtgcgaggaacgctggagcgactattacgattttggaaagcaactcccctgtagaaaatctcggggcgtcgctggcgtgttcgacaattgggggcagggaacaatggttaccgtgtccagc

SEQ ID NO: 40129 - RNA, 432 nt, synthetic construct
  misc_feature 1..432: note = derived and/or modified sequence opt5 from anti-HIV_cap256-119-047532_VR-Chain
  source 1..432: mol_type = other RNA
ctgggcagactcgtggccagcgggggaggcgtcgttccccctgggcggtccctgaccctttcttgcgtggctagccagttcacattttccggatgtggcctgcactgggtgcgccaagccccggggaagggactcgagtgggtcgcgtctatcagcttcgctggcacgaaaaagcattacaccaattccgtgagaggccggtttacaatttctcgcgacaatagcaaaaacaccgtttatctgcagatgaactcccttagagccgaagatacagccctgtactattgcgctaaggacatgggggagtacgaatgtgaggaatggaccagcgattattacgacttcggacggccccagccttgcatcgattctcgcggcgtggtcgggattctcgacatctggggacagggcacaatggtgaccgtttccagc

SEQ ID NO: 40130 - RNA, 432 nt, synthetic construct
  misc_feature 1..432: note = derived and/or modified sequence opt5 from anti-HIV_cap256-119-047489_VR-Chain
  source 1..432: mol_type = other RNA
caggtgcacctggtcgagagcggcgggggagttgtgcaacccggcaagtccctcagactgtcttgcgccgctagccagttcacctttaatcggttcgggatgcattgggtgcgccaggcccctggaaaaggccttgaatgggtcgcggggatctcctacgacggatctgataagtatcacgctgacaaagtgtggggcagatttacaattagccgggataattccaagaacacgctgtacctccagatgaactctctgcgcgccgaggacaccgccctttattactgtgctaaagatctgagagaagacgagtgcgaagagtggtggagcgattattacgacttcggcaagcggctcccgtgtcgcaagtccagaggggttgccggagtgtttgataaatggggccaagggacaatggtcaccgtgagctct

SEQ ID NO: 40131 - RNA, 438 nt, synthetic construct
  misc_feature 1..438: note = derived and/or modified sequence opt5 from anti-HIV_cap256-119-046020_VR-Chain
  source 1..438: mol_type = other RNA
gaggtgcagctgctccaaagcggcgggggactggtccagcccggcgggtcccttagactgtcttgcgccgctagcggattctccttttctagctacgccatgtcctggatccggcaggcgcctggcaaggggctcgaatgggttgcttctattagccacgacggaaccaaaaagtatcatgccgagtccgtgtggggccgcttcacaatcagcaaagataactctaagaatacgctgtttcttcagatgaactccctgagagtggaagacaccgccctctacttctgtgtcaaagatcaacgggaggacgaatgcgaggagtggtggagcgattattacgactttggccgcgaactgccgtgtagaaagtctcgggggctgggactcgctggcattttcgatatgtgggggcacggaacaatggtgaccgtttccagc

SEQ ID NO: 40132 - RNA, 432 nt, synthetic construct
  misc_feature 1..432: note = derived and/or modified sequence opt5 from anti-HIV_cap256-119-044746_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacaaatactatgccgattctgttaagggaagattcacaattagccgggacaattccaaaaacacggtgtacctggagatgaatagcctccgcgccgaagataccgctctgtattactgtgccaaggaccttagagagtatgaatgcgaggagtggacatctgattactacgactttggccggccgcagccctgtatcgattcccgcggcgtcgtggggattctggacatctggggacaaggcaccatggttacagtgagctct

SEQ ID NO: 40133 - RNA, 432 nt, synthetic construct
  misc_feature 1..432: note = derived and/or modified sequence opt5 from anti-HIV_cap256-119-044740_VR-Chain
  source 1..432: mol_type = other RNA
cagatgcacctggtggagagcggcgggggagtcgttcaacccggcatgtccctcagactgtcttgcgccgctagccagttcaactttgggtccttcggaatgcattgggtgcggcaggcccctggcaaggggcttgaatgggtggcgaccatctcttacgacggaacgaaaaagtatcacagcgattccgtctggggccgcctgtctattagcagagacaattccaaaaacacactctttctgcagatgaatagccttcggaccgaggatacagctctgtacttctgtgtgcgcgaccaaagagaagatgactgcgaggaatggtggtctgattattacgactttggcaagaaactcccgtgtcggaagtcccgcgggctggccggaatcttcgatatttggggccatgggaccatggttacagtgagctct

SEQ ID NO: 40134 - RNA, 432 nt, synthetic construct
  misc_feature 1..432: note = derived and/or modified sequence opt5 from anti-HIV_cap256-119-043790_VR-Chain
  source 1..432: mol_type = other RNA
ctgctccagctggtggagagcggcgggggagtcgttcaacccggcaactcccttagactgtcttgcgccgctgccgggttcacctttagcgactactccctccactgggtgcggcaggcgcctggaaagggcctggaatgggtggctatgatctctgatgacgggaatcttgatttctatgccgccagcgtcaaaggacgctttacaatttccagagacaactctatcaatacggtgtacctgcagatgaacagcctccgggctgaggataccgccctgtattactgtgctaaggacctgcgcgaatatgagtgcgaagagtggacatccgattactatgacttcggcagaccgcagccctgtattgatagccggggcgttgtggggatcctcgacatttggtctcaaggaaccatggtcacagtgtccagc

SEQ ID NO: 40135 - RNA, 432 nt, synthetic construct
  misc_feature 1..432: note = derived and/or modified sequence opt5 from anti-HIV_cap256-119-042880_VR-Chain
  source 1..432: mol_type = other RNA
gaggtgagactggtcgaaagcggcgggggactcgttcagcccggcgggtccctgcggctttcttgcgccgctagcggattcaccctgtccgactactatatgtcttggatccgccaagcccctggcaaggggctcgagtgggtggcggctattagctttgccggaacgaaaaagcactacggcaattccgtgaaaggcagattcacaatctctcgggataatagcaagaacaccctgtatcttgaaatgaactccctgcgcgtcgaggacacagccctctactattgtgctaaagatctgagagaatacgagtgcgaggaatggaccagcgactattacgattttgggcggccgcagccctgtattgactctcgcggagtggttggcatcctggatatttgggggcagggaacaatggtgaccgtctccagc

SEQ ID NO: 40136 - RNA, 432 nt, synthetic construct
  misc_feature 1..432: note = derived and/or modified sequence opt5 from anti-HIV_cap256-119-042606_VR-Chain
  source 1..432: mol_type = other RNA
cagatgcaactggtggagagcggcgggggagtcgttcagcccggcagatccctccggctgtcttgcgccgctagccagttcacctttgggtcctacggaatgcactgggtgcgccagatccctggcaaggggcttgaatgggtgacaggaatttctttcgccgcgacgaaaacctattacggcgacagcgtcagaggccggtttacagtgtcccgcgatatctctaagaacaccctgtatctccaaatgaatagcctgagaccggaggacacagctatgtactattgtgcccgggatcagcgctactatgaatgcgaggaatgggcctccgactactacgatttcgggagagagcagccctgtcaggaccctcggggagttgtgggcattcttgatctgtgggggcaaggaaccatggtcacagtgagctct

SEQ ID NO: 40137 - RNA, 432 nt, synthetic construct
  misc_feature 1..432: note = derived and/or modified sequence opt5 from anti-HIV_cap256-119-042444_VR-Chain
  source 1..432: mol_type = other RNA
caggtgcaactggtcgagagcggcggggacgttgtgcaccccggaggctccctcagactgtcttgcgccgctagcgggttcaccttttcctcttacggaatccattgggtgcggcaggcccctggcaaggggcttgaatgggtcgcggctattagctatgatggatccgacaaataccacacaaactctgtgtggggccgcttcacggttagcagagataattccaagaacaccgtgtatctgcagatgaatagcctccgggccgaggacacagccctgtacttttgtgtccgcgatagacgggaatctgagtgcgaactttgggagtccgactattacgatttcggcaaacgcctgccgtgtgtgaagcccagaggggttgctggagtgtttgacatctggggccaggggaccatggtcacagtgagctct

SEQ ID NO: 40138 - RNA, 432 nt, synthetic construct
  misc_feature 1..432: note = derived and/or modified sequence opt5 from anti-HIV_cap256-119-040328_VR-Chain
  source 1..432: mol_type = other RNA
caggtgcaactggtcgagagcggcgggggagttgtgcagcccggcgggtccctcagactgtcttgcgccgctagcggattcaccttttcctcttacagcatgaactgggtgcggcaggcccctggcaaggggcttgaatgggtcgcgtccatctctttcgctggaacaaaacagcactatggcaatagcgtgaagggccgctttacgatttccagagacaacagcaaaaataccgtttacctgcaaatgaactctctccggctggaggatacagccctttattactgtgccaaggacctgcgcgaatatgagtgcgaagagtggacctccgattactatgacttcgggagaccgcagccctgtatcgatagccggggagtggtcggcattctcgacatctgggggcagggaacaatggtgaccgtttcttcc

SEQ ID NO: 40139 - RNA, 432 nt, synthetic construct
  misc_feature 1..432: note = derived and/or modified sequence opt5 from anti-HIV_cap256-119-040164_VR-Chain
  source 1..432: mol_type = other RNA
cagatgcacctggtggagagcggcgggggagtcgttcaacccggcatgtccctcagactgtcttgcgccgctagccagttcaactttgggtccttcggaatgcattgggtgcggcaggcccctggcaaggggcttgaatgggtggcgaccatctcttacgacggaacgaaaaagtatcacagcgattccgtctggggccgcttttctattagcagagacaattccaaaaacacactgtacctccagatgaatagcctgcggaccgaggatacagctctttatttctgtgccaaggacctgcgcgaatacgagtgcgaagagtggacctctgattattacgactttggcagaccgcaaccctgtatcgattcccggggagtggttgggattctcgacatctggggccaggggacaatggtgaccgtcagctct

SEQ ID NO: 40140 - RNA, 432 nt, synthetic construct
  misc_feature 1..432: note = derived and/or modified sequence opt5 from anti-HIV_cap256-119-039130_VR-Chain
  source 1..432: mol_type = other RNA
gaggaacagctggtggagagcggcgggggactcgtccaacccggcagatccctgcggctttcttgcaccgggagcggattccgctttggcgactacgccatgaactgggttagacaggctcctgggaagggactggaatgggtgacattcatctcctatgatggctctaataaacactacgccgacagcgtgaagggccggtttacggtctcccgcgataactctaaaaataccctccatctgcagatgaacagccttagaccggaggacacagcgctgtatttctgtgctcgggatctccgcgaatccgagtgcgaggaatgggagagctactattacgactttgggaagaaaggaccctgtgtgaagcctagaggcgttgtgggggtcctggatatttggggacagggcaccctggtgacagtttcttcc

SEQ ID NO: 40141 - RNA, 432 nt, synthetic construct
  misc_feature 1..432: note = derived and/or modified sequence opt5 from anti-HIV_cap256-119-038138_VR-Chain
  source 1..432: mol_type = other RNA
caggtgcaactggtcgagagcggcgggggagttgtgcagaccggcagatccctccggctgtcttgcacagggagccagttcacgtttggacgctacggcatgtattgggtgagacaggcccccgggaagggacttgaatgggtcgcttccatctcttacgacggccgggatttctatcacgcccgcagcgtgtggggcagatttaccatttcccgggacaactctaaaaatacactgcatctccaaatgaacagcctgcgccctgaggataccgcgctttacttctgtgctagagacctgcgggaatccgagtgcgaagagtgggagagctattactatgattttgggaagaaaggaccgtgtgttaagccccgcggcgtggtcggggtgctcgacatctggggacagggcacactggttaccgtgtcttcc

SEQ ID NO: 40142 - RNA, 432 nt, synthetic construct
  misc_feature 1..432: note = derived and/or modified sequence opt5 from anti-HIV_cap256-119-037868_VR-Chain
  source 1..432: mol_type = other RNA
caggtgcaactggtcgagagcggcgggggagttgtgcagcccggcagatccctccggctgtcttgcgccgctagccagttcaccttttccaagtacgggatgcactgggtgcgccaggcccctggaaaaggccttcaatgggtcgcggggatctcttatgacggaagcgataagtaccatgctcacttcgtgtggggcagattttccatttctcgggacaacagcaaaaatgccctgtatctccagatgaactccctgcgcacagaagatacggccctttacttctgtgttagagacctgcgggagagcgaatgcgaggaatggaagtctgattattacgactttggccgcaaagggccgtgtctcaagcccagaggagtggctggctccttcgatatctgggggcagggaaccgtcgtgacagttagctct

SEQ ID NO: 40143 - RNA, 432 nt, synthetic construct
  misc_feature 1..432: note = derived and/or modified sequence opt5 from anti-HIV_cap256-119-037102_VR-Chain
  source 1..432: mol_type = other RNA
caggtgaagctggtcgagagcggcgggggagttgtgcaacccggcaaatccctcagactgtcttgcaccgccagccagttcacattttccaacttcgggatgcactgggtgcggcaggctcctggaaagggccttgaatgggtcgcctctatcagctttgtggggattaaaaagcattacgcgaatttcgttcgcggaagatttacgatctcccgggaccagtctaaaaacaccctgtatctccaaatgaatagcgtgcgcgtcgaggatacagctagatactattgtgcccgggacatgcgcgaatacgagtgcgaactgtgggcctccgattattacgacttcggcaagccgcagccctgtgaggatcctagaggcgtggttgggacctttgacatgtggggacttggcacactggtgaccgtcagctct

SEQ ID NO: 40144 - RNA, 438 nt, synthetic construct
  misc_feature 1..438: note = derived and/or modified sequence opt5 from anti-HIV_cap256-119-036683_VR-Chain
  source 1..438: mol_type = other RNA
ggcgtgcagctggtcgagagcgggggagccgttgtgagacccggcgggtccctcaccctgtcttgcgctgccagccaattcatcctttcctcttacggaatgcactgggtgcggcaggcgcctggcaaggggctggaatgggtcgctagcatttccaatgacggaacgaaaaagtatcatgccgagtctgtgtgggatcgctttagcatctccaaagacaatagcaagaacacactcttcctgcagatgaactctcttagagttgaagataccgccctgtacttttgtgtgaaagaccagcgggaggatgaatgcgaggagtggtggtccgactattacgatttcggccgcgaactcccgtgtagaaagagccggggcctggggctggctggaatttttgacatgtggggccacgggacaatggtcaccgtgtcttcc

SEQ ID NO: 40145 - RNA, 432 nt, synthetic construct
  misc_feature 1..432: note = derived and/or modified sequence opt5 from anti-HIV_cap256-119-036495_VR-Chain
  source 1..432: mol_type = other RNA
caggtgcaactggtcgagagcggcgggggagttgtgcagcccggccggtccctccggctgtcttgcgccgctagcgggttctccttttctagctacggaatgcactgggtgcgccaggcccctggcaaggggcttgaatgggtcgcgtccatctctttcgtgggaattaaaacccattatgctaacagcgttagaggccggtttacaatctcccgcgaccagagcaagaatacgctgtacctccaaatgaactctgtgagaattgaggataccgcccggtatttctgtgcccgcgacatgagagaatacgagtgcgaactgtgggcttccgattattacgactttggcaaaccgcagccctgtgaggatcctagaggggtcgtgggaacattcgacatgtggggccttgggaccctggttacagtgagctct

SEQ ID NO: 40146 - RNA, 438 nt, synthetic construct
  misc_feature 1..438: note = derived and/or modified sequence opt5 from anti-HIV_cap256-119-035375_VR-Chain
  source 1..438: mol_type = other RNA
gaggtgcagctggtcgaaagcggcgggggactcgttcaacccggcagatccctgcggctttcttgcgccgctagcgggttcaccctggaggactacggaatgcactgggtgcgccaggcccctggcaaggggctcgaatgggtggcgtccatctctaatgatggaacgaaaaagtatcatgctgagagcgtctgggacagattttccatttctaaagataatagcaagaacacactgttccttcagatgaactccctgcgggtggaagacaccgccctctacttttgtgttaaagatcagcgcgaggacgagtgcgaagagtggtggagcgattattacgacttcggcagagaactgccgtgtcggaagtctcgcggcctggggctcgccggaatctttgatatgtggggccacgggacaatggtgaccgtctccagc

SEQ ID NO: 40147 - RNA, 438 nt, synthetic construct
  misc_feature 1..438: note = derived and/or modified sequence opt5 from anti-HIV_cap256-119-035165_VR-Chain
  source 1..438: mol_type = other RNA
caggtgcacctggtcgagagcggcgggggagttggccaacccgccagatccctccggctgtcttgcgctgccagcgggttcatcctttcctcttacggactgcattgggtgcgccaggcgcctggcaaggggctcgaatgggtggctctgattagctatgacggaaacaatgagtactatgccgaatccgtctggggcagatttaccatctctaaagataacagcaagaatacacttttcctgcagatgaactccctccgggtggaggacacggccctgtacttttgtgttaaagatcagcgcgaagacgagtgcgaggaatggtggagcgattattacgacttcggcagagagctgccgtgtcggaagtctcgcgggctcggactggctggcatttttgatatgtgggggcacggaaccatggtgacagtctccagc

SEQ ID NO: 40148 - RNA, 432 nt, synthetic construct
  misc_feature 1..432: note = derived and/or modified sequence opt5 from anti-HIV_cap256-119-035109_VR-Chain
  source 1..432: mol_type = other RNA
caggtgcaactggtcgagagcggcgggggagttgtgcagcccggcagatccctccggctgtcttgcgccaccgctgggttcacatttagctcctacgccatgcactgggtgcgccaggcgcctggaaagggccttgaatgggtcgcttctatcagctatgacgggtccgataaataccatgccgacctggtgtggggaagattcacgatttctcgggataacagcaagaataccctctatctgcagatgaactcccttcgcgccgaggacacagctctgtactattgtgttagagatgcccgggaaagcgagtgcgaactctgggagtctgactactataattttggccgcaaactgccgtgtgtgaagcccagaggcgtcgctgggaccctggatatctggggacaaggcacaatggtgaccgtttccagc

SEQ ID NO: 40149 - RNA, 339 nt, synthetic construct
  misc_feature 1..339: note = derived and/or modified sequence opt5 from anti-HIV_cap256-119-033789_VR-Chain
  source 1..339: mol_type = other RNA
caggtgtacctggtcgagagcggcgggggagttgtgcaacccggcagatccctccggctgtcttgcgccgctagccacttctccctttctagctatgggatgcattgggtgcgccaggcccctgacatctccaagaacaccctgtacctccaggtcaattctctgagaccggaagatacagcgatgtattactgtgctcgggaccagcgctattacgagtgcgaagagtgggccagcgattattacgactttggaaaagaacaaccctgtcttgatcctagaggcgtggttgggattttcgacatctggggacagggcacgatggtgaccgtctccagc

SEQ ID NO: 40150 - RNA, 432 nt, synthetic construct
  misc_feature 1..432: note = derived and/or modified sequence opt5 from anti-HIV_cap256-119-033641_VR-Chain
  source 1..432: mol_type = other RNA
caggtgcaactggtcgagagcggcgggggagttgtgcagaccggcagatccctccggctgtcttgcacagggagccagttcacgtttggacgctacggcatgtattgggtgagacaggcccccgggaagggacttgaatgggtcgctgccatctcctacgacggctctgataaatatcacaccaacagcgtgtggggccggttcacagtttcccgcgacaattctaagaacaccgtgtacctgcaaatgaatagcctcagagcggaggatacagctctgtatttttgtgtccgggaccgcagagaatccgagtgcgaactttgggagagcgattactatgacttcgggaaacggctgccttgtgtgaagccgcgcggagttgccggcgtgtttgatatttgggggcagggaaccatggtcacagtgtcttcc

SEQ ID NO: 40151 - RNA, 432 nt, synthetic construct
  misc_feature 1..432: note = derived and/or modified sequence opt5 from anti-HIV_cap256-119-032113_VR-Chain
  source 1..432: mol_type = other RNA
caggtgcaactggtcgagagcggcgggggagttgtgcagcccggccggcctctccggctgtcctgcgtggggtctggattcagctttatcacctccgccatgcactgggtccgccaggctccggacaagggccttgaatgggtggccattatctctgatgggggaaacaatagacattacgcggacagcgttaaaggccggttcacaatttcccgcgataactctaagaatacggtgtttctggaggtcaacaatctcagacccgaagacaccgctatgtattactgtgcccgggatcagcgctattacgagtgcgaagagtgggccagcgactattacgatttcggcagagagcaaccttgtcaggaccccagaggggtggttggagtgtttgatatgtggggccaggggacaatggtcaccgtgtccagc

SEQ ID NO: 40152 - RNA, 432 nt, synthetic construct
  misc_feature 1..432: note = derived and/or modified sequence opt5 from anti-HIV_cap256-119-031739_VR-Chain
  source 1..432: mol_type = other RNA
caggtgcaactggtcgagagcggcgggggagttgtgcagcccggcagatccctccggatctcttgcgccgctagccagttcacctttaaccgctacgggatgcactgggtgagacaggcccctggaaagggcctggaatgggtcgcgtccatttcttatgacgggagcgataaataccatgctggacttgtgtggggccggttcatcatttcccgcgacaattctaagaacacactgtatctccaaatgaatagcctgagagccgaggatacggccctttactattgtgttcgggacgaacgcgagtccgaatgcgagctgtgggagagcgattactatgactttggcaaaaagctcccgtgtgtgaaacccagaggggtcgctggaaccctggatatctggggccaggggacacgggtgaccgtttcttcc

SEQ ID NO: 40153 - RNA, 432 nt, synthetic construct
  misc_feature 1..432: note = derived and/or modified sequence opt5 from anti-HIV_cap256-119-030932_VR-Chain
  source 1..432: mol_type = other RNA
gaggtgcagctgctcgaaagcggcgggggagtcgttcaacccggcagatccctgcggctttcttgcgccgctagcgggttcgccttttcccactacggaatcttctgggtgcgccaggcgcctggcaaggggctggagtgggtgaccgtcatttctggagacggcagcacacagtggtatgctgattccgtgcagggcagatttacgatctctcgggacagctccaaaaacaccctctacctgcaaatggatgggcttcgcggagaagacacagccctgtattactgtgccaaggatctcagagagctggaatgcgaggagtgggctagcgactattacgatttcggccggccgcagccctgtctggaccctcgcggggtttctggaatttccaatgtgtggggccaggggaccatggtcacagtgagctct

SEQ ID NO: 40154 - RNA, 438 nt, synthetic construct
  misc_feature 1..438: note = derived and/or modified sequence opt5 from anti-HIV_cap256-119-030740_VR-Chain
  source 1..438: mol_type = other RNA
caggtgcaactggtcgagttcggcgggggagttgtgcagaccggcagaagcctccggctgtcctgcgccgcttctgggtttacattcagcgactacggaatgcactgggtgcgccaggcccccggcaaggggcttgaatgggtcgcgtccatctctaacgatggaagcaaaaagtatcatggcgactccgtgtgggctagatttattatctctcgggataatagcaaaaacacgctgttcctccagatgtccagcctgcgcgccgaggacaccgccctttacttttgtgttagagatcaccgggaagacgagtgcgaagagtggtggtctgattattacgacttcggccgcgagctgccttgtagaaagtttcgggggctcggactggctggcattttcgatatctgggggcatggaacaatggtgaccgtctccagc

SEQ ID NO: 40155 - RNA, 438 nt, synthetic construct
  misc_feature 1..438: note = derived and/or modified sequence opt5 from anti-HIV_cap256-119-030197_VR-Chain
  source 1..438: mol_type = other RNA
caggtgcacctggtcgagagcggcgggggagttgtgcaacccggcaagtccctcagactgtcttgcgccgctagccagttcaccttttgtcggtacgggatgcattgggtgcgccaggcccctggaaaaggccttgaatgggtcgcgtccatctctaacgacgggacagataagtatcacgctgacaatgtgtggggaagattcacgattagccgggataactccaaaaataccctgtacctcgagatgaactctctgcgcggcgaagacacagccctttattactgcgccaaggatatgagagaggacgaatgtgaggagtggtggagcgattattacgactttggcaaagaactgccgtgccggaagtggaagacccgcggggttgctggaatcctcgataattggggccaggggacaatggtgaccgtctccagc

SEQ ID NO: 40156 - RNA, 438 nt, synthetic construct
  misc_feature 1..438: note = derived and/or modified sequence opt5 from anti-HIV_cap256-119-027047_VR-Chain
  source 1..438: mol_type = other RNA
cagatgcaactggtggagagcggcgggggagtcgttcagcccggcagatccctcaccctgtcttgcgccgctagccagttcacatttcggaactacgggatgcactgggtgcgccaggcccctggaaagggccttgaatgggtggcgtccatctctaaagacgggacgaagaaatatcatggagatagcgtctggggcagattcattatctcccgggacaattctaagaacaccctgtttctccaaatgagctccctgcgcgctgaggatacagccctttacttctgtgtgagagaccagcgggaagccgagtgcgaagagtggtggagcgattattacgactttggccgcgagctgccgtgtagaaaattccgggggctcggactggctggcatttttgatatctgggggcacggaaccatggttacagtgtcttcc

SEQ ID NO: 40157 - RNA, 432 nt, synthetic construct
  misc_feature 1..432: note = derived and/or modified sequence opt5 from anti-HIV_cap256-119-026950_VR-Chain
  source 1..432: mol_type = other RNA
caggtgcaactggtcgagagcggcgggggagttgtgcagcccggcaagtccctcagaatctcttgcgccgctagccggttcacctttgggcgcttcggaatgcactgggtgagacaggcccctggcaaagggctggaatgggtcgcgtccatttcttacgacggaagcgataagtatcatgctggccttgtgtggggccggtttatcatttcccgcgacaactctaaaaatacactgtacctccagatgaacagcctgagagccgaggatacggccctttattactgtgttcgggacgaacgcgagtccgaatgcgagctgtgggagagcgattattacaatttcgggaagaactatccgtgtgtgaaacccagaggagtcgctggcaccctcgacatctgggggcaaggaacaaccgtgattgtttcttcc

SEQ ID NO: 40158 - RNA, 438 nt, synthetic construct
  misc_feature 1..438: note = derived and/or modified sequence opt5 from anti-HIV_cap256-119-026279_VR-Chain
  source 1..438: mol_type = other RNA
cagatgcaactggtggagagcggcgggggagtcgttcagcccggcacctccctcacactgtcttgcgccgctagccagttctcctttacgtcttacgggatgcactgggtgagacaggcccctggaaagggccttgaatgggtggcgagcatctccaacgacgggaccaaaaagtatcatgctgagtctgtctggggacggttcacaattagcaaagataattccaagaacaccctgtttctccaaatgaatagcctgcgcgtggaagacacagccctttacttctgtgttaaagatcagagagaggacgaatgcgaggagtggtggtctgattattacgactttggccgggaactgccgtgtcgcaagtccagaggcctcgggctggccggaatcttcgatatttggggccacgggaccgtggtcatcgtgagctct

SEQ ID NO: 40159 - RNA, 432 nt, synthetic construct
  misc_feature 1..432: note = derived and/or modified sequence opt5 from anti-HIV_cap256-119-025355_VR-Chain
  source 1..432: mol_type = other RNA
gaggtgcagctggtcgaaagcggcgggggactcgttcaacccggcagatccctgcggctttcttgcgccgctagcgggttctccttttctgactacgccatgcactgggtgcgccaggcgcctggacagggcctggagtgggtggctttcatcagctatgatgggaccaagaaataccattccgactctgtctggggaagactcacaattagccgggataactcccgcaatacgctgtttcttcagatgaacagcctgagaaccgaagacacagccctctatttctgtgtgcgggatcaacgcgaggacgattgcgaagagtggtggtctgactactatgattttggcaagaaactgccgtgtagaaagtcccggggcctggccgggatcttcgacatttggggacacggcaccatggttacagtgagctct

SEQ ID NO: 40160 - RNA, 432 nt, synthetic construct
  misc_feature 1..432: note = derived and/or modified sequence opt5 from anti-HIV_cap256-119-025301_VR-Chain
  source 1..432: mol_type = other RNA
caggtgcacctggtcgccagcggcgggggagttgtgccccctggcagatccctccggctgtcttgcgtggctagccaattcaccttttccgggttcggactttactgggtccgccaggccccgggcaaggggctggagtgggtggcggctatctcttttgccggaacgaaaaagcattatgccaacagcgttaaaggcagattcacaatttcccgggacaattctaagaacaccctctacctgcagatgaatagccttcgccccgatgacacagctctgtattactgtgccaaagatctcagagaatatgagtgcgaagagtggacctccgactactatgattttggccggcctcagccctgtatcgacagccgcggggtggtcggcattctggatatctggtctcaaggaacaatggtgaccgtttccagc

SEQ ID NO: 40161 - RNA, 438 nt, synthetic construct
  misc_feature 1..438: note = derived and/or modified sequence opt5 from anti-HIV_cap256-119-025010_VR-Chain
  source 1..438: mol_type = other RNA
caggtgcaactggtcgagagcggcgggggagttgtgcagcccggcagatccctccggctgtcttgccctgccagcgggttctccttttctacctacggaatgcactgggtgcgccaggctccgggcaaggggcttgaatgggtcgccagcatctccaacgacggaaataaaaagtatcatggcgagtctgtgtgggatagattcacaattagccgggacaactccaaaaatacgctgtttctccagatgaaccgcctgagagttgaagataccgcgctttacttctgtgtgaaggaccaacgggaggatgaatgcgaggagtggtggagcgactattacgattttggccgcgaactgccctgtagaaaattccgggggctcggactggctggcatctttgacgtctgggggcacggaacaatggtgaccgtttcttcc

SEQ ID NO: 40162 - RNA, 432 nt, synthetic construct
  misc_feature 1..432: note = derived and/or modified sequence opt5 from anti-HIV_cap256-119-024631_VR-Chain
  source 1..432: mol_type = other RNA
caggtgcaactgatggagagcggcgggggagtcgttcagcccggcgggtccctcagactgtcttgcgccgctagcggattcaccttttcctcttacggcatgcactgggtgcggcaggcccctgggaagggacttgaatgggtggcgggcatcagctatgacggctccgataaataccatgctcacttcgtctgggggcgctttattatctctagagacaacagcaagaatgccctgtatctccagatgaactccctgcggccggaggatacagccctttacttctgtgtgcgcgacctgagagaaagcgagtgcgaagagtggcaatcttattactatgattttggacggaaaggcccctgtctcaagcctcgcggggttgctggatccttcgacatttggggccaggggacggtggtcaccgtgagctct

SEQ ID NO: 40163 - RNA, 432 nt, synthetic construct
  misc_feature 1..432: note = derived and/or modified sequence opt5 from anti-HIV_cap256-119-024467_VR-Chain
  source 1..432: mol_type = other RNA
gaggtgcagctggtcgaaagcggcgggggactcgttcaacccggcgggtccctgaacgtgtcttgcgccgctagcggattcacctttagaacatacgccatgcactgggtgcggcaggcgcctggcaaggggcttgagtgggtcgctgccatctcctatgacggagataataaatactctgccgacagcgtgaagggccgcttcacgatttccagagatcagtctaaaaacaccctgtatctccagatgaatagcgttcgggtggaagacacagctcgctactattgtgccagagatatgcgggagtacgaatgcgagctgtgggcttccgactattacgattttggcaagccgcaaccctgtgaggaccctcgcggggtcgtgggaaccttcgatatgtggggccttgggacactggttaccgtgagctct

SEQ ID NO: 40164 - RNA, 432 nt, synthetic construct
  misc_feature 1..432: note = derived and/or modified sequence opt5 from anti-HIV_cap256-119-023805_VR-Chain
  source 1..432: mol_type = other RNA
caggtgcaactggtcgagagcggcgggggagttgtgcagcccggcaagtccctcagactgtcttgcgccgctagccagttcgggtttggatcctacggcatgcactgggtgcggcaggcccctgggaaaggacttgaatgggtcgcgaccatctctttcgacggcgctgataagtatcatgccgacgatgtgtggggccgctttagcatttccagagacaactctaaaaatacactgtacctccaaatgaacaatctgcggccggaggatacggccctttattactgtgctaaggacctgcgcgaagatgagtgcgaagagagatggagcgactattacgatttcgggaaacagctcccctgtcggaagtcccgcggagttgccggcgtgtttgacaactgggggcagggaaccatggtcacagtgagctct

SEQ ID NO: 40165 - RNA, 432 nt, synthetic construct
  misc_feature 1..432: note = derived and/or modified sequence opt5 from anti-HIV_cap256-119-021736_VR-Chain
  source 1..432: mol_type = other RNA
caggtgcaactggtcgagagcggcgggggagttgtgcagcccggcagatccgtgcggctctcttgcgtcgccagccagttctcctttgaccgctacgggatgcactgggtgagacaggctcctggaaagggcctggaatgggttgcctctatcagctatgatgggaccgacaaataccatgcggataaggtgtggggacggttcacaatttcccgcgacaactctaaaaagacgctttatctgcaaatgaatagcctcagaccggaggatgctgccctgtactattgtgccaaagaccttcgggaagatgagtgcgaagagtggtggtccgactactatgattttggcaagcagctgccctgtcgcaagagcagaggcgtcgctgggatcttcgactcttggggacagggcaccatggtgacagtttccagc

SEQ ID NO: 40166 - RNA, 438 nt, synthetic construct
  misc_feature 1..438: note = derived and/or modified sequence opt5 from anti-HIV_cap256-119-021203_VR-Chain
  source 1..438: mol_type = other RNA
cagatgcaactggtggagagcggcgggggagtcgttcagcccggcagatccctcaccctgtcttgcgccgctagccagttcacattttccaactacgggatgcactgggtgcggcaggcccctggaaagggccttgaatgggtggcgtctgtcagcaatgacgggacgaaaaagtatcatggagattccgtgtgggaccgcttcaccatctctagagataacagcaaaaatacactgtttctccaaatgtccagcctgcgggctgaggacaccgccgtttacttctgtgtgcgcgatgaaagagaggacgaatgcgaggagtggtggtctgattattacgactttggccgggaacttccgtgtcgcaagttcagaggcctggggctcgccggaatttttgatatctggggccacgggacactggtcaccgtgtccagc

SEQ ID NO: 40167 - RNA, 432 nt, synthetic construct
  misc_feature 1..432: note = derived and/or modified sequence opt5 from anti-HIV_cap256-119-020569_VR-Chain
  source 1..432: mol_type = other RNA
caggtgcaactggtcgagagcggcgggggagttgtgcagcccggcgaatccctcagaatctcttgcgccgctagccagttcaccttttcccggtacgggatgcactgggtgcgccaggcccctggaaagggcctggagtgggtcgcgtctattagcttcgacgggagagataaatatcattcctctcttgtgtggggacggctgacaatcagccgcgacaattccaagagcacgctctttctgcaaatgaactctcttagaccggaagataccgctctgtactattgtgcccgggacgttcgcgagtccgaatgcgaggagtggcagagcgattactatgccttctacagaaaactcccctgtgtgaagcctcggggcgtcgctggcacactggacatttgggggcagggaaccatggtgacagtttcttcc

SEQ ID NO: 40168 - RNA, 432 nt, synthetic construct
  misc_feature 1..432: note = derived and/or modified sequence opt5 from anti-HIV_cap256-119-019432_VR-Chain
  source 1..432: mol_type = other RNA
caggtgcaactggtccagagcggcgggggagttgtgcagcccggcagatccctccggatctcttgcgccgctccttacttcacctttgggcgctatggattccactgggtgagacaggccccgggcaaggggctggagtgggtcgcgagcatttcctttgacggacgggattactatcattctccccacgtgtggggccgccttacaatcagcagagacaactccaaaaatacgctgtacctccaaatgaactctctgcgggctgaagataccgccctttattactgtgcccgcgacctgagagagagcgaatgcgaggaatgggagtccgattattacgacttcggcaagaaagggccttgtgttaagccccggggagtggctggcagcctcgatatgtgggggcagggaacaatggtcaccgtgtcttcc

SEQ ID NO: 40169 - RNA, 432 nt, synthetic construct
  misc_feature 1..432: note = derived and/or modified sequence opt5 from anti-HIV_cap256-119-018827_VR-Chain
  source 1..432: mol_type = other RNA
caggcccaactggtggagagcggcgggggagtcgttcagcccggcagatccctccggctgtcttgcgctgccagccacttctcctttaatcgctacgggatgcattgggtgagacaggcgcctggaaagggccttgaatgggtggctgggatctcttatgacggacgggatttctaccacgccgacattgtctggggccgcctgaccatcagcagagataattccaaaaacacagtgtatctccagatgaactctctgcgggccgacgatacgggcctttactattgtgctcgcgacgttagagagagcgaatgcgaggaatgggagtcctactattacgattttgggcggaagggaccgtgtctgaaaccccgcggcgtggccgggaccttcgacatgtggggacaaggcacaattgtcagcgtgtctgct

SEQ ID NO: 40170 - RNA, 432 nt, synthetic construct
  misc_feature 1..432: note = derived and/or modified sequence opt5 from anti-HIV_cap256-119-018483_VR-Chain
  source 1..432: mol_type = other RNA
ctggtgcagctcgtcgagagcggcgggggagttgtgcaacccggcaagtccctgagactttcttgcgtggccagccagttcacctttaatcggtacgggatgcactgggtccgccaggctcctggaaaaggcctggaatgggtggccgggatctcctatgacggaagagataagtaccatgcgcacttcgtttggggccggattacaatctctcgcgacaatagcaaaaacacgctctatctgcagatgaactcccttagagctgaggataccgccctgtaccattgtgtgcgggacctccgcgaatctgagtgcgaactgtgggagagcgattattacgactttggcaagaaactgccgtgtgtcaagcccagaggggtggccggaattttcgatctctggggccaagggacaatggttaccgtgtccagc

SEQ ID NO: 40171 - RNA, 432 nt, synthetic construct
  misc_feature 1..432: note = derived and/or modified sequence opt5 from anti-HIV_cap256-119-018118_VR-Chain
  source 1..432: mol_type = other RNA
caggtgcacctggtcgccagcggcgggggagttgtgccccctggcagatccctcaccctgtcttgcgtggctagccaattcacattttccgggtgtggacttcattgggtccggcaggccccgggcaaggggctggagtgggtggcgtctatcagcttcgctggaacgaaaaagcactacggcaattccgttaaaggccgctttaccatttctagagacaatagcaagaacacactctatctgcagatgaactcccttcggcccgaagataccgccctgtactattgcgccaaagacctccgcgagtacgaatgtgaggaatggacaagcgattattacgacttcgggagagatcagccttgcatcgactctcggggagtggtcggcattctggatatctgggggcaaggaaccatggtgacagtttccagc

SEQ ID NO: 40172 - RNA, 432 nt, synthetic construct
  misc_feature 1..432: note = derived and/or modified sequence opt5 from anti-HIV_cap256-119-017782_VR-Chain
  source 1..432: mol_type = other RNA
caggtgcaactggtcgagagcggcgggggagttgtgcagcccggcaagtccctcagactgtcttgcgccgctagcgggttccctttttccaactacgccatgcactgggtgcggcagaccccgggacgcggccttgaatgggtcgcggggatctctttcgctgccacgaaaaagtattacagacccagcgtgcggggacgctttacagtttccaccgacatttctaaaaatacactgtatctcgagatgaacagcctgagacctgaagataccgccctttacttctgtgctcgggaccagcgctattacgagtgcgaagagtgggcctccgattattacgactttggcagagagcaaccctgtctggatcctcggggcgtggtcgggatcttcgacctctggggacagggcacaatggtgaccgttagctct

SEQ ID NO: 40173 - RNA, 432 nt, synthetic construct
  misc_feature 1..432: note = derived and/or modified sequence opt5 from anti-HIV_cap256-119-017669_VR-Chain
  source 1..432: mol_type = other RNA
caggtgcaactggtcgagagcggcgggggagttgtgcagcccggctcctctctccggctgagctgcgccgcttcccacttcgcctttaaccggtacgggatgcattgggtgcgccaggcgcctggaaagggccttgaatgggtcgctgggatctctttcgacggagccgataaatttcacgccgacaaggtgtggggcagattcaccattagccgggataattccaaaaacacactgtctctccagatgaatagcctgcgcccggaggacacggctctttattactgtgccaaggatctgagagaagacgagtgcgaagagtggtggtccgattattacgactttggccggcgcctcccctgtagaaaaagcagaggggtttctggaatcttcgataactggggccaagggaccatggtgacagtctccagc

SEQ ID NO: 40174 - RNA, 432 nt, synthetic construct
  misc_feature 1..432: note = derived and/or modified sequence opt5 from anti-HIV_cap256-119-016976_VR-Chain
  source 1..432: mol_type = other RNA
caggtgcaactggtcgagagcggcgggggagttgtgcagcccggcagatccctccggctgtcttgcgccgctagccagttctcctttggggacttcggaatgcactgggtgcgccaggcccctggcaaggggcttgaatgggtcgcggctatctcttttgccggaaccaaaaagaactacgccgatagcgtgagaggccggttcacaatttcccgcgactctagcaaaaatacgctgtatctccaaatgaactccctgagaccggaggataccgctctttactattgtgttaaggacatgcggggctacgaatgcgaggaatggacaagcgattattacgactttgggcgcccccagccttgtatcgattctagaggagtggtcggcaccttcgacgtgtgggggcagggaacaatggttaccgtgtccagc

SEQ ID NO: 40175 - RNA, 432 nt, synthetic construct
  misc_feature 1..432: note = derived and/or modified sequence opt5 from anti-HIV_cap256-119-015432_VR-Chain
  source 1..432: mol_type = other RNA
gaggtgcagctgctcgaaagcggcgggggactggtccaacccggcgggtcccttagactgtcttgcgccgctagcggattcaccttttccggctactctctcaactgggttcggcaggcccctgggaagggactggagtgggtggcgagcatctcctatgacggctctgataaataccacgctgaccgcgtgtggggcagattcacaattagccgggataattccaagaacacgctttatctgcagatgaatagcctccgcgccgaagacaccgccctgtactattgtgtcagagatgctcgggagtctgaatgcgagctgtgggagtccgactactataactttgggcgcaaactcccgtgtgtgaagcccagaggagttgccggcacactggatatctgggggcagggaaccatggtgacagtcagctct

SEQ ID NO: 40176 - RNA, 432 nt, synthetic construct
  misc_feature 1..432: note = derived and/or modified sequence opt5 from anti-HIV_cap256-119-015281_VR-Chain
  source 1..432: mol_type = other RNA
ctgggcagactcgtggccagcgggggaggcgtcgttccccctgggcggtccctgcgcctttcttgcgtggctagccagttcaccttttccggatgtggcctgcactgggtgagacaagccccggggaagggactcgagtgggtcgcgtctatcagcttcgctggcacgaaaaagcattacggcaattccgtgaaagggcggtttacaatttctcgcgacaatagcaagaacaccgtttatctggaaatgaactcccttagagccgaggatacagccctgtactattgcgctaaagacctccgggaatacgagtgtgaagagtggaccagcgattattacgacttcggacgcccccagccttgcatcgattctagaggcgtggtcgggattctggacatctggggacagggcacaatggtgaccgtttccagc

SEQ ID NO: 40177 - RNA, 432 nt, synthetic construct
  misc_feature 1..432: note = derived and/or modified sequence opt5 from anti-HIV_cap256-119-014957_VR-Chain
  source 1..432: mol_type = other RNA
caggtgcaagtcgttgagagcggcgggggagtggtgcagcccggcacctccctgagactctcttgcacagtcagcgggttctccttttctaactacgacctgcactgggtgcggcagacgcctgccaagggacttgaatgggttgctgtggtcagctatgatggctcccgcgagtactataccgactctgtgaaagggagattcatcattagccgggatcagtccaagaatacactgtacctccaaatgaacagcgttcgcctggaagacaccgccagatattactgtgcgcgggatatgcgcgagtatgaatgcgagctttgggcttctgactactacgattttggaaaaccgcagccctgtgaggaccctagaggcgtggtcggcacattcgatatgtgggggctgggaaccctcgtgacagtgtccagc

SEQ ID NO: 40178 - RNA, 432 nt, synthetic construct
  misc_feature 1..432: note = derived and/or modified sequence opt5 from anti-HIV_cap256-119-014777_VR-Chain
  source 1..432: mol_type = other RNA
caggtgcacctggtcgagagcggcgggggagttgtgcaacccggcagatccctccggctgtcttgcgccgctagccatttctccctttctagctacgggatgcactgggtgcgccaggcccctggaaagggcctggaatgggtcgcggggatctcctttgctgccaccaaaacatattacggaggctctgtgaagggcagattcacggttagccgggacatttccaaaaacaccctctatctgcagatgaatagccttcgcccggaggatacagccatgtactattgtgctagagaccagcggtactatgaatgcgaggaatgggcctctgattactacgactttgggcgcgagcaaccctgtcaggatcctagaggagtggtcggcgtgttcgacatgtgggggcagggaaccatggttacagtgtccagc

SEQ ID NO: 40179 - RNA, 432 nt, synthetic construct
  misc_feature 1..432: note = derived and/or modified sequence opt5 from anti-HIV_cap256-119-014313_VR-Chain
  source 1..432: mol_type = other RNA
caggtgcaactggtcgagagcggcgggggagttgtgcagcccggcagatccctccggatctcttgcgccgctagccagttcaccttttcccgctacgggatgcactgggtgagacaggcccctggaaagggcctggaatgggtcgcgtctattagctatgacgggcgggattaccatcacgctggagccgtgtggggccgcttcatcatttccagagacaactctaaaaatagccttcatctgcaaatgaactccctccggccggaggatacagccctgtatttttgtgctcgcgaccttagagaaagcgagtgcgaagagtgggagtctgattactataatttctggaagaaactgccctgtgttaagcctcggggcgtggtcgggatcctcgacatttggggacagggcacggtggttaccgtgtccagc

SEQ ID NO: 40180 - RNA, 438 nt, synthetic construct
  misc_feature 1..438: note = derived and/or modified sequence opt5 from anti-HIV_cap256-119-014219_VR-Chain
  source 1..438: mol_type = other RNA
cagatgcaactggtggagagcggcgggggagtcgttcagcccggctcctctctcaccctgagctgcgccgcttcccagttcacattttctaactacgggatgcactgggtgagacaggcccctggaaagggccttgaatgggtggcgagcatctccaatgacgggacgaaaaagtatcatggagattctgtctgggaccggttcaccattagccgcgataactccaaaaatacactgtttctccaaatgaacagcctgagagctgaggacaccgccctttacttctgtgtgaaggatcagcgggaagacgagtgcgaagagtggtggtctgattattacgactttggccgcgagctgccgtgtagaaaattccggggcctcgggctggccggaacatttgatatctggggccacgggaccatgctgattgtttccagc

SEQ ID NO: 40181 - RNA, 432 nt, synthetic construct
  misc_feature 1..432: note = derived and/or modified sequence opt5 from anti-HIV_cap256-119-013631_VR-Chain
  source 1..432: mol_type = other RNA
caggtgcaactggtcgagagcggcgggggagttgtgcagcccggcagatccctccggctgtcttgcgccgctagccagttcacctttgggtcctacggaatgcactgggtgcgccagatccctggcaaggggcttgaatgggtcgccacaatttcttatgacggaacgaaaaagtaccatgcggatagcgtgtgggacagattcatcatttcccgggataactctaaaaataccctgtttctccaaatgaacagcctgcgcccggaggacacagctctttatttctgtgttaaggatcagagacaggacgaatgcgaggaatggtggtccgattactatgactttggccggcgcctgccctgtagaaaaagccggggcctcgccgggatcttcgatgtgtggggacacggcaccatggtcacagtgtcttcc

SEQ ID NO: 40182 - RNA, 432 nt, synthetic construct
  misc_feature 1..432: note = derived and/or modified sequence opt5 from anti-HIV_cap256-119-012924_VR-Chain
  source 1..432: mol_type = other RNA
caggtgaccctggtcgagagcggcgggggattcgttcaacccggcgggtccctcagactgtcttgcgccacaagcggatttacgttctcctcttacgctatgcactgggtgcggcaggcccctggcaaggggcttgaatgggtggcggctatcagctttgacggagccgataaatatcatgccgacaacgtctggggccgcctgtccatttctagagataatagcaagtccaccctctacctgcagatgaacagccttcggccggaggacacagctgtgtatttctgtgccaaagatctgcgcgaagacgagtgcgaagagagatggtctgattactatgactttggcaagcagctcccctgtcggaaatcccgcggggttgctggaatcttcgataattggggccaagggaccatggtgacagtcagcgcc

SEQ ID NO: 40183 - RNA, 432 nt, synthetic construct
  misc_feature 1..432: note = derived and/or modified sequence opt5 from anti-HIV_cap256-119-011793_VR-Chain
  source 1..432: mol_type = other RNA
caggtgcaactggtcgagagcggcgggggagttgtgcagcccggcgggtccctccggctgtcttgcgtggccagccagttcaccttttcccggtacggaatgcactgggtccgccaggctcctggcaaggggcttgaatgggtggcctctatcagctatgacggaagagataaataccatgcggacttcgtttggggccggctgacaatttcccgcgatgactctaagaaaacgctctatctgcaaatggatagccttagagtggacgataccgctctgtactattgtgtccgggacatgcgcgagtccgaatgcgagctctgggaaagcgattactatgactttggcaagagactgccgtgtgtgaaacccagaggggttgccggaatcttcgatatttggggccaggggacaatggtgaccgtctcttcc

SEQ ID NO: 40184 - RNA, 432 nt, synthetic construct
  misc_feature 1..432: note = derived and/or modified sequence opt5 from anti-HIV_cap256-119-011413_VR-Chain
  source 1..432: mol_type = other RNA
caggtgcaactggtcgagagcggcggggacgttgtgcagcccggaagatccctccggctgtcttgcgccgctagcggcttcaccttttccacatacgggatgcactgggtgcgccaggcccctggaaagggccttgaatgggtcgcggctatctctttcgccgggacgaaaaagaactatgccgatagcgtgagaggacggtttaccatttcccgcgactctagcaaaaatacactgtacctcgagatgaactccctgagaccggaagataccgctctttattactgtgccaaggacatgcggggctatgagtgcgaagagtggacaagcgattactatgacttcggccgcccccagccttgtatcgattctagaggggttgtgggaacctttgacgtctggggccaagggacaatggtgaccgtttccagc

SEQ ID NO: 40185 - RNA, 432 nt, synthetic construct
  misc_feature 1..432: note = derived and/or modified sequence opt5 from anti-HIV_cap256-119-011323_VR-Chain
  source 1..432: mol_type = other RNA
caggtgaagctggtcgagagcggcgggggagttgtgccccctggcaaatccctcagactgtcttgcaccgccagccaattcacattttccaatttcgggatgcactgggtgcggcaggctccgggaaagggccttgaatgggtcgcctctatcagctttgtggggattaaaacgcattacgctaattccgttcgcggaagattcaccatctctcgggaccagagcaagaacacactgtatctccagatgaactccgtgcgcgtcgaggataccggcagatactattgtgcgcgggacatgcgcgaatacgagtgcgaactgtgggccagcgattattacgactttggcaaaccccaaccttgtgaggatcccagaggggtggttggaacattcgacatgtggggccttgggaccctggtgacagtctcttcc

SEQ ID NO: 40186 - RNA, 432 nt, synthetic construct
  misc_feature 1..432: note = derived and/or modified sequence opt5 from anti-HIV_cap256-119-011233_VR-Chain
  source 1..432: mol_type = other RNA
caggtgcacctggtcgagagcggcgggggagttgtgcaacccggcagatccgtgcggctctcttgcgccgctagccatttctccctgtctagctacgggatgcactgggtccgccaggcccctggaaagggccttgaatgggtgaccgggatctcctttgcgggaacaaaaacgtattacggcgactctgttagaggccggttcaccgtgagccgcgatatttccaagaacacactgtttctccagatgaatagcctgagaccggacgataccgctatgtattactgtgcccgggaccagcgctattacgagtgcgaagagtgggcctctgattattacgacttcgggagagaacaaccctgtcttgatcctcggggagtcgtgggcatctttgacctgtgggggcagggaacaatggttaccgtgtccagc

SEQ ID NO: 40187 - RNA, 432 nt, synthetic construct
  misc_feature 1..432: note = derived and/or modified sequence opt5 from anti-HIV_cap256-119-009038_VR-Chain
  source 1..432: mol_type = other RNA
caggagcaactggtggaaagcggcgggggagtcgttcagcccggcagatccctccggctgtcttgcgtggccagccgcttcaccttttccgctttcgggatgcactgggtgagacaggcccctggaaagggccttgagtgggtcgcgtctatcagctttgctgggattaaaaagtactatggagactccgtgaaaggccggttcacaatctctcgcgataacagcaagaatacgctgtacctccagatggacggcctgagaggggaagataccgccctttattactgtgccaaagacctgcgggagctcgaatgcgaggagtgggcttccgattattacgactttggacgcccgcaaccctgtctggatcctagaggcgttagcgggatttctaacgtgtggggacagggcacaatggtcaccgtgtccagc

SEQ ID NO: 40188 - RNA, 432 nt, synthetic construct
  misc_feature 1..432: note = derived and/or modified sequence opt5 from anti-HIV_cap256-119-008756_VR-Chain
  source 1..432: mol_type = other RNA
caggtgcaactggtcgagagcggcgggggagttgtgcagcccggcaagtccctccggctgtcttgcgtggtcagccagttcacctttgggcggtacggaatgcactgggtgcgccaggcccctggcaaagggcttgaatgggttgcttccatctcttatgacggaagcgataagtaccatacatcctctctgtggggcagattcattgtgagccgggacaactccaaaaatacgctctatctgcaaatgaacagccttcgcccggaggataccgccctgtactattgtgtcagagaccggcgcgaatctgagtgcgaagagagatggtccgattactatgactttggcaagcagctcccctgtgtgaaacctagaggggttgcgggaatcttcgatatttggggccaggggacaatggtgaccgtcagctct

SEQ ID NO: 40189 - RNA, 438 nt, synthetic construct
  misc_feature 1..438: note = derived and/or modified sequence opt5 from anti-HIV_cap256-119-008055_VR-Chain
  source 1..438: mol_type = other RNA
cagatgcaactggtggagagcggcgggggagtcgttcagcccggcagatccctcaccctgtcttgcgccgctagccagttctcctttgccaactacgggatgcactgggtgcggcaggcgcctggaaagggccttgaatgggtggcttctatcagcaatgacgggacgaaaaagtatcatgaggaatccgtctggggacgcttcacaatttctaaagataacagcaagaataccctgtttctccaaatgaactccctgagaatcgaggacacagccctttacttctgtgtgaaagatcagcgggaagacgagtgcgaggaatggtggagcgattattacgactttggccgcgagctgccgtgtagaaagtctcggggcctcgggctggccggaattttcgatatgtggggccacgggaccatggttacagtgtccagc

SEQ ID NO: 40190 - RNA, 435 nt, synthetic construct
  misc_feature 1..435: note = derived and/or modified sequence opt5 from anti-HIV_cap256-119-006949_VR-Chain
  source 1..435: mol_type = other RNA
caggtgcacctggtcgagagcggcgggggagttgtgcaacccggccggtccctccggctgtcttgcgccgctagcgggttctccgtgtctaacaattacatgaactgggtccgccaggcccctggagaaggccttgagtgggtggcgctgatcagctttgacgggagacagaaggatctcgctgactccgttaaaggacggttcgccatttctcgcgataatagcaagaacaccctgtatcttcagatgaactccctgagactcgaagacacagccctgtactattgtgctcgggatctgcgcgagctcgactgcgaagagtggacgctgtacaattattacgattttggcagcagaggcccgtgtgtggaccccagaggggtcggaggctctttcgatgtgtgggggcaaggaaccatggttacagtgtccagc

SEQ ID NO: 40191 - RNA, 432 nt, synthetic construct
  misc_feature 1..432: note = derived and/or modified sequence opt5 from anti-HIV_cap256-119-006685_VR-Chain
  source 1..432: mol_type = other RNA
caggtgcaactggtcgagagcggcgggggagttgtgcagcccggcagatccctccgggtgtcttgcgccgctagccacttcaccttttcccgctacgggatgcattgggtcagacaggcccctggaaagggcctggaatgggtggcgtctatcagctatgacgggcgggatttctaccacgctcgctccgtttggggaagatttacaatttctcgggacaacagcaaaaatacgcttcatctgcagatgaactccctccgcccggaggataccgccctgtatttctgtgccagagaccttcgggaaagcgagtgcgaagagtgggagtcttactattacgattttggcaagaaaggcccctgtgtgaagcctcgcggggtcgtgggagttctggacatctggggccaagggacactcgtgaccgtctccagc

SEQ ID NO: 40192 - RNA, 432 nt, synthetic construct
  misc_feature 1..432: note = derived and/or modified sequence opt5 from anti-HIV_cap256-119-006015_VR-Chain
  source 1..432: mol_type = other RNA
caggtgcaactggtcgagagcggcgggggagttgtgcagcccggcaagtccctcagactgtcttgcgccgctagccggttcacctttaatcgctacgggatgcactgggtgagacaggcccctggaaaaggccttgaatgggtcgcggctatctccttcgacgggacagataagtatcattctgacgatgtgtggggacggtttacgattagccgcgacaattccaaaaacaccctgtacctccagatgaactctctgagaccggaggatacagccctttattactgtgccaaggacctgcaagaagatgagtgcgaagagtggtggagcgactattacgatttcggcaaacagctcccctgtcggaagtcccgcggcgttgctgggatctttgacgattggggacagggcaccatggtgacagtcagctct

SEQ ID NO: 40193 - RNA, 432 nt, synthetic construct
  misc_feature 1..432: note = derived and/or modified sequence opt5 from anti-HIV_cap256-119-005841_VR-Chain
  source 1..432: mol_type = other RNA
caggtgcaactggtcgagagcggcgggggagttgtgcagcccggcagatccctccggctgtcttgcgccgctagccagttctcctttgggaacttcggaatgcactgggtgcgccaggcccctggcaaggggcttgaatgggtcgcggctatctcttttgccggaaccaaagagaattacgccaacagcgtgagaggccggttcacaatttcccgcgacaattctaagaacacgctgtatctccaaatgaatagcctgagagctgaagataccgccctttactattgtacaaaagacatgcgggagtacgaatgcgaggagtggacctccgattattacgactttggccgcccgcagccctgtatcgatagcagaggggttgtgggaacattcgacgtctggggccaggggaccatggtgacagtttcttcc

SEQ ID NO: 40194 - RNA, 432 nt, synthetic construct
  misc_feature 1..432: note = derived and/or modified sequence opt5 from anti-HIV_cap256-119-005824_VR-Chain
  source 1..432: mol_type = other RNA
caggtgcaactggtcgagagcggcgggggagttgtgcagcccggcgggtccctcagactgtcttgcgccgctagcggattcacctttcggcgctacgccatgcactgggtgagacaggcgcctggcaaggggcttgaatgggtcgcttccatctcttatgacggaagcgataaataccatacatcctctctgtggggccggttcattgtgagccgcgacaactccaagaatacgctctatctgcagatgaacagccttagaccggaggataccgccctgtactattgtgttcgggaccgcagagaatctgagtgcgaggaacggtggtccgattactatgactttggcaaacaactcccctgtgtgaagcctcgcggggtcgccggaatcttcgatatttggggccaggggacaatggtgaccgttagctct

SEQ ID NO: 40195 - RNA, 432 nt, synthetic construct
  misc_feature 1..432: note = derived and/or modified sequence opt5 from anti-HIV_cap256-119-005494_VR-Chain
  source 1..432: mol_type = other RNA
caggtgagactggtcgagagcggcgggggagttgtgcaacccggccggtccctccgcatctcttgcgccgctagccagttcatgtttaacaagtacgggatgcactgggtgagacaggcccctggaaaaggcctggaatgggtcgcgtccatttcttatgacgggagcgataagtaccatgctgaccttgtgtggggacggttcaccatctcccgcgataattctaaaaacacactgtatctccagatgaatagcctgagagccgaggacacggccctttactattgtgttcgggatgctcgcgaatccgagtgcgaactgtgggagagcgactactataactttggcagaaagctcccgtgtgtgaaaccccggggcgtcgccgggaccctggatatttggggacaaggcacaatggtgaccgtttcttcc

SEQ ID NO: 40196 - RNA, 432 nt, synthetic construct
  misc_feature 1..432: note = derived and/or modified sequence opt5 from anti-HIV_cap256-119-004949_VR-Chain
  source 1..432: mol_type = other RNA
caggtgcaactggtcgagagcggcgggggagttgtgcagcccggcagatccctccggctgtcttgcgccgctagcaagttctccctttctagctacgggatgcactgggtgcgccaggcccctggaagaggcctggaatgggtcgcggggatctcctttgctgccaccaaaaagtattaccggccgtctgtgcgcggaagattcacagttagcacggacatttccaaaaacaccctctatctggagatgaatagccttcggcccgaagatacagccctgtacttttgtgctcgcgaccagagatattacgagtgcgaagagtgggcctctgattattacgacttcggccgggagcaaccttgtctcgatccccgcggcgtggtcgggatctttgacctgtggggacagggcaccatggtgacagtttccagc

SEQ ID NO: 40197 - RNA, 432 nt, synthetic construct
  misc_feature 1..432: note = derived and/or modified sequence opt5 from anti-HIV_cap256-119-004422_VR-Chain
  source 1..432: mol_type = other RNA
cacgtgcagctggtcgagagcggcgggggagttgtgcaacccggcagatccctccggctgtcttgcgccgctagcgggctttccttctctagctacgccatgcattgggtgcgccaggcgcctggaaagggcctggaatgggtcgctgtggtttcctatgacgggaccacaaaattttacgccgattctgtgaagggaagattcacgatcagccgggacaactccaaaaataccctctatctgcagatgaacagccttcgcggcgaggatacagccctgtactattgtgctaaggacctcagagaatacgagtgcgaagagtggacctctgattattacgactttggccggccgcagccctgtattgattcccgcggggtcgtgggaatcctggacatttggagccaaggcacaatggttaccgtgtcttcc

SEQ ID NO: 40198 - RNA, 432 nt, synthetic construct
  misc_feature 1..432: note = derived and/or modified sequence opt5 from anti-HIV_cap256-119-003932_VR-Chain
  source 1..432: mol_type = other RNA
caggtgcaactgctcgagagcggcgggggagtcgttcagcccggcgggtccctgagactttcttgcaaggccagccacttctcctttgaccggtacggaatgcattgggtgcgccaggctcctggcaaagggctggaatgggtggccgcgatctctttcgatggagctgacaagtatcacgccgataacgtctggggcagactcagcatttcccgggacaattctaaaagcaccctgtaccttcagatgaactccctgcgcccggaggatacagccgtgtatttttgtgctaaggacctcagagaagatgagtgcgaggaacggtggagcgactactatgatttcggcaaacaactgccctgtcgcaagtctagaggggttgccggaatctttgacaattggggccaggggacgatggtgaccgtctccgct

SEQ ID NO: 40199 - RNA, 438 nt, synthetic construct
  misc_feature 1..438: note = derived and/or modified sequence opt5 from anti-HIV_cap256-119-003577_VR-Chain
  source 1..438: mol_type = other RNA
caggtgcaactggtcgagagcggcgggggaggcgttcagcccgggagatccctccggctgtcttgcgccgctagcggattcacctttcgctcctacgccatgcactgggtgagacaggcgcctggcaaggggcttgaatgggtggctgtcatctctaatgacggaacgaaaaagtatcatgccgagagcgtgtgggatcggttctccatttctaaagacaatagcaagaacacactgtttctccagatgaactccctgcgcgttgaagataccgccctttacttctgtgtgaaagaccaaagagaggatgaatgcgaggagtggtggagcgactattacgattttggccgggaactgccgtgtcgcaagtctagaggcctcgggctggctggaatcttcgacatgtggggccacgggacaatggtcaccgtgtccagc

SEQ ID NO: 40200 - RNA, 432 nt, synthetic construct
  misc_feature 1..432: note = derived and/or modified sequence opt5 from anti-HIV_cap256-119-002155_VR-Chain
  source 1..432: mol_type = other RNA
ctgggcagactcgtggccagcgggggaggcgtcgttccccctgggcggtccctgcgcctttcttgcgtggctagccagttcaccttttccggatgtggcctgcactgggtgagacaagtcccggggaagggactcgagtgggtggcctctatcagcttcgcgggcacaaaaacgcattacggcaactccgttaaggggcggttttctattagccgcgacaattccatcaacaccgtgtatctgcagatgaatagccttagagctgaagatacagccctgtactattgcgccaaagacctccgggagtacgaatgtgaggaatggacctctgattattacgacttcggacgcccccagccttgcattgattccagaggcgtcgtggggatcctggacatttggagccagggaacaatggttaccgtgtcttcc

SEQ ID NO: 40201 - RNA, 432 nt, synthetic construct
  misc_feature 1..432: note = derived and/or modified sequence opt5 from anti-HIV_cap256-119-002017_VR-Chain
  source 1..432: mol_type = other RNA
caggtgcaactggtcgagagcggcgggggagttgtgcagcccggccggtccctccggctgtcttgcgccgctagcgggttcaccttttcctactatggaatccactgggtgcgccaggcccctggcaaggggcttgaatgggtcgcgtctattagctacgacgagagagatttctatcatgctcggtccgtgtggggacgctttgccatctctagagacaacagcaaaaatacactgcacctccagatgaactccctgcggccggaagatacggccctttacttctgtgctcgcgacctgagagagagcgaatgcgaggagtgggaatcttattactatgattttggcaagaaaggcccctgtgttaagcctagaggggtggtcggagtgctcgacatttggggccaagggaccctggttacagtgtccagc

SEQ ID NO: 40202 - RNA, 432 nt, synthetic construct
  misc_feature 1..432: note = derived and/or modified sequence opt5 from anti-HIV_cap256-119-001312_VR-Chain
  source 1..432: mol_type = other RNA
caggtgcaactgatggagagcggcgggggagtcgttcagcccggcagatccctccggctggcctgcgctgcctctgggttcacctttagctcctacgcgatccactgggtgcgccaggctcctggaaagggccttgaatgggtggccgccatttctttcgctgggacgaaaaagaactatgccgacagcgtcagaggacggtttacaatctcccgcgattctagcaaaaataccctgtacctcgagatgaactccctgagaccggaagacacagctctttattactgtgccaaggatatgcggggctatgagtgcgaagagtggaccagcgactactatgatttcggccgcccccagccttgtattgactctagaggggtggttggaacatttgatgtgtggggccaagggaccatggtcacagtgtccagc

SEQ ID NO: 40203 - RNA, 438 nt, synthetic construct
  misc_feature 1..438: note = derived and/or modified sequence opt5 from anti-HIV_cap256-119-001017_VR-Chain
  source 1..438: mol_type = other RNA
cagatgcaactggtggagagcggcgggggagtcgttcagcccggcagatccctcaccctgtcttgcgccgctagccagttctcctttacaaactacgggatgcactgggtgcggcaggcccctggaaagggccttgaatgggtggcgtctatcagcaatgacgggaacaaaaagtatcatggagagtccgtctgggatcgcttcacgatttctagagacaatagcaaaaacaccctgtttctccaaatgaatcggctgcgcgtggaagatacagctctttacttctgtgttaaggaccagagagaggatgaatgcgaggagtggtggtccgactattacgattttggccgggaactgccgtgtcgcaaattcagaggcctcgggctggccggaatctttgacgtgtggggccacgggaccatggtcacagtgagctct

SEQ ID NO: 40204 - RNA, 432 nt, synthetic construct
  misc_feature 1..432: note = derived and/or modified sequence opt5 from anti-HIV_cap256-119-000594_VR-Chain
  source 1..432: mol_type = other RNA
caggtgcaactggtcgagagcggcgggggactcgttcagcccggcacctccctgagactttcttgcgccgctagcgccttcacatttaagaactacgggatgcactgggtgcggcaggcgcctggaaaaggcctggactgggtggcttccatctcttatgatgggcgcgacaagtaccatagctccctcgtctggggaagactgacgatttctcgggataatagcaaatccacccttttcctgcagatgaacagcctccgcgccgaagacacagccctgtattactgtgctagagatctgcgggagtctgaatgcgaggaatggcaatccgactattacgccttttataagaaactcccgtgtgtgaagccccgcggcgttgctggcaccctggatatctgggggcagggaacaatggtgaccgtcagctct

SEQ ID NO: 40205 - RNA, 432 nt, synthetic construct
  misc_feature 1..432: note = derived and/or modified sequence opt5 from anti-HIV_cap256-059-241099_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatgttgattctgtgcagggcagattcacaattagccgggacaattccaagaacacgatgtttctgcaaatgaatagcctccgcaccgaggatacagctgtctactattgtgccagagacctgggcgaatctgaggtggaagagtgggccaccgattactatgacttctccatcgcttacccggttgaggggccccggggagtggtcggcatttttgatatctgggggcagggaacaatggtgaccgtgagctct

SEQ ID NO: 40206 - RNA, 432 nt, synthetic construct
  misc_feature 1..432: note = derived and/or modified sequence opt5 from anti-HIV_cap256-059-207529_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcgggaatcagcttcgctggcattaacaaatattacggcaattccgtgaaggggagatttacaatctctcgggacaacagccgcaatacgctgtatctccagatgaactccctgagagccgaggataccgccctttactattgtgctcgggacctgcgcgaaatggagtgcgaagagtgggccagcgattactatgacttcggaagaggcgggccgtgtcaagatccccggggagttgtgggcacatttgacatttgggggcagggaaccatggtcacagtgtcttcc

SEQ ID NO: 40207 - RNA, 435 nt, synthetic construct
  misc_feature 1..435: note = derived and/or modified sequence opt5 from anti-HIV_cap256-059-205541_VR-Chain
  source 1..435: mol_type = other RNA
cagatgcaactggtggagagcggcgggggagtcgttcagcccggcgggtccctcagactgtcttgcgccgctagcggattctccttttcttactatgccatggactgggtgcggcaggcgcctggcaaggggcttgaatgggtggctttcatcagctccgatggatctgacaaaaactacgccgatagcgtcaagggccgctttaccatttccagagacaatagcaaaaacacactgtatctccagatgaactctctgcgggccgaggatacggctgtgtactattgtgccaaggacgttggcgggcacaaaaatgatgaatgggctaccaattactattacgacatctccattgcctacccgatccaagatccccgcgcggtggccggagctttcgacgtctggggccaggggacaatggtgaccgttagctct

SEQ ID NO: 40208 - RNA, 432 nt, synthetic construct
  misc_feature 1..432: note = derived and/or modified sequence opt5 from anti-HIV_cap256-059-188439_VR-Chain
  source 1..432: mol_type = other RNA
caggtgcaactggtcgagagcggcgggggagttgtgcagcccggcagatccctccggctgtcttgcgccgctagccagttcaccttttccaactacgggatgcactgggtgcgccaggcccctggaaagggccttgaatgggtcgcggctatctctttcgccgggattaataaatattacacagacagcgtgaagggaagatttacgatctcccgggataactctaaaaataccctgtatctccaaatgaacagcctgcgcgccgaggacacagctctttactattgtgccaaggatctgagaggcttcgaatgcgaggaatgggcttccgactactatgattttggccgggacctcccgtgtcaggatccccgcggggttgtgggaaccttcgacgtctggggccaggggacaaaagtgaccgttagctct

SEQ ID NO: 40209 - RNA, 432 nt, synthetic construct
  misc_feature 1..432: note = derived and/or modified sequence opt5 from anti-HIV_cap256-059-187234_VR-Chain
  source 1..432: mol_type = other RNA
caggtgcaactggtcgagagcggcgggggagttgtgcaggccggcagatccctccggctgtcttgcgctgccagccagttcacctttgggtcctacggaatgcactgggtgcgccaggcgcccggcaaggggcttgaatgggtcgctgccatctctttcgccggaacaaaaattcattatgctgacagcgtgaagggcagatttacgatctcccgggataactctaaaaatgccctgtacctccaaatgcacagcctgcgcgctgaggacaccgccctttattactgtgcgaaggatctgagagaatatgagtgcgaagagtgggcctccgactactatgatttcggccgggaccagccttgtcaggatccgcgcggggttgtgggaatttttgacatctggggccaggggacaatggtcaccgtgagctct

SEQ ID NO: 40210 - RNA, 432 nt, synthetic construct
  misc_feature 1..432: note = derived and/or modified sequence opt5 from anti-HIV_cap256-059-187047_VR-Chain
  source 1..432: mol_type = other RNA
caggtgcaactggtcgagagcggcgggggagttgtgcagcccggcagatccctccggctgtcttgcgccgtgagccagcttaccttctcctcttacgggatgcactgggtccgccaggctcctggaaagggcctggaatgggtggccgcgatcagctttgttgggattaaaaagtattacgctgactccgtgaaaggaagattcacaatctctcgggataacagcaagaatacgctctatctgcaaatgaactcccttcgcgtcgaggacaccgccctgtactattgtgccaaagatctcagagaatacgagtgcgaagagtgggctagcgactattacgattttggccgggaccagccgtgtcaggatgcccgcggcgtggttgggacatctgacatttggggacagggcaccatggtgacagtctccagc

SEQ ID NO: 40211 - RNA, 432 nt, synthetic construct
  misc_feature 1..432: note = derived and/or modified sequence opt5 from anti-HIV_cap256-059-186068_VR-Chain
  source 1..432: mol_type = other RNA
caggtgcaactggtcgagagcggcgggggagttgtgcagcccggcagatccctccggctgtcttgcgccgctagccagttctccttttctaactacgggatgcactgggtgcgccaggcccctggaaagggccttgaatgggtcgcggggatcagcttcgctgccaccaaaaagtattacgccgactccgtgaaaggaagattttctgttagccgggataattccaagaacgctctgtatctccaaatgaatagcctgcgcgccgaggacacagctctttactattgtgccagagatctgcgggactacgaatgcgaggaatgggcgtctgattattacgacttcggccgcgagtacccgtgtcaggatcccagaggcgtggtcgggacgtttgacatttggggacagggcaccatggtgacagtttccacc

SEQ ID NO: 40212 - RNA, 435 nt, synthetic construct
  misc_feature 1..435: note = derived and/or modified sequence opt5 from anti-HIV_cap256-059-182835_VR-Chain
  source 1..435: mol_type = other RNA
caggtgcaactggtcgagagcggcgggggactcgttcagcccggcagatccctgcggctttcttgcgccgctagcgggttctcctttaacaatttcgccatggactgggtgcgccaggcgcctggaaagggcctggaatgggtggcttttgtctctagcgatgggtccaacaaaaattacgccgactctgtgaagggaagattcatcattagccgggataactccaaaaataccgtttatctccagatgaacagcctgcgcgtggaggacacagccgtctactattgtgctaaggatcttggcgccaataaagacgatgaatgggctacggactactattacgatctgtctgtggccagaccggttcccgaccctcgggcggtggtcggcgcctttgatgtgtgggggcaaggaaccatggtgacagtctccagc

SEQ ID NO: 40213 - RNA, 432 nt, synthetic construct
  misc_feature 1..432: note = derived and/or modified sequence opt5 from anti-HIV_cap256-059-176659_VR-Chain
  source 1..432: mol_type = other RNA
agagtgcagctggtcgagagcggcgggggagttgtgcaacccggccggtccctccgcctgtcttgcgccgctagccagttctccttttctaattacgggatgcactgggtgagacaggcccctggaaagggccttgaatgggtcgcggggatcagcttcgctgccattaaaaagtattacgccgactccgtgaaaggacggtttaccatctctcgcgataatagcaagaacgctctgtatctccagatgaactccctgagagccgaggacacagctctttactattgtgcccgggatctgcgcgaatacgagtgcgaagagtgggcgagcgactattacgatttcggcagagagctcccgtgtcaagacccccggggcgttgtggggacgtttgatacctggggacagggcacaatggtcaccgtgtctaca

SEQ ID NO: 40214 - RNA, 432 nt, synthetic construct
  misc_feature 1..432: note = derived and/or modified sequence opt5 from anti-HIV_cap256-059-172956_VR-Chain
  source 1..432: mol_type = other RNA
caggtgcaactggtcgagagcggcgggggagttgtgcagcccggcagatccctccggctgtcttgcgccgctagccagttctccttttctagctacgggatgcactgggtgcgccaggcccctggaaagggccttgaatgggtcgcggctatgtccttcgccgggaccaaccaatattacgccgcttctgtgaaaggaagatttacaatcagccgggacaattccaagaacacgctgtatctccatatgaatagcctgcgcccggaggataccgccctttactattgtgctagagacctgcgggaatacgagtgcgaagagtgggccgcggattattacgacttcggccgcgagtacccctgtcaggatcctagaggcgttgtggggatttttgacgtctggggacagggcacactcgtgaccgtttcttcc

SEQ ID NO: 40215 - RNA, 432 nt, synthetic construct
  misc_feature 1..432: note = derived and/or modified sequence opt5 from anti-HIV_cap256-059-171272_VR-Chain
  source 1..432: mol_type = other RNA
caggtgctgctcgtcgagagcggcgggggagttgtgcaacccggcagatccctgcggctttcttgcgccgctagccagttcaccttttccaactacgggatgcactgggtgcgccaggcccctggaaagggcctggaatgggtcgcggctatctctttcgccgggatgaaaaagtattacgccgacagcgtgaaaggaagatttacaatttcccgggataattctaagaacacgctctatctgcagatgaatagccttcgcgctgaggacaccgccctgtactattgtgctaaagatctcagagagttcgaatgcgaagagtgggcctccgactactatgattttggccgggcgcaaccgtgtcaggacccccgcggcgttgtggggacattcgatctgtggggacagggcaccatggtcacagtgagctct

SEQ ID NO: 40216 - RNA, 432 nt, synthetic construct
  misc_feature 1..432: note = derived and/or modified sequence opt5 from anti-HIV_cap256-059-168734_VR-Chain
  source 1..432: mol_type = other RNA
caggtgcaactggtcgagagcggcgggggagttgtgcagcccggcagatccctccggctgtcttgcaccgccagccagttctccttttctagctacgggatgcactgggtgcgccaggctcctggaaagggccttgaatgggtcgccgcgatctccttcgctgggacgaaaaagtattacgtgggaacagttaaaggcagatttaccatttctcgggacaacagcaagaatacactgtatctccaaatgaactccctgcgcgccgaggataccgccctttactattgtgctaaagacatgagagaatacgagtgcgaagagtgggccagcgattattacgacttcggccgggagtacccgtgtcaggatccccgcggggtggtcggaacatttgacatctggggccaggggaccatggtgacagtttcttcc

SEQ ID NO: 40217 - RNA, 432 nt, synthetic construct
  misc_feature 1..432: note = derived and/or modified sequence opt5 from anti-HIV_cap256-059-155838_VR-Chain
  source 1..432: mol_type = other RNA
caggtgcaactggtcgagagcggcgggggagttgtgcagcccggcagatccctccggctgtcttgcgccgtgagccagttcaccttttccaattacgggatgcactgggtccgccaggctcctggaaagggccttgaatgggtggccgcgatctctttcgctgggacgaaaaagagctatgccgcctccgttaaaggaagatttacaatttctcgggacaatagcaagaacaccctgtacctccaaatgaactccctgcgcccggaggatacagctctttattactgtgccaaagacatgagaggcttcgaatgcgaggaatgggctagcgattattacgactttggccgggagcagccctgtcaggatcctcgcggggtggtcggaatcttcgacctgtggggccaggggaccatggtgtctgtttccagc

SEQ ID NO: 40218 - RNA, 432 nt, synthetic construct
  misc_feature 1..432: note = derived and/or modified sequence opt5 from anti-HIV_cap256-059-149799_VR-Chain
  source 1..432: mol_type = other RNA
caggtgcacctggtcgagagcggcgggggagttgtgcaacccggcagatccctccggctgtcttgcgccgctagccagttcaccttttccaactacgggttccattgggtgcgccaggcccctggaaagggccttgaatgggtcgcggctatctcttttgccggggtgaaaaagcactatgccgacagcgttaaaggaagattcacaatttcccgggataattctaagaacacgctgtacctccagctgaatagccttcgcgctgaggacaccgccctgtattactgtgctaaagatctcagagaatatgagtgcgaagagtgggcctccgactactatgattttggccgggacttcccgtgtcaagatccccgcggcgtggtcgggacatttgacatctggggacagggcaccatggtgacagttagctct

SEQ ID NO: 40219 - RNA, 432 nt, synthetic construct
  misc_feature 1..432: note = derived and/or modified sequence opt5 from anti-HIV_cap256-059-148168_VR-Chain
  source 1..432: mol_type = other RNA
caggtgcaactggtcgagagcggcgggggagttgtgcagcccggcagatccctccggctgtcttgcaccgccagccagttcacattttccaattacgggatgcactgggtgcgccaggctcctggaaagggccttgaatgggtcgccgggatctctttcgcggctacgaaaaagtattacagcgactccgtgaaaggaagatttaccatttctcgggataatagcaagaacgccctgtatctccaaatgaactccctgcgcgccgaggacacagctctttaccattgtgccaaagatctgagagaatatgagtgcgaagagtgggctagcgactactatgatttcggccgggagcagccgtgtcaggacccccgcggcgttgtggggacctttgatatctggggacagggcacaatggtcaccgtgtctaca

SEQ ID NO: 40220 - RNA, 435 nt, synthetic construct
  misc_feature 1..435: note = derived and/or modified sequence opt5 from anti-HIV_cap256-059-144685_VR-Chain
  source 1..435: mol_type = other RNA
caggtgcacctggtcgagagcggcgggggagttgtgcaacccggcagatccctccggctgtcttgcgccgctagcgggttcaccttttccaacttcgccatggactgggtgcgccaggcgcctggaaagggccttgaatgggtcgcttttgtgtctagcgatgggaataacaaaaattacggagactccgttaagggcagattcacaatctctcgggataacagcaaaaatacgctgtttctccagatgaactccctgcgcgccgaggacaccgccctttattactgtgtgaaggatgtcggcgactataaaagcgatgaatgggctacacattactattacgacctgtctattgccgatccgatccaggaccccagagctgtggttggggccttcgatatttggggacggggcaccatggtggcggtctccagc

SEQ ID NO: 40221 - RNA, 432 nt, synthetic construct
  misc_feature 1..432: note = derived and/or modified sequence opt5 from anti-HIV_cap256-059-140017_VR-Chain
  source 1..432: mol_type = other RNA
caggtgcaactggtcgagagcggcgggggagttgtgcagcccggcagatccctccggctgtcttgcgccgctagccagttctcctttgggaacttcggaatgcactgggtgcgccaggcccctggcaaggggcttgaatgggtcgcgggaatctcttttgctggcaccaaaaagtactatgccgacagcgtgaaaggcagattcacaatttcccgggataattctaagagcgccctgtttctccaaatgaactccctgcgcgctgaggacacggccctttactattgtgctaaagatctgagatactatgaatgcgaggaatgggccagcgactactatgatttcgggcgggaccagccgtgtcaggatccccgcggagttgtgggcacctttgacatgtgggggcagggaacaatggtcaccgtgtcttcc

SEQ ID NO: 40222 - RNA, 432 nt, synthetic construct
  misc_feature 1..432: note = derived and/or modified sequence opt5 from anti-HIV_cap256-059-137547_VR-Chain
  source 1..432: mol_type = other RNA
caggtgcaactggtcgagagcggcgggggagttgtgcagcccggcagatccctccggctgtcttgcgccgctagccagttcaccttttcccgctacgggatgcactgggtgagacaggcccctggaaagggccttgaatgggtcgcggctatctctttcgccgggattaaaaagaactatgccgacagcgtgaaaggacggtttacaatctcccgcgataattctaagaacacgctgtacctccaaatgaatagcctgagagctgaggacaccgccctttattactgtgctcgggatctgcgcgagttcgaatgcgaagagtgggcctccgactattacgattttggcagagacttcccgtgtcaggatccccggggcgttgtggggatttttgacatctggggacagggcacaatggtcaccgtgagctct

SEQ ID NO: 40223 - RNA, 435 nt, synthetic construct
  misc_feature 1..435: note = derived and/or modified sequence opt5 from anti-HIV_cap256-059-131908_VR-Chain
  source 1..435: mol_type = other RNA
caggtgcaactggtcgagagcggcgggggagttgtgcagcccggcagatccctccggctgtcttgcaccgccagcgggttcacattttccaactacggaatccactgggtgcgccaggctcctggcaaggggcttgaatgggtcgccgcgatttcttatgagggaagcatcaaatactatgtggactccgttaagggcagattcacgatttctcgggatgacagcaaaaataccctgtttctccagatgaactccctgcgcacagaagataccgctgtgtactattgtacaagagacgtccgggagtgggaaaccgaggagtgggccacaaattactattacgatcttagcatcgcctacccgattcgccatcccagaggcgtggttgggatcttcgacgtgtggggactgggcacccgggtcacggtgtcttcc

SEQ ID NO: 40224 - RNA, 432 nt, synthetic construct
  misc_feature 1..432: note = derived and/or modified sequence opt5 from anti-HIV_cap256-059-116006_VR-Chain
  source 1..432: mol_type = other RNA
caggcccaactggtggaaagcggcgggggagtcgttcagcccggcagatccctccggctgtcttgcgctgccagccagttctccttttctagctacgggatgcactgggtgcgccaggcgcctggaaagggccttgaatgggtggcttccatctctttcgccggggtcaaaaagaccaacgccgacagcgtgaaaggaagatttacaatttcccgggataatagcaagaacacgctgcatctccaaatgaatggcctgcgcaacgacgataccgctctttattactgtgccagagacctgcgggatttcgagtgcgaagagtgggcttctgactattacgattttggccgcgagttcccgtgtcaggaccccagaggggttgtgggaacatttgatatctggggccaggggaccaaagtcacagtgtccagc

SEQ ID NO: 40225 - RNA, 411 nt, synthetic construct
  misc_feature 1..411: note = derived and/or modified sequence opt5 from anti-HIV_cap256-059-115783_VR-Chain
  source 1..411: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagctatgccgactccgtgaaagggagattcacaatttctcgggataacagcaagaatacgctgtacctccaaatgaactccctgcgcgccgaggacaccgctctttattactgtgccaaagatctgagagaaatggagtgcgaagagtgggctagcgactattacgattttggacgggacctcccgtgtcaggatccccgcggcgttgtgggcacactggacatctgggggcagggaaccatggtcacagtgtcttcc

SEQ ID NO: 40226 - RNA, 432 nt, synthetic construct
  misc_feature 1..432: note = derived and/or modified sequence opt5 from anti-HIV_cap256-059-114609_VR-Chain
  source 1..432: mol_type = other RNA
caggtgcaactggtcgagagcggcgggggagttgtgcagcccggcagatccctccggctgtcttgcgccgctagccagcttaccttctccaactttgggatgcactgggtgcgccaggcccctggaaagggcctggaatgggtcgcggggatctctttcgctggaacgaaaaagtactatgccgacagcgtgaaaggcagatttacaatttcccgggataattctaagaacgccctctacctgcaaatgaatacccttcgcgctgaggacacagccctgtatttctgtgctaaagatctcagagaatacgagtgcgaagagtgggccagcgactattacgattttggccgggaccagccgtgtcaggatccccgcggggttgtgggaatcttcgacatttggggccaggggaccatggtcacagtgtccagc

SEQ ID NO: 40227 - RNA, 432 nt, synthetic construct
  misc_feature 1..432: note = derived and/or modified sequence opt5 from anti-HIV_cap256-059-113952_VR-Chain
  source 1..432: mol_type = other RNA
caggcccaactggtggagagcggcgggggagtcgttcagcccggcagatccctccggctgtcttgcgctgccagccacttcaccttttcctcttacgggttccattgggtgcgccaggcgcctggaaagggccttgaatgggtggctgggatcagctttgccgccacgaaaaagtattacgctgactccgtcaaaggaagattcacaatttctcgggataatagcaaggacgccctgtatctccagatgaactccctgcgcgctgaggataccgccctttactattgtgcgagagacctgcggggctacgaatgcgaggaatgggccagcgattattacgactttggccgcgatcaaccgtgtcaggaccccagaggggtggttggaatcttcgatctctggggccaggggacaatggtgaccgtctcttcc

SEQ ID NO: 40228 - RNA, 432 nt, synthetic construct
  misc_feature 1..432: note = derived and/or modified sequence opt5 from anti-HIV_cap256-059-113878_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgccacgaacaaatactatgtggatagcgttaaggggagattcaccatttcccgggacaattctaaaaacacactctacctgcagatgagctcccttaccgccgaggatacagctgtgtattactgtgccaaggacctgggaggcatcaaaattgatgaatggggcaccgactattacgatatcagcgtctcttacccggtgcaagacccccgcgctgttgccgggatttttgatgtgtggggacatggcacaatggtctccgtgagctct

SEQ ID NO: 40229 - RNA, 432 nt, synthetic construct
  misc_feature 1..432: note = derived and/or modified sequence opt5 from anti-HIV_cap256-059-113622_VR-Chain
  source 1..432: mol_type = other RNA
caggtgcaactggtcgagagcggcgggggagttgtgcagcccggcagatccctccggctgtcttgcgccgctagccagttcacctttacatcctacgggatgcactgggtgcgccaggcccctggaaagggccttgaatgggtcgcggggatctctttcgctggaacgaaaaagcattatgccgacagcgtgaaaggcagatttaccatttcccgggataattctaagagcacactgtacctccaaatgaactccctgcgcgccgaggacaccgctctttattactgtgccaaagatatgagagaatatgagtgcgaagagtgggctagcgactactatgatttcggccgggaccagccgtgtcaggatccccgcggggttgtgggaatctttgacctgtggggccaggggacaatggtcaccgtgtcttcc

SEQ ID NO: 40230 - RNA, 432 nt, synthetic construct
  misc_feature 1..432: note = derived and/or modified sequence opt5 from anti-HIV_cap256-059-109427_VR-Chain
  source 1..432: mol_type = other RNA
caggtgcaactggtcgagagcggcgggggagttgtgcagcccggcagatccctccggctgtcttgcgccgctagccagttcaccttttccaattacgggatgcactgggtgcgccaggcccctggaaagggccttgaatgggtcgcgtctatcagcttcgctgggattaaaaagcattatacagactccgtgaaaggaagatttacgatctctcgggataatagcaagaacaccctgttcctccaaatgaactccctgcgcgccgaggacacagccctttactattgtgctagagatctgcgggaatacgagtgcgaagagtgggccagcgactattacgattttggccgcgaccagccgtgtcaggatcccagaggcgttgtggggacctctgacatttggggacagggcacaaaagtcaccgtgtccagc

SEQ ID NO: 40231 - RNA, 432 nt, synthetic construct
  misc_feature 1..432: note = derived and/or modified sequence opt5 from anti-HIV_cap256-059-109081_VR-Chain
  source 1..432: mol_type = other RNA
caggagcaactggtggaaagcggcgggggagtcgttcagcccggcagatccctccggctgtcttgcgccgctagccagttctccttttctgcctacgggatgcactgggtgcgccaggcgcctggaaagggccttgagtgggtggctgggatcagcttcgccgccaccaaaaagtattacgaagactccgtcaaaggaagatttacaatttctcgggataacagcaagaatacgctgtatctccaaatgaactccctgcgcggcgaggacaccgctctttactattgtgccaaagatatgagagaaatggagtgcgaggaatgggctagcgactactatgatttcggccggccgcagccctgtcaggaccctcgcggggtggttggaatctttgatatgtggggccaggggacaatggtgaccgtctcttcc

SEQ ID NO: 40232 - RNA, 432 nt, synthetic construct
  misc_feature 1..432: note = derived and/or modified sequence opt5 from anti-HIV_cap256-059-107590_VR-Chain
  source 1..432: mol_type = other RNA
caggagcaactggtggaaagcggcgggggagtcgttcagcccggcagatccctccggctgtcttgcgccgctagccagttctccatctctgcctacgggatgcactgggtgcgccaggcgcctggaaagggccttgagtgggtggctgggattagctttgccggaaccaaaaagtattacgccgactccgtcaaaggcagattcacaatctctcgggataacagcaagaatacgctgtatctccaaatgaactccctgcgcggcgaagacaccgctctttactattgtgccaaagatatgagagagatggaatgcgaggagtgggctagcgactactatgattttgggcgggaccagccgtgtcaggatccccgcggagtggttggcattttcgacatgtgggggcagggaacaatggtgaccgtctcttcc

SEQ ID NO: 40233 - RNA, 435 nt, synthetic construct
  misc_feature 1..435: note = derived and/or modified sequence opt5 from anti-HIV_cap256-059-107504_VR-Chain
  source 1..435: mol_type = other RNA
caggtgctgctcgtcgagagcggcgggggagttgtgcaacccggcaagtccctgagactttcttgcagcgcctcccggttcaccttttctaactacgggatgcactgggtgcgccaggctcctggaaaaggcctggaatgggtcgccgcggtgagcttcgctgggatcaagaaaacaaatgccgactccgttaagggaagatttacgatttctcgggataacagcaaaaataccctctatctgcagatgaactcccttcgcgccgaggacacagctctgtactattgtgccagagatctccgggacttcgaatgcgaggaatgggctagcgattactatgacttttggggcgatccgcagccctgtcaagaccctcgcggcgtggtcgggaccttcgatctgtggggacagggcacaatggtgaccgtttcttcc

SEQ ID NO: 40234 - RNA, 432 nt, synthetic construct
  misc_feature 1..432: note = derived and/or modified sequence opt5 from anti-HIV_cap256-059-099614_VR-Chain
  source 1..432: mol_type = other RNA
gaggtgctgctcctggaaagcggcgggggacttgtccagcccggcagatccctgcggctctcttgcgccgctagccaattcaccttttcctcttacgggatgcactgggttcgccaggcccctggaaagggcctggagtgggtggcggggatcagcttcgtgggaattaaaaagtattacgctgactccgtcaaaggcagatttacaatctctcgggataacagcaagaatacgctttatctgcagatgaactccctccgcgccgaagacaccgccctgtactattgtgctagagatctgcgggagtacgaatgcgaggagtgggccagcgactattacgatttcggccgcgaccagccgtgtcaagatcccagaggggtggttggaacatttgacatttggggccaggggaccatggtgacagtctcttcc

SEQ ID NO: 40235 - RNA, 432 nt, synthetic construct
  misc_feature 1..432: note = derived and/or modified sequence opt5 from anti-HIV_cap256-059-098972_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcgagcatctccttcgctgggattaaaaagaactatagagactctgtgaaaggacggtttacaatcagccgcgataattccaagaacacgctgtacctccaaatgaccagcctgagaccggaggacacagccctttattactgtgccaaagatctgcggggcttcgaatgcgaggaatgggcttctgactattacgattttggccgcgagctcccctgtcaggaccctagaggggttgtgggaaccttcgatatgtggggccaggggacaatggtcaccgtgtccagc

SEQ ID NO: 40236 - RNA, 432 nt, synthetic construct
  misc_feature 1..432: note = derived and/or modified sequence opt5 from anti-HIV_cap256-059-097236_VR-Chain
  source 1..432: mol_type = other RNA
caggtgcaactggtcgagagcggcgggggagttgtgcagcccggcagatccctccggctgtcttgcgccgctagcgggttctccttttctaacttcggatttcactgggtgcgccaggcccctggcaaggggcttgaatgggtcgcggctatcagcttcgtgggaaataaaaagtactatgccgagtccgttaaaggcagatttaccatttctcgggaaaacagcaagaatatgctgttcctccagatgaactccctgcgcggcgaggacacagccgtgtactattgtgctaaagatcttagagaatttgagtgcgaggaatgggccagcgactactatgatttcgggcgggagcaaccgtgtcaggacccccgcggagtcgtgggctctatcgatgtttgggggcatggatccctggtgacggtcagctct

SEQ ID NO: 40237 - RNA, 432 nt, synthetic construct
  misc_feature 1..432: note = derived and/or modified sequence opt5 from anti-HIV_cap256-059-091487_VR-Chain
  source 1..432: mol_type = other RNA
caggtgcaactggtcgagagcggcgggggagttgtgcagcccggccggtccctccggctgtcttgcgccgctagccagttcacctttaaccgctacgggatgcactgggtgagacaggcccctggaaagggccttgaatgggtcgcggtgatctcctatgacgggacaaataaatactatggagagtctgttaagggccggttcacgattagccgcgataactccaaaaataccctgtacctccaaatgaactctctgagagctgaagacacagccctttattactgtgccaaggatctgcgggaggacgaatgcgaggagtggtggagcgattattacgactttggccgcgaactcccgtgtagaaaatccagaggggtggctggaatcttcgatatttggggccaggggaccatggtcacagtgagctct

SEQ ID NO: 40238 - RNA, 432 nt, synthetic construct
  misc_feature 1..432: note = derived and/or modified sequence opt5 from anti-HIV_cap256-059-089812_VR-Chain
  source 1..432: mol_type = other RNA
caggtgcaactggtcgagagcggcgggggagttgtgcagcccggcagatccctccggctgtcttgcgccgctagccagcttaccttctcctcttacgggatgcactgggtgcgccaggcccctggaaagggcctggaatgggtcgcggggatcagctttgctggaacgaaaaagcattattccgactctgtgaaaggcagattcacaattagccgggataactccaagaatgccctctacctgcaaatgaacagccttcgcgccgaggacaccgctctgtattactgtgccaaagatctcagagaatatgagtgcgaagagtgggcttctgactactatgattttggccgggagcagccgtgtcaggacccccgcggggttgtgggaatcttcgatatgtggggccaggggacaatggtcaccgtgtccagc

SEQ ID NO: 40239 - RNA, 432 nt, synthetic construct
  misc_feature 1..432: note = derived and/or modified sequence opt5 from anti-HIV_cap256-059-088468_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagcttcgtggggattaaaaagtattacgccaattccgttaaaggaagatttacaatctctcgggacaatagcaagaacacgctgtatctccaaatgaactccctgcgcgccgaggataccgctctttactattgtgccagagacctgcgggaatacgagtgcgaagagtgggctagcgattattacgacttcggccgcggcgggccgtgtcaggatcccagaggagtggtcggctcttttgacatttgggggcagggaacaatggtgaccgtttccagc

SEQ ID NO: 40240 - RNA, 432 nt, synthetic construct
  misc_feature 1..432: note = derived and/or modified sequence opt5 from anti-HIV_cap256-059-088341_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagcttcgccgggattaaaaagcattatgccgactccgtgaaaggaagatttacaatctctcgggataacagcaagaatatggttttcctgcaaatgaactccctccgcgctgaggacacggccctgtactattgtgctagagatcttcgggaatacgagtgcgaagagtgggccagcgactattacgattttggccgcgaccagccgtgtcaggatcccagaggcgtggtcgggacctctgacatttggggacagggcacaatggtgaccgtttccagc

SEQ ID NO: 40241 - RNA, 432 nt, synthetic construct
  misc_feature 1..432: note = derived and/or modified sequence opt5 from anti-HIV_cap256-059-086533_VR-Chain
  source 1..432: mol_type = other RNA
caggtgctgctcgtcgagagcggcgggggagttgtgcaacccggcagatccctgcggctttcttgcgccgctagccagttcaccttttccaacttcgggatgcactgggtgcgccaggcccctggaaagggcctggaatgggtcgcggggatctcttttgtgggaattaaaaagtactatgctggcagcgttaaaggcagattcacaatctcccgggacaattctaagaacacgctctacctgcagatgaatagccttcgcgccgaggataccgccctgtattactgtgctaaagacctcagagaatttgagtgcgaagagtgggcctccgattattacgacttcgggcggccgcaaccctgtcaggatcctcgcggagtggtcggcacatttgacctgtgggggctgggaaccctcgtgacagttagctct

SEQ ID NO: 40242 - RNA, 432 nt, synthetic construct
  misc_feature 1..432: note = derived and/or modified sequence opt5 from anti-HIV_cap256-059-086043_VR-Chain
  source 1..432: mol_type = other RNA
gaggtgcacctggtcgaaagcggcgggggactcgttaagcccggcgggtccctgagactttcttgcgccgctagcggattcaccttttccacatactctatgaactgggtgcggcaggcccctggcaaagggctggagtgggtggcgttcgtcgcttttgacgaaagcgataagtattacgccgactccgtgaaaggacgcttcacgatctctagagataatagcaagaacaccctctccctgcaaatgaatagccttcgggttgaggacacagccatttattactgtgctaaagaagtgggcgataacaaggacgatgagtgggcctctgactattacgatctgtccatcgcttatccgattcaggacccccgcgccgtcggcagagggtacgatatctggggacagggcaccatggtgacagttagctct

SEQ ID NO: 40243 - RNA, 432 nt, synthetic construct
  misc_feature 1..432: note = derived and/or modified sequence opt5 from anti-HIV_cap256-059-084191_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagcttcgtggggattaaaaagtattacgccgactccgttaaaggaagatttacagtgtctcgggataacagcaagtccacgctgtatctccaaatgaatagcctgcgcgccgaggacaccgctctttactattgtgccagagatctgcgggaatacgagtgcgaagagtgggcttctgactattacgatttcggccgcgaccagccgtgtcaggatcccagaggcgtcgtggggatctttgacatttggggacagggcacagccgttaccgtgtccagc

SEQ ID NO: 40244 - RNA, 417 nt, synthetic construct
  misc_feature 1..417: note = derived and/or modified sequence opt5 from anti-HIV_cap256-059-082135_VR-Chain
  source 1..417: mol_type = other RNA
caggtgcaactggtcgagagcggcgggggagttgtgcagcccggcagatccctccggctgtcttgcaccgccagcgggttcacatttcgctcctacgctatccactgggtgagacaggcccctggaaagggccttgaatgggtcgcgctgatttcttatgacgggagcaataaatactatgctgattccgtgaagggacggttcacgatctctcgcgacaatagcaaaaacaccctctacctgcagatgaactcccttacaagcgaggataccgccgtttattactgtgccaaggacctgggcggctctaaaacagatgaatgggggaccgactattgctacccggtgcaagatcccagagtcgtggttggagcttttgacatttggggccatgggacaatggtgaccgtctccagc

SEQ ID NO: 40245 - RNA, 432 nt, synthetic construct
  misc_feature 1..432: note = derived and/or modified sequence opt5 from anti-HIV_cap256-059-079417_VR-Chain
  source 1..432: mol_type = other RNA
caggtgcaactggtcgagagcggcgggggagttgtgcagcccggcagatccctccggctgtcttgcgccgctagcgggttctccttttctaactacgccatggactgggtgcgccaggcgcctggaaagggccttgaatgggtcgctttcgtgagctccgatgggaataacaaaaagtatgccgactctgttaaaggaagatttaccctgagccgggataattacaagaacacagtgtatctccagatgaactccctgacggtcgaggacaccgccgtgtactattgtgctaaagatcttggcgccaataaggacgatgaatggggcacagactactatgatatgagcgtttcttacccgatccccgaccctcgcgctgtggtcggggccttcgatgtgtggggacaaggcaccctggtgacagtctccagc

SEQ ID NO: 40246 - RNA, 435 nt, synthetic construct
  misc_feature 1..435: note = derived and/or modified sequence opt5 from anti-HIV_cap256-059-076027_VR-Chain
  source 1..435: mol_type = other RNA
caggtgcaactggtcgagagcggcgggggagttgtgcagcccggcagatccctccggctgtcttgcgccgctagcgggttctccttttctaagtacggaatgcactgggtgcgccaggcccctggcaaagggcttgaatgggtcgcgttcgtggcttttgacgagagcgaaaagtattacgccgcctccgttaaaggaagattcaccatctctcgggataacagcaagaatacactgtccctccagatgaacagcctgcgcacggaggacaccgctatttattactgtgccaaagaagtgggcgataataaggacgatgagtggacatctccgtattactatgacatctccattgcttaccccgtccatgatcctagagccgtggttggcgtgagcgacgtctgggggcaaggaaccatggtgacagtgtcttcc

SEQ ID NO: 40247 - RNA, 432 nt, synthetic construct
  misc_feature 1..432: note = derived and/or modified sequence opt5 from anti-HIV_cap256-059-075082_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagcttcgtggggattaaaaagtattacgccgactccgttaaaggaagatttacaatctctcgggataacagcaagaatacgctgtatctccaaatgaactccctgcgcgccgaggacaccgctctttactattgtgccaaagatctgagagaaatggagtgcgaagagtgggctagcgactactatgatttcggccgggacctcccgtgtcaggatccccgcggcgtggtcgggacactggacatttggggacagggcaccatggtgacagtttcttcc

SEQ ID NO: 40248 - RNA, 432 nt, synthetic construct
  misc_feature 1..432: note = derived and/or modified sequence opt5 from anti-HIV_cap256-059-072575_VR-Chain
  source 1..432: mol_type = other RNA
cagggccaactggtggagagcgggggaggcgtcgttcagcccgggagatccctccggctgtcttgcgccgctagccagttcaccttttccaacttcggaatgcactgggtgcgccaggcccctggcaaggggcttgaatgggtggcggtcatctcttacgacggaacgaaaaagtattacgctgatagcgtgaaaggcagatttacaatttcccgggacaattctaagaacaccctgtatctccaaatgaatagcctgcgcgccgaggatacagccctttactattgtgctaaagacatgagagaagatgagtgcgaagagtggggcgccgactactatgatttcgggaaggactacccgtgtcaggcttcccggggagttgtgggcatctttgatatttgggggcagggaaccatggtcacagtgagcgcc

SEQ ID NO: 40249 - RNA, 432 nt, synthetic construct
  misc_feature 1..432: note = derived and/or modified sequence opt5 from anti-HIV_cap256-059-071926_VR-Chain
  source 1..432: mol_type = other RNA
caggtgcaactggtcgagagcggcgggggagttgtgcagcccggcagatccctccggctgtcttgcgccgctagccagctttccttctctaattacgggatgcactgggtgcgccaggcccctggaaagggcctggaatgggtcgcggggatcagctttgtgggaattaaaaagtattacagagactccgttaaaggccggttcaccatctctcgcgataatagcaagaacacactctatctgcaaatgaactcccttagaacggaggacaccgctctgtactattgtgtgaaagatctccgggaatttgagtgcgaagagtgggccagcgactactatgatttcggccgcgaccagccgtgtctggatcccagaggggtcgtgggaacatttgacatttggggccaggggaccatggttacagtgtcttcc

SEQ ID NO: 40250 - RNA, 432 nt, synthetic construct
  misc_feature 1..432: note = derived and/or modified sequence opt5 from anti-HIV_cap256-059-069638_VR-Chain
  source 1..432: mol_type = other RNA
caggtgcaactggtcgagagcggcgggggagttgtgcagcccggcagatccctccggctgtcttgcgccgctagcgggttcaccttttccaagaacgccatgcactgggtgcgccaggcgcctggaagaggccttgaatgggtcgcttctgtggccttcgacgggagcgataaatactatgccgactccgttaagggacggtttacaatctctcgcgataatagcaaaaacacgctgtccctccagatgaatagcctgagagctgaggacaccgccgtgtactattgtgctaaggaagtcgatctttacaaagacgatgagtggggctctgactattacgatctgtccattgcctatccgatccaagacccccgggcggtggttggcgggttcggaatttggggccaggggacaatggtgaccgtcagctct

SEQ ID NO: 40251 - RNA, 432 nt, synthetic construct
  misc_feature 1..432: note = derived and/or modified sequence opt5 from anti-HIV_cap256-059-069165_VR-Chain
  source 1..432: mol_type = other RNA
ctggtgcagctcgtcgagagcggcgggggagttgtgcaacccggccggtccctgcggctttcttgcgccgctagccgcttcaccttttccaactacgggatgcactgggtgagacaggcccctggaaagggcctggaatgggtcgcggggatctctttcgctggaacaacgaaatattacgccgacagcgtgcggggccgctttaccatttccagagataattctaagaacacactctatctgcagatgaatagccttcgggccgaggacaccgctctgtactattgtgccaaagatatgcgcgaaatggagtgcgaagagtgggcttccgactactatgatttcggcagaccgcagccctgtcaagaccctagaggggttgtgggaatctttgatatttggggccaggggacaatggtcaccgtgagctct

SEQ ID NO: 40252 - RNA, 432 nt, synthetic construct
  misc_feature 1..432: note = derived and/or modified sequence opt5 from anti-HIV_cap256-059-068956_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaagaggccttgaatgggtcgctctgatctcttatgacgggagcaataagtactatgtggattccgttaaaggacggttcacgatttctcgcgacaatagcaagaacaccctctacctgcagatgaactcccttacagccgaggataccgccgtgtattactgtgctaaagacctgggcggcagcaaggatgacgaatgggccacagattattacgacctctctatcgcttacccgattcaagatcccagagccgtcgcggggatctttgacgtgtggggacggggcaccgttgtgacagtctccagc

SEQ ID NO: 40253 - RNA, 432 nt, synthetic construct
  misc_feature 1..432: note = derived and/or modified sequence opt5 from anti-HIV_cap256-059-068876_VR-Chain
  source 1..432: mol_type = other RNA
caggtgcaactggtcgagagcggcgggggagttgtgcagcccggccggtccctccggctgtcttgcgccgctagccagttcaccttttcctcttacgggatgcactgggtgcgccaggcccctggaaagggccttgaatgggtcgcggctatcagcttcgccgggacgaaaaagtattacgccaactccgtgaaaggaagatttacaatttctcgggacaatagcaagaacaccctgtccctccaaatgaatagcctgcgcggcgaggatacagctagatattactgtgcccgggacccgcgcgaatatgagtgcgaagagtgggcttctgattactatgacttcggcagagatcagccctgtcaggaccctagaggggttatcggaatttttgatatctggggccaggggaccatggtgacagtctccagc

SEQ ID NO: 40254 - RNA, 432 nt, synthetic construct
  misc_feature 1..432: note = derived and/or modified sequence opt5 from anti-HIV_cap256-059-067733_VR-Chain
  source 1..432: mol_type = other RNA
caggtgcaactggtcgagagcggcgggggagttgtgcagcccggcagatccctccggctgtcttgcaccgccagccagttctccttttctagctacgggatgcactgggtgcgccaggctcctggaaagggccttgaatgggtcgccgcgatctccttcgctgggacgaaaaagaactatgtggactctgttaaaggaagatttacaattagccgggataattccaagaacaccctgtacctccaaatgaatagcctgcgcgccgacgatacagccctttattactgtgctaaagacatgagagagtatgaatgcgaggaatgggcctctgattactatgacttcggccgggagtacccgtgtaccgatccccgcggcgtggtcgggacatttgacgtgtggggacagggcaccatggttacagtgtccagc

SEQ ID NO: 40255 - RNA, 432 nt, synthetic construct
  misc_feature 1..432: note = derived and/or modified sequence opt5 from anti-HIV_cap256-059-067450_VR-Chain
  source 1..432: mol_type = other RNA
caggtgcaactggtcgagagcggcgggggagttgtgcagcccggcagatccctccggctgtcttgcgccgctagccagttcaccttttccaattacgggatgcactgggtgcgccaggcccctggaaagggccttgaatgggtcgcggggatctctttcgctggaattaaaaagtattacgccgacagcgtgaaaggcagatttacaatctcccgggataatgccaagaacacgctgtatctccaaatgaactctctgcgcgctgaggacaccgccctttactattgtgctaaagatctgagagaatacgagtgcgaagagtgggccagcgactattacgatttcggccgggagctcccgtgtcaggacccccgcggggttgtgggaacatttgatatttggggccaggggaccatggtcacagtgtccagc

SEQ ID NO: 40256 - RNA, 432 nt, synthetic construct
  misc_feature 1..432: note = derived and/or modified sequence opt5 from anti-HIV_cap256-059-065694_VR-Chain
  source 1..432: mol_type = other RNA
caggtgcaactggtcgagagcggcgggggagttgtgcagcccggcagatccctccggctgtcttgcgccgctagccagcttaccttcaacaattacgggatgcactgggtgcgccagacacctggaaagggcctggaatgggtcgccgggatctcctttgcgggaattaacaaatattacgctgactctgtgaagggcagattcacgatcagccgggataattccaaaaacgccctctatctgcaaatgacctctcttcgcgccgaggacacagctctgtactattgtgttaaggatctcagagaaatggagtgcgaagagtgggccagcgactactatgattttggccgggaccagccgtgtcaggatccccgcggggtggtcggaaccttcgacatttggggccaggggacaatggtgaccgtttccagc

SEQ ID NO: 40257 - RNA, 432 nt, synthetic construct
  misc_feature 1..432: note = derived and/or modified sequence opt5 from anti-HIV_cap256-059-065109_VR-Chain
  source 1..432: mol_type = other RNA
caggtgcaactggtcgagagcggcgggggagttgtgcagcccggcaagtccctcagactgtcttgcgccgctagcgggttcacctttacaaacaatgccatgaactgggtgcggcaggcgcctggaaaaggccttgaatgggtcgctttcgtgtcctctgacgggcgcaataagaactacgccgatagcgttaaaggaagatttacgatctcccgggacaattctaagaacaccgtgtatctgcagatgaatagcctccgcgtcgaggatacagccctgtactattgtgctaaagaccttggcgccaacaaggatgacgaatgggctaccgattactatgacctgtccgtggcctacccgattcccgatcctagagcggttgtgggcgccttcgacgtctgggggcaaggaacaatggtgaccgtgagctct

SEQ ID NO: 40258 - RNA, 432 nt, synthetic construct
  misc_feature 1..432: note = derived and/or modified sequence opt5 from anti-HIV_cap256-059-065060_VR-Chain
  source 1..432: mol_type = other RNA
caggtgcaactggtcgagagcggcgggggagttgtgcagcccggcacctccctcagactgtcttgcgccgctagcgggttcacattttccaactacgccatgggatgggtgcggcaggcgcctggcaaggggcttgaatgggtcgctgtggtttcttatgacggaagcaaaaagtcctacgccgattctgtgaaaggccgcttcacgatcagcagagacaattcccggaacaccctgtatctccagctgaatagccttcgcgccgaggatacagctatgttttactgtgccaaggacctgggcaaaggggaaattgaggaatgggctaccgattattacgactggtctaaggcctatccgatcgagggacccagagatgtcgtgggcgcgttcgacacatgggggcaaggaaccctcgttacagtgtccagc

SEQ ID NO: 40259 - RNA, 432 nt, synthetic construct
  misc_feature 1..432: note = derived and/or modified sequence opt5 from anti-HIV_cap256-059-064001_VR-Chain
  source 1..432: mol_type = other RNA
caggtgcaactggtcgagagcggcgggggagttgtgcagcccggcagatccctccggctgtcttgcgccgctagccagttcaccttttccaactacgggatgcactgggtgcgccaggcccctggaaagggccttgaatgggtcgcggggatctctttcgctggaacgaaaaattattacgccaagagcgtgaaaggcagatttacaatttcccgggacaactctaagaatgccctgtatctccaaatgaacagcctgcgcgctgaggataccgccctttactattgtgctaaagacatgagagaatacgagtgcgaagagtgggcctccgattattacgacttcggccgggatcagccgtgtcaggacccccgcggggttgtgggaacatttgatatctggggccaggggaccatggtcgcggtgagctct

SEQ ID NO: 40260 - RNA, 432 nt, synthetic construct
  misc_feature 1..432: note = derived and/or modified sequence opt5 from anti-HIV_cap256-059-063270_VR-Chain
  source 1..432: mol_type = other RNA
caggtgcaactggtcgagagcggcgggggagttgtgcagcccggcagatccctccggctgtcttgcgccgctagccagttcaccttttccaactacgggatgcactgggtgcgccaggcccctggaaagggccttgaatgggtcgcggctatctctttcgccgggacgaaaaagcattatgccgacagcgtgaaaggaagatttacaatttcccgggataattctaagaacgctctgtacctccaaatgaatagcctgcgcgccgaggacaccgctctttattactgtgccaaagatctgagagaatatgagtgcgaagagtgggcgtccgactactatgatttcggccgggaccagccgtgtctcgatccccgcggcgttgtggggatctttgacatttggggacagggcacactggtcaccgtgagctct

SEQ ID NO: 40261 - RNA, 432 nt, synthetic construct
  misc_feature 1..432: note = derived and/or modified sequence opt5 from anti-HIV_cap256-059-061357_VR-Chain
  source 1..432: mol_type = other RNA
caggtgcaactggtcgagagcggcgggggagttgtgcagcccggcagatccctccggctgtcttgcgccgctagcgggttcaccttttccaacttcggatttcactgggtgcgccaggcccctggcaaggggcttgaatgggtcgcgggaatctctttcgctggcacaaaaatttactatgccgacagcgtgaagggcagatttacgatctcccgggaaaattctaaaaacatgctgtacctccagatgaatagcctgcgcggggaggataccgccgtttatttctgtgctaaggaccttagagagtttgaatgcgaggagtgggcctccgattactatgacttcggacgggaatttccgtgtcaagatccccgcggcgtggtcgggacattcgacgtgtggggacatggcgctgttgtgaccgtcagctct

SEQ ID NO: 40262 - RNA, 435 nt, synthetic construct
  misc_feature 1..435: note = derived and/or modified sequence opt5 from anti-HIV_cap256-059-059834_VR-Chain
  source 1..435: mol_type = other RNA
caggtgcaactggtcgagagcggcgggggagttgtgcagcccggcagatccctccggctgtcttgcgccgctagcgggttcaccttttccaacttcggaatgcactgggtgcgccaggcccctggcaaggggcttgaatgggtcgcgtttgtggctttcgacgagtctgataaatactatgccgccagcgttaagggaagatttacagtgtcccgggacaattctaaaaacacggtcagcctgcagatgaactccctccgcaccgaagatacagctgtgtactattgtgccaaggaggttggcgacaataaagatgacgaatggaccagcccgtactattacgatttctctatcgcttatcccgtgcatgaccctagagccgtcgtgggcgggtacgatgtgtggggacaaggcacaatggtcaccgtttccagc

SEQ ID NO: 40263 - RNA, 432 nt, synthetic construct
  misc_feature 1..432: note = derived and/or modified sequence opt5 from anti-HIV_cap256-059-059313_VR-Chain
  source 1..432: mol_type = other RNA
caggtgcacctggtcgagagcggcgggggagttgtgcaacccggcaagtccctcagactgtcttgcgccgctagccagttcaccttttccaacttcgggatgcattgggtgcggcaggcccctggaaaaggccttgaatgggtcgcggggatctcttttgctggaacaaagaaatactatgccgacagcgtgaagggccgcttcacgatttccagagataattctaaaaacaccctgtacctccagatgaatagcgttcgggccgaggacacagctctgtattactgtgccaaggatatgcgcgaatatgagtgcgaagagtgggcttccgactactatgattttggcaagccgcaaccctgtcaggaccctagaggggtggtcggaaccttcgatatgtggggccttgggacactggtgaccgttagctct

SEQ ID NO: 40264 - RNA, 432 nt, synthetic construct
  misc_feature 1..432: note = derived and/or modified sequence opt5 from anti-HIV_cap256-059-057130_VR-Chain
  source 1..432: mol_type = other RNA
caggtgcaactggtcgagagcggcgggggagttgtgcagcccggcagatccctccggctgtcttgcgccgctagccagttctccttttctagctacgggatgcactgggtgcgccaggcccctggaaagggccttgaatgggtcgcggctatctccttcgccgggattaaaaagcattatgccgactctgtgaaaggaagatttaccatcagccgggataactccaagaatacactgtacctccaaatgaacagcctgcgcgttgaggacacggctctttattactgtgccaaagatctgagagaatatgagtgcgaagagtgggcttctgactactatgatttcggccggccgcagccctgtcaggaccctcgcggcgtggtcgggacctccgatatttggggacagggcacaatggtgaccgttagctct

SEQ ID NO: 40265 - RNA, 411 nt, synthetic construct
  misc_feature 1..411: note = derived and/or modified sequence opt5 from anti-HIV_cap256-059-050520_VR-Chain
  source 1..411: mol_type = other RNA
caggtgcaactggtcgagagcggcgggggagttgtgcagcccggcagatccctccggctgtcttgcgccgctagccagttcacctttaatcgctacgggatgcactgggtgagacaggcccctggaaagggccttgaatgggtcgcggtgatctcctatgctgactctgttaaagggcggttcacaattagccgcgataattccaagaacacgctgtacctccaaatgaactctctgagagccgaggacaccgccctttattactgtgctaaagatctgcgggaagacgagtgcgaagagtggtggagcgattattacgactttggacgcgagctcccgtgtagaaagtcccggggcgtggccggcatcttcgatatttgggggcagggaacaatggtcaccgtgagctct

SEQ ID NO: 40266 - RNA, 432 nt, synthetic construct
  misc_feature 1..432: note = derived and/or modified sequence opt5 from anti-HIV_cap256-059-049839_VR-Chain
  source 1..432: mol_type = other RNA
caggtgcaactggtcgagagcggcgggggagttgtgcagcccggcagatccctccggctgtcttgcgccgctagcgggttctccttttctaactacgccatggactgggtgcgccaggcgcctggaaagggccttgaatgggtcgctgtggttagctccgatgggaaaaccaagaattatgccgactctgtgaaaggaagattcacaatcagccgggataactccaagaatacggtctacctgcagatgaacagcctccgcccggaggacaccgccgtgtattactgtgctaaagatctgggcgccaataaggacgatgaatggacaaccgactattacgattggtctgttgcttatcccgtgcctgaccccagagccgtcgtgggcgcgtttgatgtgtgggggcaaggaacaatggtcaccgtttccagc

SEQ ID NO: 40267 - RNA, 432 nt, synthetic construct
  misc_feature 1..432: note = derived and/or modified sequence opt5 from anti-HIV_cap256-059-048503_VR-Chain
  source 1..432: mol_type = other RNA
caggtgcaactggtcgagagcggcgggggagttgtgcagcccggcagatccctccggctgtcttgcgccgctagccagctttccttctctaattacgggatgcactgggtgcgccaggcccctggaaagggcctggaatgggtcgcggggaccagctttgctggaacgaaaaagtattacgccgactccgtgaaaggcagattcacaatctctcgggataatagcaagaacgccctctatctgcaaatgaactcccttcgcgctgaggacaccgccctgtactattgtgctaaagatctcagagaatacgagtgcgaagagtgggccagcgactattacgattttggccgggaccagccgtgtcaggatccccgcggggttgtgggaacattcgacatttggggccaggggaccatggtcacagtgtctgcg

SEQ ID NO: 40268 - RNA, 432 nt, synthetic construct
  misc_feature 1..432: note = derived and/or modified sequence opt5 from anti-HIV_cap256-059-045516_VR-Chain
  source 1..432: mol_type = other RNA
caggtgcaactggtcgagagcggcgggggagttgtgcagcccggccggtccctccggctgtcttgcgccgctagccagttcaccttttccgggtacggaatgcactgggtgcgccaggcccctggcaaggggcttgaatgggtcgcggctatctctttcgccggaaacaaaagatattttgccgacagcgtgaagggccggttcacaatttcccgcgataattctaaaaacacgctgtttctccaaatgaatagcctgagagctgaggacaccgccctttactattgtgctcgggatatgcgcgaatacgagtgcgaagagtgggcctccgactattacgatttcggcagaccgcagccctgtcaggaccctagaggggttgtgggagtctttgatatctggggccaggggacaatggtgaccgttagctct

SEQ ID NO: 40269 - RNA, 432 nt, synthetic construct
  misc_feature 1..432: note = derived and/or modified sequence opt5 from anti-HIV_cap256-059-044188_VR-Chain
  source 1..432: mol_type = other RNA
caggtgcacctggtcgagagcggcgggggagttgtgcaacccggcagatccctccggctgtcttgcgccgctagccagttcaccttttcctcttacgggatgcattgggtgcgccaggcccctggaaagggccttgaatgggtcgcggggatcagcttcgctggaacaaataaatattacgccgactccgtgaagggcagatttacggtttctcgggataatagcaaaaacaccctgtatgtgcagatgaactccctccgcgccgaggacacagctctgtactattgtgccagagatcttcgggaatacgagtgcgaagagtgggctagcgactattacgatttcggccgcgagcaaccgtgtcaggaccccagaggggtcgtgggaatttttgatatctggggccctgggaccatggttacagtgtcttcc

SEQ ID NO: 40270 - RNA, 435 nt, synthetic construct
  misc_feature 1..435: note = derived and/or modified sequence opt5 from anti-HIV_cap256-059-044105_VR-Chain
  source 1..435: mol_type = other RNA
cagggccaactggtggagagcgggggaggcgtcgttcagcccgggagatccctctctctgagctgcgccgcttccggattctcttttaacaattacgccatggactgggtgcggcaggcgcctggcaaggggcttgaatgggtggctgtcgtgagctccgatggaaacaataaaaactatgccgactctgttaagggccgcttcaccatcagcagagataattccaaaaacacagtgtacctgcagatgaatagcctccgggccgaggacacggctatttattactgtgccaaggatgtcggcgctaacaaagacgatgaatgggccaccaattattactatgactggtctgtggcgtacccggttcccgatcctcgcgccgtgatcggggcttttgacgtctggggacaaggcacaatggtgaccgtgtccagc

SEQ ID NO: 40271 - RNA, 432 nt, synthetic construct
  misc_feature 1..432: note = derived and/or modified sequence opt5 from anti-HIV_cap256-059-042100_VR-Chain
  source 1..432: mol_type = other RNA
caggtgcaactggtcgagagcggcgggggagttgtgcagcccggcagatcccagcggctctcttgcgccgctagccagttcaccttttcctcttacgggatgcactgggtgcgccaagcccctggaaagggcctggaatgggtcgcggctatcagcttcgccgggacaaataaatattacggagactccgtgaagggcagatttacgatttctcgggataatagcaaaaacaccctttatctgcagatgaactccctccgcgccgaggacacagctctgtaccattgtgccagagatatgcgggaatatgagtgcgaagagtgggctagcgactactatgatttcggccgcgaccagccgtgtcaggatcccagaggggttgtgggaatctttgacctttggggccaagggaccatggtcacagtgtcttcc

SEQ ID NO: 40272 - RNA, 432 nt, synthetic construct
  misc_feature 1..432: note = derived and/or modified sequence opt5 from anti-HIV_cap256-059-040742_VR-Chain
  source 1..432: mol_type = other RNA
caggtgcaactggtcgagaccggcgggggagttggccagcccggaaagagcctcagactgtcctgcgccgcttctgggttcacatttagcaacttcgccatggactgggtgcggcaggcgcctggcaaagggcttgaatgggtggcttttatctcctctgatggaattaataagaaatacggcgacttcgtcaagggccgctttacgatcagcagagataactccaaaaataccctgttcctccagatgaactctctgcgggccgaggacacagccctttattactgtgctaaggatgtgggggactataagagcgatgaatggggaaccgactactatgatctgtccattgagtacccgatccaagacccccgcgccgttgtgggcgcttttgataattgggggcagggaacaatggtcattgtgagctct

SEQ ID NO: 40273 - RNA, 432 nt, synthetic construct
  misc_feature 1..432: note = derived and/or modified sequence opt5 from anti-HIV_cap256-059-040554_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggggatcagcttcgctgccacaaataaatattacggaggctccgtgaagggcagatttacgatttctcgggacaatagcaaaaacaccctgtatctccaaatgaactccctgcgcgccgaggatacagctctttactattgtaccagagacatgcgggaatacgagtgcgaagagtgggccagcgattattacgacttcgggaaggatcagccgtgtcaggacccccgcggagttgtgggcacactggatatctgggggcagggaaccatggtcacagtgtcttcc

SEQ ID NO: 40274 - RNA, 432 nt, synthetic construct
  misc_feature 1..432: note = derived and/or modified sequence opt5 from anti-HIV_cap256-059-039660_VR-Chain
  source 1..432: mol_type = other RNA
caggtgcaactggtcgagagcggcgggggagttgtgcagcccggcagatccctccggctgtcttgcgccgctagccagttctccttttctaactacgggatgcactgggtgcgccaggcccctggaaagggccttgaatgggtcgcgagcatctccttcgctgggaccaaaaagaaatatgccgactctgtgaagggaagatttacaattagccgggataattccaaaaacacgctgttcctccaaatgaatagcctgcgcaccgaggacgccgctctttactattgtgccaaggatatgagagaatttgagtgcgaagagtgggcttctgactactatgatttcggccgggagcagccgtgtcaggacacacgcgatgttgtgggcatctttgacatttgggggcagggaaccatggtcacagtgtccagc

SEQ ID NO: 40275 - RNA, 435 nt, synthetic construct
  misc_feature 1..435: note = derived and/or modified sequence opt5 from anti-HIV_cap256-059-039298_VR-Chain
  source 1..435: mol_type = other RNA
caggtgcaactggtcgagagcggcgggggagttgtgcagcccggcagatccctccggctgtcttgcgccgctagcgggttcaccttttccaagtacggaatgcactgggtgcgccaggcccctggcaaagggcttgaatgggtcgcgttcgtggcttttgacgagtctgataagtattacgccgccagcgctaaaggaagattcatcatttcccgggacaactctaagaatacactgagcctccagatgaactccctgcgcacggaagataccgccgtttattactgtgctaaagaggtgggcgacaataaggatgacgaatggacaagcccgtattactatgatatctctattgcctaccccgtccaagaccctagagcggtggttggcgggtacgatgtgtggggacagggcaccatggtcacagtgtccagc

SEQ ID NO: 40276 - RNA, 432 nt, synthetic construct
  misc_feature 1..432: note = derived and/or modified sequence opt5 from anti-HIV_cap256-059-037873_VR-Chain
  source 1..432: mol_type = other RNA
caggtgcaactggtcgagagcggcgggggagttgtgcagcccggcagatccctccggctgtcttgcgccgctagccagttcaccttttccaactacgggatgcactgggtgcgccaggcccctggaaagggccttgaatgggtcgcggctatctctttcgccgggattaataaatattacgccgacagcgtgaagggaagatttacactgtcccgggataacacgaaaaataccctctatctgcaaatgaactctcttcgcgctgaggacacagccctgtactattgtgctagagatctccgggaatacgagtgcgaagagtgggccagcgactattacgatttcggccgcccgcagccctgtcaggaccctagaggcgttgtggggacctccgatatctggggacagggcacaatggtcaccgtgagctct

SEQ ID NO: 40277 - RNA, 432 nt, synthetic construct
  misc_feature 1..432: note = derived and/or modified sequence opt5 from anti-HIV_cap256-059-037633_VR-Chain
  source 1..432: mol_type = other RNA
caggtgcaactggtcgagagcggcgggggagttgtgcagcccggcagatccctccggctgtcttgcgccgctagccagttcaccttttccaacttcgggatgcactgggtgcgccaggcccctggaaagggccttgaatgggtcgcggctatctcttttgccgggattaataaaaactacgccgacagcgtgaagggaagattcacaatctcccgggataattctaaaaacacgctgcatctccaactgaatagccttcgcgctgaggacaccgccctgtattactgtgctaaggatctcagagaatatgagtgcgaagagtgggcctccgactactatgattttggccgggaccagccgtgtcaggatccccgcggcgttgtggggacattcgacatttggggacagggcaccatggtcacagtgagctct

SEQ ID NO: 40278 - RNA, 432 nt, synthetic construct
  misc_feature 1..432: note = derived and/or modified sequence opt5 from anti-HIV_cap256-059-036817_VR-Chain
  source 1..432: mol_type = other RNA
caggtgcaactgctcgagagcggcgggggagtcgttcagcccggcagatccctgcggctttcttgcgaagccagccagttcaccttttccaacttcgggatgcactgggtgcgccaggctcctggaaagggcctggagtgggtggccgcgatctcttttgctgggattaaaaagaattacgccgacagcgtcaaaggaagattcacaatctcccgggataactctaagaatacgctctatctgcaaatgaacagccttcgcgtggaagacaccgccctgtactattgtgctaaagatctcagagagtacgaatgcgaggagtgggcctccgactattacgattttggccgggaacagccgtgtcaggacccccgcggcgttattgggacattcgatatctggggacagggcaccatggtgacagtcagctct

SEQ ID NO: 40279 - RNA, 432 nt, synthetic construct
  misc_feature 1..432: note = derived and/or modified sequence opt5 from anti-HIV_cap256-059-032787_VR-Chain
  source 1..432: mol_type = other RNA
caggtgcaactggtcgagagcggcgggggagttgtgcagcccggcagatccctccggctgtcttgcgccgctagcgggttcaccttttccaagtacgccatgcactgggtgcgccaggcgcctggaaaaggccttgaatgggtcgctttcgtggcctttgacgagtctgataagtattacgttgacagcgtgaaagggagattcacaatctcccgggataactctaagaatacgctgagcctccagatgaactccctgcgcgccgaagacaccgctgtctattactgtgccaaagaggtgcatgttaataaggatgacgaatgggctagcgattattacgacctttctattgcctatccgatccaagatcccagagcggtggtcggaggcctggacatttggggccaggggacaatggtgaccgtgtccagc

SEQ ID NO: 40280 - RNA, 432 nt, synthetic construct
  misc_feature 1..432: note = derived and/or modified sequence opt5 from anti-HIV_cap256-059-032427_VR-Chain
  source 1..432: mol_type = other RNA
caggtgcaactggtcgagagcggcgggggagttgtgcagcccggcagatccctccggctgtcttgcgccgctagccagttcaccttttccaacttcgggatgcactgggtgcgccaggcccctggaaagggccttgaatgggtcgcggggatctcttttccgggaacgaaaaagtactatgctgacagcgtgaaaggcagattcacaatttcccgggataattctaagaacgccctgtacctccaaatgaatagcctgcgcgccgaggacaccgctctttattactgtgccagagatctgcgggaatatgagtgcgaagagtgggcttccgactactatgattttggcaaaccccagccttgtctcgacccccgcggggttgtgggaacattcgatatctggggccaggggaccatggtcacagtgagctct

SEQ ID NO: 40281 - RNA, 435 nt, synthetic construct
  misc_feature 1..435: note = derived and/or modified sequence opt5 from anti-HIV_cap256-059-029390_VR-Chain
  source 1..435: mol_type = other RNA
caggtgcaactggtcgagagcggcgggggagttgtgcagcccggcagatccctccggctgtcttgcgccgctagcgggttcacctttaaccagcacggaatgcattgggtgcgccaggcccctgacaagggccttgaatgggtcgcgttcgtggggtttgatgagtccgaaaaatactatgctgactctgttaagggaagattcacaatcagccgggataattccaaaaacacgctgtctctccaaatgaatagcctgcgcccggaggacaccgccgtgtactattgtgccaaggaagtcggcgataacaaagaggacgagtgggcttccgattactattacgaccttagcaatgcctatcccattcacgatcctagagctgtggttggcgggtacgacatctggggacagggcacaatggtgaccgtctgctct

SEQ ID NO: 40282 - RNA, 435 nt, synthetic construct
  misc_feature 1..435: note = derived and/or modified sequence opt5 from anti-HIV_cap256-059-027877_VR-Chain
  source 1..435: mol_type = other RNA
caggtgcaactggtcgagagcggcgggggagttgtgcagcccggcagatccctccggctgtcttgcagcgcctccgctttctcttttagctacttcgccatggactgggtgcgccaggcgcctgggaagggacttgaatgggtcgcttttgtgtcctctgatggcaacaataaaaactatgccgacagcgttaaggggagattcaccatctcccgggataatagcaaaaacacagtgtttctgcagatggactctctccgcccggaggatacggccgtctactattgtgctaaggacctgggaggcaataaagatgacgaatggtccaccaactactattacgatattagcatcgccgaccccgtgcctgatcccagagctgttgccggcgcgttcgacgtgtgggggcaaggaacaatggtcaccgtgtcttcc

SEQ ID NO: 40283 - RNA, 435 nt, synthetic construct
  misc_feature 1..435: note = derived and/or modified sequence opt5 from anti-HIV_cap256-059-026640_VR-Chain
  source 1..435: mol_type = other RNA
caggtgcaactggtcgagagcggcgggggagttgtgcagcccggcagatccctccggctgtcttgcgccgctagcgggttctccttttctaagtacggaatgcactgggtgcgccaggcccctggcaaagggcttgaatgggtcgcgttcgtggcttttgacgagagcgatagatattacgccgcctccgttaagggacggttcaccatctctcgcgacaacagcaaaaatacactgtccctccagatgaacagcctgagaacggaagataccgctatttattactgtgccaaggaggtgggcgacaataaagatgacgaatggacatctccgtattactatgatatgtccatcgcttaccccgtccaagaccctcgggccgtggttggcgggtacgatatttggggacagggcaccatggtgacagtcagctct

SEQ ID NO: 40284 - RNA, 432 nt, synthetic construct
  misc_feature 1..432: note = derived and/or modified sequence opt5 from anti-HIV_cap256-059-026017_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgggacgaacaaatactatgtggatagcgccaagggaagattcaccatttcccgggacaattctaaaaacacactctacctgcagatgaatagccttaccccggaggatacagccgtgttttattgtgctaaggacctgggcggctacaaagatgacgaatgggggaccgagtattacgatatctccgttagctaccccgtccaagaccctcgcgccgtggctggagttttcgatgtgtggggccatgggacaatggtcaccgtgtcttcc

SEQ ID NO: 40285 - RNA, 432 nt, synthetic construct
  misc_feature 1..432: note = derived and/or modified sequence opt5 from anti-HIV_cap256-059-024100_VR-Chain
  source 1..432: mol_type = other RNA
tgccaggtgctggtcgagagcggcgggggagttgtgcaacccggcagatccctccggctgtcttgtgccgctagccagttcaccttttcctcttacgggatgcactgggtgcgccaggcccctggaaagggccttgaatgggtcgcggctatcagcttcgccgggacgaaaaagtattacgccgactccgtgaaaggaagatttgctatttctcgggatacaagcaagaacgccctgtatctccagatgaataccctgcgcgctgaggacacagccctttactattgcgcgagagatctgcgggagttcgaatgtgaagagtgggcctccgactactatgattttggccgcccgcaaccctgccaggaccctagaggcgttgtggggagcttcgatatctggggacagggcaccatggtcacagtgtctctc

SEQ ID NO: 40286 - RNA, 432 nt, synthetic construct
  misc_feature 1..432: note = derived and/or modified sequence opt5 from anti-HIV_cap256-059-023966_VR-Chain
  source 1..432: mol_type = other RNA
caggtgcaactggtcgagagcggcgggggagttgtgcagcccggcagatccctccggctgtcttgcgccgctagccagttctccttttctagctacgggatgcactgggtgcgccaggcccctggaaagggccttgaatgggtcgcggctatctccttcgccgggattaaaaagcattataccgactctgtgaaaggaagatttacaatcagccgggataactccaagaatacgctgtacctccaaatgaacagcctgcgcgccgaggacaccgctctttattactgtgccaaagatctgagaggcttcgaatgcgaggaatgggcttctgactattacgattttggccgggaccagccgtgtcaggatccccgcggggttgtgggaacattcgacatttggggccaggggaccctcgtcacagtgtccagc

SEQ ID NO: 40287 - RNA, 432 nt, synthetic construct
  misc_feature 1..432: note = derived and/or modified sequence opt5 from anti-HIV_cap256-059-020534_VR-Chain
  source 1..432: mol_type = other RNA
caggtgcaactggtcgagagcggcgggggagttgtgcagcccggcagatccctccggctgtcttgcgccgctagccagttcaccttttccaactacgggatgcactgggtgcgccaggcccctggaaagggccttgaatgggtcgcggggatgtctttcgctggaacaaatacgtattacgccgacagcgtgaaaggcagatttaccatctcccgggataactctaagaatacactgtatctccaaatgaacagcctgcgcgccgttgacaccgctctttactattgtgccagagatatgcgggagtacgaatgcgaggaatgggcttccgactattacgatttcggccgcgagtacccgtgtcaggaccccagaggggtggtcggaatttttgatctgtggggccaggggacaatggtgaccgttagctct

SEQ ID NO: 40288 - RNA, 435 nt, synthetic construct
  misc_feature 1..435: note = derived and/or modified sequence opt5 from anti-HIV_cap256-059-019513_VR-Chain
  source 1..435: mol_type = other RNA
caggtgcaactggtcgagagcggcgggggagttgtgcagcccggcagatccctgcggctgtcttgcgccgctagcgggttcaccttttccaacttcgccatgggatgggtgcgccaggcgcctggcaaggggcttgaatgggtcgctgtgatctctagcgacggaacaaataaaaactacggcgattccgttaagggcagatttacgatttctcgggacaatagcaaaaacaccctgttcctccagatgaactccctgcgcgccgaggatacaagcctttattactgtgccaaggacctcgggggatataaaaccgatgaatgggctacaaattactattacgacatctctattgcctccccgatccaagatcccagagctgtggtcggcgcctttgacatttgggggcagggaaccatggtgacagttaccagc

SEQ ID NO: 40289 - RNA, 432 nt, synthetic construct
  misc_feature 1..432: note = derived and/or modified sequence opt5 from anti-HIV_cap256-059-012963_VR-Chain
  source 1..432: mol_type = other RNA
caggtgcaactggtcgagagcggcgggggagttgtgcagcccggcagatccctccggctgtcttgcgtggccagcgggttctccttttctagctacggaatggcttgggtccgccaggcccctggcaaggggcttgaatgggtgaccgttatctccttcgcgggagtgaaaacatattacgctgactctgtcaagggcagatttacgattagccgggataactccaaaggcaccctgtatctccagatggacgggctgcgcccggaggatacagccctttactattgtgccaaggacctggctgaaagagagtgcgaagagtgggccagcgattactatgacttcggacgggagctcccctgtcaagatcctcgcggcgtggttgggacctttgacgtgtggggacagggcacaatggtcaccgtgtcttcc

SEQ ID NO: 40290 - RNA, 435 nt, synthetic construct
  misc_feature 1..435: note = derived and/or modified sequence opt5 from anti-HIV_cap256-059-010396_VR-Chain
  source 1..435: mol_type = other RNA
caggtgcaactggtcgagagcggcgggggagttgtgcagcccggcagatccctccggctgtcttgcgccgctagcgggttctcctttaacaattacgccatgaactgggtgcgccaggcgcctggaaagggccttgaatgggtcgctttcgtgtctagcgacgggtccaataaaaactatgccgattctgttaccggaagatttacactgagccgggacaattccaagaacacggtgttcctccagatgaatagcctgcgcgtcgaggataccgccgtgtactattgtgctaaagacgttggcgccaacaaggatgacgaatggacaaccaattactattacgatatctctattgctgacccggtgcccgatcctagagccgtcatcggcgcgtttgacgtgtgggggcaaggaacaatggtgaccgtctccagc

SEQ ID NO: 40291 - RNA, 432 nt, synthetic construct
  misc_feature 1..432: note = derived and/or modified sequence opt5 from anti-HIV_cap256-059-008136_VR-Chain
  source 1..432: mol_type = other RNA
caggtgcaactggtcgagagcggcgggggagttgtgcagcccggcagatccctccggctgtcttgcgccgctagcgggttcacctttaatacatacgccatgcactgggtgcgccaggcgcctggaaagggccttgaatgggtcgctctgatctcctatgacgggacggagaaatactatgccgattctgtgaagggaagattcaccattagccgggacaattcccgcaacacactctacctgcagatgaactctcttagactggaagatgccgctctctatcaatgtgccaaagacctgggcggcagcaagtccgatgagtgggggaccgactactatgatatgagcatctcttacccgattcaggacccccgggctgttgccggagtgtttgatatctggggccaggggacactggtcaccgtgtccagc

SEQ ID NO: 40292 - RNA, 432 nt, synthetic construct
  misc_feature 1..432: note = derived and/or modified sequence opt5 from anti-HIV_cap256-059-006147_VR-Chain
  source 1..432: mol_type = other RNA
caggtgcaagtcgttgagagcggcgggggagtggtgcagcccggcagatccctgcggctctcttgcaccgccagcgggttcacattttccaacttcgctatgggatgggtccgccaggcccctggcaaggggctggaatgggtggcgtttatctctagcgacggatccaataaaaactacggcgattctgttaagggcagattcacgattagccgggacaattccaaaaacaccgtgtttcttcagatgaatagcctgcgcgtcgaggatacagctctctattactgtgccaaggacgtgggggattataaatctgacgaatggggaaccgagtactatgatatctccattagctacccgatccaagaccccagagccatggttggcgctttcgatctgtgggggcagggaacaatggtgaccgtctctcct

SEQ ID NO: 40293 - RNA, 432 nt, synthetic construct
  misc_feature 1..432: note = derived and/or modified sequence opt5 from anti-HIV_cap256-059-005081_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggggatcagcttcgctgccacgaaaaagtattactccgagtctgtgaaaggaagatttacaattagccgggacaactccaagaatgccctgcatctccacatgaacagcctgcgcgctgaagataccgccctttattactgtgctaaagacctgagagagttcgaatgcgaggagtgggcctctgattattacgactttggccgggatcaaccgtgtcaggacccccgcggcgttgtggggatcttcgatatgtggggacagggcacaatggtcaccgtgtccagc

SEQ ID NO: 40294 - RNA, 432 nt, synthetic construct
  misc_feature 1..432: note = derived and/or modified sequence opt5 from anti-HIV_cap256-059-005006_VR-Chain
  source 1..432: mol_type = other RNA
caggcccaactggtggagagcggcgggggagtcgttcagcccgctaagtccctcagactgtcttgcgccgcgagcggcttcacctttaacaaatacgctatgcactgggtgcggcaggcccctgggaagggacttgaatgggtggccttcgtcgcttttgacgagtccgataaatattacgccgactctgtgaagggccgcttcacaatcagcagagataattccaaaaacacgctgtctctccagatgaataacctgcgggctgaagacaccgccgtttattactgtgcgaaggaggtgggggataataaggacgatgaatgggccagcgactattacgatctttccattgcttatccgatccaagacccccgcgccgtcggaagaggctacgatatttggggccaggggacaatggtgaccgttagctct

SEQ ID NO: 40295 - RNA, 432 nt, synthetic construct
  misc_feature 1..432: note = derived and/or modified sequence opt5 from anti-HIV_cap256-059-004451_VR-Chain
  source 1..432: mol_type = other RNA
caggtgcacctggtcgagagcggcgggggagttgtgcaacccggcaagtccctcagactgtcttgcaccgccagcgggttcacatttacgaacttcgctatggactgggtgcggcaggcccctggaaaaggccttgaatgggtcgcgtttatctcctctgatgggagcaataagtactattccgagtctgtgaaaggacgcttcaccattagcagagacaactccaagaatacactgtacgttcagatgaacagcctccggaccgaagatacagctgtgtattactgtgccaaagacctgggcggctataaggatgacgagtggtctaccgattactatgactggtccacagcctacccggtccaggatccccgcgctgtggccggggcttttgacctttggggacaaggcaccatggttagcgtgtcttcc

SEQ ID NO: 40296 - RNA, 432 nt, synthetic construct
  misc_feature 1..432: note = derived and/or modified sequence opt5 from anti-HIV_cap256-059-003571_VR-Chain
  source 1..432: mol_type = other RNA
caggagcaactggtggaaagcggcgggggagtcgttcagcccggcagatccctccggctgtcttgcgccgctagccagttcacctttggggcctacggaatgcactgggtgcgccaggcgcctggcaaggggcttgagtgggtggctggagtctccttcgtgggcaacaataaatattacgccgactctgttaagggcagatttacaatcagccgggataactccaaaaatacgctgtatctccaaatgaactctctgcgcggggaagacaccgccctttactattgtgctagagatatgcgggagatggaatgcgaggagtgggccagcgactactatgatttcggacgcccgcagccctgtcaggaccctagaggcgtggtcgggatttttgatatgtggggacagggcacaatggtgaccgtttccagc

SEQ ID NO: 40297 - RNA, 432 nt, synthetic construct
  misc_feature 1..432: note = derived and/or modified sequence opt5 from anti-HIV_cap256-059-003449_VR-Chain
  source 1..432: mol_type = other RNA
caggtgcaactggtcgagagcggcgggggagttgtgcagcccggcaagtccctcagactgtcttgcgccgctagccaggtgaccttctcctcttacgggatgcactgggtccggcaggcccctggaaaaggccttgaatgggtggcggggatcagctttgctggaacaaagaaatattacgccgactccgttaagggccgcttcacgatttctagagataacagcaaaaatgccctgtatctccaaatgaaccggctgcgcgctggcgacaccgccctttactattgtgctaaggatctgagagagtacgaatgcgaggaatgggcctccgactattacgattttgggcgggagcagccgtgtcaggacccccgcggagtggtcggcatcttcgatatttgggggctcggaacaatggtgaccgttagctct

SEQ ID NO: 40298 - RNA, 432 nt, synthetic construct
  misc_feature 1..432: note = derived and/or modified sequence opt5 from anti-HIV_cap256-059-002712_VR-Chain
  source 1..432: mol_type = other RNA
caggtgcaactggccgagagcggcgggggagtcgttcagcccggcagatccctccggctgtcttgcgctgccagccagttcaccttttcctcttacgggatgcactgggtgcgccaggcgcctggaaagggccttgaatgggtggctgccatcagcttcgccgggacgaaaaagcattatgctgactccgtcaaaggaagatttacaatttctcgggataatagcaagaataccctgaacctccaaatgaactccctgcgcgccgaggacacagctctttactattgtgccagagatatgcgggaatacgagtgcgaagtgtgggcgagcgactattacgatttcggccgcgagcagccgtgtcaggaccccagaggcgttgtggggacctttgatatctggggacagggcacaatggtcaccgtgtctcct

SEQ ID NO: 40299 - RNA, 432 nt, synthetic construct
  misc_feature 1..432: note = derived and/or modified sequence opt5 from anti-HIV_cap256-059-001573_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggggatcagctatgacggaacatccaaatactatgctgattctgtgaagggcagattcacgattagccgggacaactccaaaaataccctgtacctccaaatgaacagcctgcgcgccgaggatacagccctttattactgtgctaaggacctgagagaagatgagtgcgaagagtggtggtctgactattacgattttggccgggagctcccgtgtcgcaaatccagaggggttgccggaaccttcgacatctggggccatgggacaatggtgaccgtcagctct

SEQ ID NO: 40300 - RNA, 432 nt, synthetic construct
  misc_feature 1..432: note = derived and/or modified sequence opt5 from anti-HIV_cap256-059-001379_VR-Chain
  source 1..432: mol_type = other RNA
caggtgagactggtcgagagcggcgggggagttgtgcaacccggccggtccctccgcctgtcttgcgccgctagcgggttcacctttaactcctaccctatgcactgggtgagacaggccccgggaaagggccttgactgggtcgcgctgatctcttatgatgggacaaataaattctacgtggacagcgttaagggacggtttacgatttcccgcgataactctaaaaataccctctatctgcagatgaacagccttacagctgaagacaccgccatgtactattgtgccaaggatctgggcggcaataaagacgatgagtgggggacagactactatgatatctccgtggcttaccccattcatgaccctagagccgtcgctggaatcttcgatgtgtggggccacgggaccatggttacagtgagctct

SEQ ID NO: 40301 - RNA, 432 nt, synthetic construct
  misc_feature 1..432: note = derived and/or modified sequence opt5 from anti-HIV_cap256-059-001029_VR-Chain
  source 1..432: mol_type = other RNA
caggagcaactggtgcagagcggcgggggagtcgttcagcccggcagatccctccggctgtcttgcgcccctagccagttcaccttttccgctcacgggatgcattgggtgcgccaagccccgggaaagggccttgaatgggtggcggggatctctttcgctggaacgaaaaactactatgccgacagcgtcaagggcagatttacaatttcccgggataattctaaaaacaccctgtacctccagatgaatagcctgcgcgtggaggacacagccctttattactgtgctaaggatatgagagaaatggagtgcgaagagtgggcctccgactattacgatttcggccggcaccagccctgtcaggaccctcgcggggttgtgggaatctttgatatttggggccaagggaccatggtcacagtgagctct

SEQ ID NO: 40302 - RNA, 432 nt, synthetic construct
  misc_feature 1..432: note = derived and/or modified sequence opt5 from anti-HIV_cap256-048-165087_VR-Chain
  source 1..432: mol_type = other RNA
gaggtgaagctgctcgaaagcggcgggggactggtccagcccggcgggtacagacggctttcctgcgccgcttctggattcacctttagccgctatgccatgcactgggcgagacaagctcctggcaaagggctggagtgggttgccgtggtgtccgacgatggagtcaagaaatactatccggactctgtgcggggccgcttcacaatcagcagagataactcccggaatacggtttctctccagatgaacagcctgcgccccgaagacaccgccgtgtactattgtgctaaggatgtcggcgccaataaagacgatgagtgggctacagactactatgatctttccattgcctaccctgtgcccgaccctagagcggttgtgggggcctttgatatctggggacagggcaccatggtcacagtgagctct

SEQ ID NO: 40303 - RNA, 432 nt, synthetic construct
  misc_feature 1..432: note = derived and/or modified sequence opt5 from anti-HIV_cap256-048-158861_VR-Chain
  source 1..432: mol_type = other RNA
gaggtgcagctggtcgaaagcggcgggggactcgttcaacccggcgggtccctgcggctttcttgcgtggacttcggatttcggttcagcgagtactggatgtcctgggtgcgccaggcccctggcaaggggctggaatgggtcgctgtgatctcttatgatggaaccaacaaatactatgccgacagcgttaagggcagatttacaatttcccgggataattctaaaaacacgctctacctgcagatgaatagccttcgcgcggaggacaccgctctgtattactgtgccaaggatatgagagaatccgagtgcgaggaatgggccagcgactattacgatttcggcaaagactacccgtgtcaggatcccagaggggtggtcggaacatttgacatctggggccaagggaccatggtgacagtttcttcc

SEQ ID NO: 40304 - RNA, 435 nt, synthetic construct
  misc_feature 1..435: note = derived and/or modified sequence opt5 from anti-HIV_cap256-048-158280_VR-Chain
  source 1..435: mol_type = other RNA
caggtgcacctggtcgagagcggcgggggagttgtgcaacccggcagatccctccggatctactgcgccgtgtctgagttcacctttcgcaactatgctatgcattgggtcagactggcccctgggaagggacttcagtgggtggcggttattagccacgacggcatcaatgattactatgctgactccgtgaaagggcggttcacaatttctcgcgataacagcaagaatacggtctccctgcagatgaactctctcagaccggaagacaccgccgtgtactattgtgccaaagatctgggagctaataaggacgatgaatgggccacagactactatgatcttagcatcgcttaccccgttcctgaccccaccggcccttggtttggcgccttcgatatttgggggcagggaacaatggtgaccgtctccagc

SEQ ID NO: 40305 - RNA, 432 nt, synthetic construct
  misc_feature 1..432: note = derived and/or modified sequence opt5 from anti-HIV_cap256-048-157928_VR-Chain
  source 1..432: mol_type = other RNA
caggtgcaactgatggagagcggcgggggagtcgttcagcccggcagatccctccggctgtcttgcgccatcagcgggttcaccttttccaactactggatgtcttgggtgcgccaggctcctggaaagggccttgaatgggtggccgtcattagctccgacgggtctagcaaaaattatgcggattccgtgaagggaagattcacaatcagccgggacaactctaaaaatacggtttccctgcagatgaacagcctccgcccggaggataccgctgtgtactattgtgccaaggacgtcggcgccaataaagatgacgaatgggctacagattactatgacctgtctattgcctaccccgtgcctgatcccagagctgttgtgggcgcctttgacatctgggggcaaggaaccatggtcacagtgtccagc

SEQ ID NO: 40306 - RNA, 432 nt, synthetic construct
  misc_feature 1..432: note = derived and/or modified sequence opt5 from anti-HIV_cap256-048-157056_VR-Chain
  source 1..432: mol_type = other RNA
caggtgcaactggtcgagagcggcgggggagttgtgcagcccggcagatccctccggctgtcttgcgccgctagcgggttcaccctttcctcttacgccatgcactgggtgcgccaggcgcctggaaagggcctggaatgggtcgcttttatcagcaacgacgggtccaataaatatttcgccgattctgtgaagggaagatttacaattagccgggacaactccaaaaatacgctctacctgcagatgaacagccttcgcgccgaggataccgctgtttattactgtgccaaggacctgggcggcaataaagatgacgaatgggctacagattattacgacctctctatcgcctatccggtgcaagatcccagagtcgtggttgggattttcgacatctggggacagggcaccatggtgacagtctccagc

SEQ ID NO: 40307 - RNA, 432 nt, synthetic construct
  misc_feature 1..432: note = derived and/or modified sequence opt5 from anti-HIV_cap256-048-156422_VR-Chain
  source 1..432: mol_type = other RNA
caggtgcaactggtcgagagcggcgggaccgttgtgcagcccggaagatccctccggctgtcttgcgtgggcagcgggttctccctttcttactatgccatccactgggtccgccaggctcctggaaagggcctggaatgggtggccgttattagctacgacgggtccaactattactatgcggattctgtgaaaggaagatttacaatcagccgggacaattccaagaacacggtctacctccagatgaatagcctgcgcggcgtggataccgctgtttattactgtgccaaagaccttggcgggggagaggtggaagagtgggccacagattactatgactggtctattgcttacccggtcgaacatcccagagccgtggtgggcgtcttcgatatctgggggcaaggaaccaaggttacagtgtccagc

SEQ ID NO: 40308 - RNA, 432 nt, synthetic construct
  misc_feature 1..432: note = derived and/or modified sequence opt5 from anti-HIV_cap256-048-152863_VR-Chain
  source 1..432: mol_type = other RNA
gaggtgcagctgctcgaaagcggcgggggactggtccaacccggcgggtcccttagactgtcttgcgccggaagcggcttcaccttttccaagcacgggatgcattgggttcggcaggctcctggaaaaggcctcgagtgggtggccttcgtggcgtttgacgaatctgataagtactatgctgacagcgtcaaaggccgcttcacaatctccagagataactctaagaatacgctgagccttcagatgaactccctgcgggccgaggacaccgccatgtactattgtgctaaagaagtgggggataataaggacgatgagtgggccagcgactactatgatctctctattgcttacccggttcacgacccccgcgccgtggtcggaggctatgatatctgggggcagggaacaatggtgaccgtttccagc

SEQ ID NO: 40309 - RNA, 432 nt, synthetic construct
  misc_feature 1..432: note = derived and/or modified sequence opt5 from anti-HIV_cap256-048-152770_VR-Chain
  source 1..432: mol_type = other RNA
caggtgcaactggtcgagagcggcgggggagttgtgcagcccggcagatccctccggctgtcttgcgccgctagcgggttcacctttcgctccaatgccatgcactgggtgagacaggcgcctggaaagggccttgaatgggtcgctgtgatctcttacgacgggagcaaaacatattacgccgattccgttaagggacggttcacgatttctcgcgacaatagcaaaaacaccctgtatctccagatgaactccctgagagccgaggatacagctgtgtactattgtgccaaggaccttggcgaatacaaaagcgatgagtgggctaccgactattacgatctgtctatcgcctacccggtccaagacccccggggcgtggcgggggcctttgatatttggggacagggcacaatggttaccgtgtccagc

SEQ ID NO: 40310 - RNA, 432 nt, synthetic construct
  misc_feature 1..432: note = derived and/or modified sequence opt5 from anti-HIV_cap256-048-150027_VR-Chain
  source 1..432: mol_type = other RNA
gaggtgcagctggtcgaaagcggcgggggactcgttcaacccggcgggtccctgcggctttcttgcgccgtgagcggattcaccttttcctcttacatcatgcactgggtgcggcaggctcctggcaaggggctggagtgggtcgccgtgattagctatgacggatccaacaaagattacgcggactctgttaagggccgcttcacaatcagcagagataattccaaaaacacgctctatctgcagatgaatagccttcgggctgaagacaccgccctgtactattgtgccaaggatctccgcgagtacgaatgcgaggagtgggcttctgactattacgattttggcagagactacccgtgtcaggatcccagaggggtggtcggaacattcgacatttggggccaagggaccatggtgacagtttccagc

SEQ ID NO: 40311 - RNA, 432 nt, synthetic construct
  misc_feature 1..432: note = derived and/or modified sequence opt5 from anti-HIV_cap256-048-148246_VR-Chain
  source 1..432: mol_type = other RNA
caggtgcaactggtcgagagcggcgggggagttgtgcagcccggcagatccctccggctgtcttgcgccaccagcgggttcacattttccacgtactctatgcactgggtgcgccaggctcctggaaagggccttgaatgggtcgccgtgatcagctatgacgggtccaacgagtactatgttgattctgtgaaaggaagattcaccattagccgggacaattccaagaacacactgtacctccagatgaatagcctgcgcgtcgaagataccgcgctttattactgtgctaaagacctgggcggcaacaaggatgacgagtgggggacagattattacgacttttctgtggcctacccggttcaagatcccagagccgtgtccggaatcttcgacgtctggggccatgggaccatggtgacagtgagctct

SEQ ID NO: 40312 - RNA, 432 nt, synthetic construct
  misc_feature 1..432: note = derived and/or modified sequence opt5 from anti-HIV_cap256-048-147428_VR-Chain
  source 1..432: mol_type = other RNA
caggtgcaactggtcgagagcggcgggggagttgtgcagcccggcagatccctccggctgtcttgcagcgcctccgggttcaccttttctaactacggaatgcactgggtgcgccaggctcctggcaaggggcttgaatgggtcgccgtgatcagcttcgacggatccaataaagtttatgcggattctgtgaagggcagatttacaattagccgggacaactccaaaaatacgctgtacctcgagatgaacagcctgcgcgctgaagataccgccgagtattactgtgccaaggaccttggcgaatctgataaagaggagtggccgtccgactattacgatttcgggagagactttacaggacaggtcccccgggctgtggttggcatcttcgatatgtgggggcaaggaaccatggtgacagtcagctct

SEQ ID NO: 40313 - RNA, 432 nt, synthetic construct
  misc_feature 1..432: note = derived and/or modified sequence opt5 from anti-HIV_cap256-048-146603_VR-Chain
  source 1..432: mol_type = other RNA
gaggtgcagctggtcgaaagcggcgggggactcgttcaacccggcagatccctgcggctttcttgcgccgctagcgggttcacctttgacgattacgccatccactgggtgcgccaggcgcctggaaagggcctggagtgggtggctctcatttcctatgacgggacagataaatactatgccgactctgtcaagggaagattcacgatcagccgggataactccaaaaataccctgtaccttcagatgaactctctgcgcgtggaagacacagccgtttatcattgtgctaaggatctcggcggcaccaaaagcgacgagtgggccacagattactatgacctgtccattgcttacccgatccaggatcccggggccgtggtcggagtgtttgacatttggggccaagggaccatggttacagtgagctct

SEQ ID NO: 40314 - RNA, 432 nt, synthetic construct
  misc_feature 1..432: note = derived and/or modified sequence opt5 from anti-HIV_cap256-048-145735_VR-Chain
  source 1..432: mol_type = other RNA
caggtgcaactggtccagagcggcgggggagttgtgcagcccggcagatccctccggctgtcttgcggggccagcggattcaccttttccaactacgctatgcactgggtgcgccaggcccctggcaaggggcttgactgggtcgcggtgatctcttatgatggaacaaatgagaaccatgctgacagcgttaaaggcagattcacgatttcccgggataattctaagaacaccgtgtacctgcaaatgaatagcctccgcgccgaagacacagccgtctattactgtgctaaagatgtgggcgggtccaaggacgatgagtgggccaccgactattacgatctgagcatcgcttatccggttcccgaccctagagccgtggtcggagcgtttgatatttggggccaggggacaatggtgaccgtgtcttcc

SEQ ID NO: 40315 - RNA, 432 nt, synthetic construct
  misc_feature 1..432: note = derived and/or modified sequence opt5 from anti-HIV_cap256-048-145116_VR-Chain
  source 1..432: mol_type = other RNA
caggtgcacctggtcgagagcggcgggggagttgtgcaacccggcgggtccctcagactgtcttgcgccgctagcggattcaccttttccaactacggcatgcattgggtgcggcaggcccctgggaagggacttgaatgggtcgcggctatctctttcgccggcacaaataaatattacgccgacagcgtgaagggccgctttacgatttccagagataactctaaaaatgctctgtatctccagatgaacagcctgcgggccgaggacaccgctctttactattgtgccaaggatctgcgcgaatccgagtgcgaagagtgggcgagcgactactatgatttcgggagagactacccgtgtcaggatccccggggagttgtgggcacactcgacatctgggggcaaggaaccatggtcacagtgtcttcc

SEQ ID NO: 40316 - RNA, 432 nt, synthetic construct
  misc_feature 1..432: note = derived and/or modified sequence opt5 from anti-HIV_cap256-048-144077_VR-Chain
  source 1..432: mol_type = other RNA
caggtgaagctggtcgagagcggcgggggagttgtgcaacccggcagatccctccggctgtcttgcgccgctagcgggttcaccctttcctcttacgccatgcactgggtgcgccaggcgcctggaaaaggcctggaatgggtcgctgtgatcagctatgacgggtccaacagatacacagccgattctgttaagggacggtttacgattagccgcgacaattccaaaaacaccctcaatctgcagatgaacagccttagaccggaggatacagccgtgtattactgtgctaaggacgtcggcgccaataaagatgacgaatgggctaccgattattacgacctgtctatcgcctatcccgtgcctgatccccgggcggttgtgggcgccttcgacatttgggggcagggaacaaccgtcacagtgtccagc

SEQ ID NO: 40317 - RNA, 432 nt, synthetic construct
  misc_feature 1..432: note = derived and/or modified sequence opt5 from anti-HIV_cap256-048-142876_VR-Chain
  source 1..432: mol_type = other RNA
caggtgcaactggtcgagagcggcgggggagttgtgcagcccggcgggtccctcagactgtcttgcgtggccagcggattcaccttttccacatacggcatgcactgggtccggcaggctcctgggaagggacttgaatgggtggccttcatgcgctttgacggctctaacagatattacggcgatagcgttaaagggcggttcacgatctcccgcgacaattctaagaacaccctgtatctccagatgattagcctgagagcggaggatacagctgtgtaccattgtgccaaagaccttggaggcaataagccggatgaatgggccaccgactattacgatctgtccatcgcttatcccgtccaagaccctcgggccgtggttggggtgtttgatatttggggacagggcacaatcattaccgtcagctct

SEQ ID NO: 40318 - RNA, 432 nt, synthetic construct
  misc_feature 1..432: note = derived and/or modified sequence opt5 from anti-HIV_cap256-048-140582_VR-Chain
  source 1..432: mol_type = other RNA
caggtgcaactggtcgagagcggcgggggagttgtgcagcccggcagatccctccggctgtcttgcgccgctagcgggttctccttttctaactacgccatggactgggtgcgccaggcgcctggaaagggccttgaatgggtcgctttcgtgagctccgatgggtctaataaaaactatgccgacagcgttaagggaagatttaccatctcccgggataatagcaaaaacacagtgtacctgcagatgaactctctccgcgtcgaggacacggccgtgtattactgtgctaaggatctgggcgccaataaagacgatgaatgggctaccgactattacgatctttccgttgcctatccggtgcccgaccctagagcggtcgtgggcgccttcgatgtgtgggggcaaggaacaatggtcaccgttagctct

SEQ ID NO: 40319 - RNA, 432 nt, synthetic construct
  misc_feature 1..432: note = derived and/or modified sequence opt5 from anti-HIV_cap256-048-139355_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctatcattagctatgacgggtccaacaaatactatgccgattctgtgaagggaagattcacaatcagccgggacaattccaaaggcacgctgtacctccagatggatggcccgcgccccgaggacaccgccctgtattactgtgctaaggatcttggggaaagagagtgcgaagagtgggccagcgactattacgattttggacgggacttcccttgtcaagatccccgcggcgttgtggggacatttgacatttggggacagggcaccatggtcacagtgtcttcc

SEQ ID NO: 40320 - RNA, 432 nt, synthetic construct
  misc_feature 1..432: note = derived and/or modified sequence opt5 from anti-HIV_cap256-048-139151_VR-Chain
  source 1..432: mol_type = other RNA
caggtgcaactggtcgagagcggcgggggagttgtgcagcccggcaagtccctcagactgtcttgcgccgctagcgggttcacctttaacacatacggaatgcactgggtgcggcaggcccctggcaaagggcttgaatgggtcgcggtgatctcctatgacggatctattcagaagtacgctgatagcgttaaaggccgcttcacgatctccagagacaattctaagaacaccctgtatctccaaatgaatagcctgtccgtggaggatacagccgtctactattgtgccaaagaccttggcaagaacaaggatgacgaatgggctaccgattactatgacattagcatcgcctacccggtgcccgatcctcgggctgttgtgggggtctttgacatttggggacagggcacagtggtgaccgtctcttcc

SEQ ID NO: 40321 - RNA, 432 nt, synthetic construct
  misc_feature 1..432: note = derived and/or modified sequence opt5 from anti-HIV_cap256-048-137672_VR-Chain
  source 1..432: mol_type = other RNA
gaggtgcagctggtcgaaagcggcgggggagttgccagacccggcgggtccctccggctgtcttgcgctgccagcggattcatctttacccactacgcgatggactgggtgcgccaagctcctggcaaggggcttgagtgggtggccgtcatttcctctgatggaagctccaaaaactatgccgactctgtgaagggcagattcacaatcagccgggataattccaaaaacacggttagcctgcagatgaactctctccgcccggaagacaccgctgtgtactattgtgccaaggatgtcggcgctaataaagacgatgagtgggccacagactactatgatctgtccattgcgtaccccgtgcctgaccccagagccgttgtgggggcttttgatatctggggacagggcaccatggtcacagtgagctct

SEQ ID NO: 40322 - RNA, 432 nt, synthetic construct
  misc_feature 1..432: note = derived and/or modified sequence opt5 from anti-HIV_cap256-048-137506_VR-Chain
  source 1..432: mol_type = other RNA
caggtgagactggtcgacagcggcgggggagttgtgcaacccggcgggtccctccggctgtcttgcgccgctagcggattcaccttttccacatacggcatgcactgggtgcgccaggcccctgggaagggacttgagtgggtcgcgttcatcagatctgatggcagcaacaaatattacgctgactccgtgcagggccggttttctattagccgcgataattccaagaacacgctgtatctccagatgaatagcctgagagccgaagacaccgccgtttactattgtgctaaagatcttggggagtctgacaaggaagagtggccgtccgattactatgacttcggacgggattttacaggccaagacccccgcgccgtggtcggggtgttcgatatctggggacagggcaccacagttattgtgagctct

SEQ ID NO: 40323 - RNA, 432 nt, synthetic construct
  misc_feature 1..432: note = derived and/or modified sequence opt5 from anti-HIV_cap256-048-137270_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatgagcccggacgggtccaacagatattacacagattctgttaaaggacggttcacgatcagccgcgacaattccaagaacaccctgagcctccagatgaactctctgagacccgaggatacagccgtgtattactgtgccaaagacgtcggcgctaataaggatgacgaatgggccaccgattattacgacctttccattgcttatcctgtgcccgatcctcgggccgttgtgggcgcgtttgacatctgggggcaaggaacaatggtcaccgtgagctct

SEQ ID NO: 40324 - RNA, 432 nt, synthetic construct
  misc_feature 1..432: note = derived and/or modified sequence opt5 from anti-HIV_cap256-048-135447_VR-Chain
  source 1..432: mol_type = other RNA
gaggtgcagctggtcgaaagcggcggggccgttgtgcaacccggaagatccctccggctgtcttgcaccgctagcggcttctcctttacatcttacacgatccactgggtgcgccaggcccctgggaagggacttgagtgggtcgcgttcattagctatgacggcaccgagaaaaagtacacagattccgtgaaagggagatttaccatctctcgggacaacagcaagaatacactgtccctccagatgaacagcctgcgcccggaagataccgctgtttattactgtgccaaagaccttggagcctctaaggatgacgaatgggctacagattattacgacttctccattgcctatcccgtgcaggatcctagagctgtcgtgggcgcctttgacatctggggccaagggaccatggttacggtgagctct

SEQ ID NO: 40325 - RNA, 432 nt, synthetic construct
  misc_feature 1..432: note = derived and/or modified sequence opt5 from anti-HIV_cap256-048-131966_VR-Chain
  source 1..432: mol_type = other RNA
caggagcaactggtggaaagcggcgggggagtcgttcagcccggcagatccctccggctgtcttgcgccgctagcgggttcaccttttccaattacgccatgcactgggtgcgccaggcgcctggaaagggccttgagtgggtggctgccatgtctcatgacgggagcgataaatattacgccgactccgtcaagggaagattcacaatctctcgggataatagcaaaaacacgctgtatatgcagatgaactccctccgcgctgaagacaccgccgtgtactattgtgctaaggatcaaggcgagagcgaaaaagaggagtgggcctctgactactatgattttggcagagactacccggggcaggatccccggcgcgttgtggcgacattcgccatttggggacagggcaccatggtcacagtgtccagc

SEQ ID NO: 40326 - RNA, 432 nt, synthetic construct
  misc_feature 1..432: note = derived and/or modified sequence opt5 from anti-HIV_cap256-048-131008_VR-Chain
  source 1..432: mol_type = other RNA
gaggtgagactggtcgaaagcggcgggggactcgttaagcccggcgggtccctgcggctttcttgcgccgctagcggattcaccgtgtcctctaactacatgagctgggtgcgccaggcccctggcaaagggctggagtgggtcgcggctatctcctttgccggaacaaataagtattacgccgactctgtgaaaggcagattcacgattagccgggataactccaagaatgctctctatctgcaaatgaacagccttcgcgccgaagacaccgctctgtactattgtgccaaagatctcagagagtctgaatgcgaggagtgggcgtccgactactatgattttggccgggactacccgtgtcaggatccccgcggggttgtgggaacactggacatctggggccaggggaccatggtcacagtgagctct

SEQ ID NO: 40327 - RNA, 432 nt, synthetic construct
  misc_feature 1..432: note = derived and/or modified sequence opt5 from anti-HIV_cap256-048-129369_VR-Chain
  source 1..432: mol_type = other RNA
caggtgcaactggtcgagagcggcgggggagttgtgcagcccggcagatccctccggctgtcttgcgccgctagcgggttcaccttttccaactacgtgatgcactgggtccgccaggcccctggaaagggccttgaatgggtggcgctggtttctttcgacgggagcaataaatattacgctgattccgtgaagggaagatttacaatctctcgggacaacagcaaaaatacggtctatctccagatgaactccctgcgcggcgtggataccgccgtttactattgtgccaaggaccttggcgggggagaggtggaagagtgggctacagattactatgactggagcattgcctacccggtcgaacatcccagagctgtggtgggcgtcttcgatatctgggggcaaggaaccaaagttacagtgtcttcc

SEQ ID NO: 40328 - RNA, 432 nt, synthetic construct
  misc_feature 1..432: note = derived and/or modified sequence opt5 from anti-HIV_cap256-048-128476_VR-Chain
  source 1..432: mol_type = other RNA
gaggtgcaggtcctggaaagcggcgggggactcgttcaacccggcgggtccctgagacttgcctgcgctgcctctggattcagcttttcctcttacggcatgcactgggtgcggcaggcgcctgggaagggactggagtgggtgagcttcatccgctatgacggcgctaacaaataccatgccgattccgtcaagggcagatttattatctctcgggacgatagcaaaaataccgtgtccctccagatgaacagcctgcgcccggaagacacagccgtttattactgtgctaaggatcttggggccaataaagacgatgagtgggctacggactattacgatctgtctattgcctatcccgtgcctgaccccagagcggtcgtgggagccttcgatatctggggccaggggaccatggttacagtgtccagc

SEQ ID NO: 40329 - RNA, 432 nt, synthetic construct
  misc_feature 1..432: note = derived and/or modified sequence opt5 from anti-HIV_cap256-048-128270_VR-Chain
  source 1..432: mol_type = other RNA
caggtgcaactggtcgagagcggcgggggagttgtgcagcccggcagatccctccggctgtcttgcaccgccagcgggttcacatttcgctcctacgctatgcactgggtgagacaggcccctggaaagggccttgaatgggtcgcgctgatctcttatgacgggagcaacaaatactatgctgattccgtgaagggacggttcacgatttctcgcgacaatagcaaaaacaccctctacctgcagatgaactcccttacaagcgaggataccgccgtttattactgtgccaaggacctgggcggctctaaaacagatgaatgggggaccgactattacgagttttggaatgcttacccggtgcaagatcccagagtcgtggttggagccttcgacatctggggccatgggacaatggtgaccgtctccagc

SEQ ID NO: 40330 - RNA, 432 nt, synthetic construct
  misc_feature 1..432: note = derived and/or modified sequence opt5 from anti-HIV_cap256-048-126220_VR-Chain
  source 1..432: mol_type = other RNA
caggtgcaactggtcgagagcggcgggggagttgtgcagcccggcagatccctccggctgtcttgcgccgctagcgggttcatcttttccccttacgggattcactgggtgcgccaggccccgggcaaggggcttgaatgggtcgcgctgatctctcatgacggaagcaaaaagtattacgctgattccgtgaaaggcagattcaccatttctcgggacaactttaaggatacactctatctgcagatgaatagccttcgcggcgttgacacggccgtgtactattgtgccaaagatctgggaggaggcgaggtcgaagagtgggctaccgactactatgattggtccacagcctaccccgtggaacaccctagagctgttgtgggggtcttcgacatctggggacaaggcaccaaggtgacagtgagctct

SEQ ID NO: 40331 - RNA, 432 nt, synthetic construct
  misc_feature 1..432: note = derived and/or modified sequence opt5 from anti-HIV_cap256-048-125713_VR-Chain
  source 1..432: mol_type = other RNA
gaggtgcagctggtcgaaagcggcgggggactcgttcaacccggcgggtccctgagactttcttgcgaggccagcggattctccttttctacctacgaactgaactgggtgcggcaggctcctggcaaggggctcgagtgggtggccgtcatcagctatgacggatccaattactattacgcggattctgtgaaaggccgcttcacaattagcagagacaactccaagaatacgctgtatcttcagatgaacagcctgcgggctgaagataccgccgtttactattgtgccaaagacgtgggcgctaataaggatgacgagtgggccacagattactacgacctctctatcgcttatccggtccccgatcctcgcgccgtggttggggcgtttgacatttggggacagggcaccatggtgacagtctccagc

SEQ ID NO: 40332 - RNA, 432 nt, synthetic construct
  misc_feature 1..432: note = derived and/or modified sequence opt5 from anti-HIV_cap256-048-123934_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatggcctgggtgcgccaggcgcctggcaaggggcttgaatgggtcacagctatcagcttcgccggaacgaacaaatattacgccgactccgtgaagggcagatttaccatttctcgggataatagcaaagacacactgtatctccagatggatggcctgcgcccggaggacaccgctctttactattgtgccaaggatctgggggaaagagagtgcgaagagtgggcttccgactactatgatttcggacgggactttcccggccaagatcagcgcgccgttgcgggggtgttcgacatgtggggacagggcacaatggtcaccgtgagctct

SEQ ID NO: 40333 - RNA, 432 nt, synthetic construct
  misc_feature 1..432: note = derived and/or modified sequence opt5 from anti-HIV_cap256-048-122673_VR-Chain
  source 1..432: mol_type = other RNA
gaggtgcaggtcgttgaaagcggcgggggactggtgaagcccggcgggtccctcagactgtcttgcgccgctagcggattcaccttttcctctcacgtgatgaactgggtccggcaagcccctggcaaagggcttgagtgggtgagctccatctctggaggcagctccagcaaggactacgcggattctgttaaaggccgcttcacaatttccagagacaatagcaagaacacgctgtctctccagatgaactccctgcggccggaagataccgctgtgtattactgtgccaaagacgtcggggccaataaggatgacgagtgggctacagattattacgaccttagcatcgcctatcccgtgcctgatccccgcgctgttgtgggagcctttgacatttggggccaggggaccatggtcacagtgtcttcc

SEQ ID NO: 40334 - RNA, 432 nt, synthetic construct
  misc_feature 1..432: note = derived and/or modified sequence opt5 from anti-HIV_cap256-048-122208_VR-Chain
  source 1..432: mol_type = other RNA
agagtgcaggtcgttgagagcggcgggggagtggtgaagcccggcgggtccctgcggctctcttgcggagccagcggcttcaccttttccaacgcttggctgtcttgggtccgccaagcccctgggaaaggacttgaatgggtggcggttatcagctccgacggctctagcaagaattacgctgattccgtgaaaggcagattcacaattagccgggacaactctaagaatacggtctccctgcagatgaacagcctccgcccggaggataccgccgtgtattactgtgccaaagacgttggggctaataaggatgacgaatgggccacagattattacgacctgtctatcgcttatcccgtgcctgatcccagagccgtcgtgggagcgtttgacatttggggccaggggaccatggtgacagtctccagc

SEQ ID NO: 40335 - RNA, 432 nt, synthetic construct
  misc_feature 1..432: note = derived and/or modified sequence opt5 from anti-HIV_cap256-048-121552_VR-Chain
  source 1..432: mol_type = other RNA
caggtgcaactggtcgagagcggcgggggagttgtgcagcccggcgggtccctccggctgtcttgcgccgctagcggattcaccttttcctcttacgccatgcactgggtgcggcaggcgcctggcaaggggcttaaatgggtcgctgacatcagctatgatgcctcctctaagtactatgccgacagcgtgaaaggacgcttcacaatttccagagataacagcaagaatacgctgtacctcgaaatgaactctctgcggccggaggacaccgctgtttattactgtgccaaagatcttggcgaacgcgagtgcgaagagtgggcttccgactattacgattttggcagagacttcccctgtcaggatcctagaggggtggtcggaacatttgacatctggggccaagggaccatggtgacagttagctct

SEQ ID NO: 40336 - RNA, 432 nt, synthetic construct
  misc_feature 1..432: note = derived and/or modified sequence opt5 from anti-HIV_cap256-048-120643_VR-Chain
  source 1..432: mol_type = other RNA
caggtgcaactggtcgagagcggcgggggagttgtgcagcccggcagatccctccggctgtcttgcgccgctagcgggttcaccctttccgcctacacaatgcactgggtgcgccaggcgcctggaaagggcctggaatgggtctctgtgatcagctttgctgggaacaataaatattacgccgactccgttaagggaagattcacgatttctcgggagaacagcaaaaatatgctctatctgcagatgaactcccttcgcggcgaagataccgccgtgtactattgtgctaaggacctgagagagtttgaatgcgaggagtgggccagcgattactatgacttcggccgggattacccgtgtcaagacccccgcggggtcgtgggaacatttgatgtttggggccatgggtctctcgtgaccgtctccagc

SEQ ID NO: 40337 - RNA, 432 nt, synthetic construct
  misc_feature 1..432: note = derived and/or modified sequence opt5 from anti-HIV_cap256-048-118458_VR-Chain
  source 1..432: mol_type = other RNA
caggtgcaactggtcgagagcggcgggggagttgtgcagcccggcagatccctccggctgtcttgcgccgctagcgggttcaccttttccacatctggaatgcactgggtgcgccaggcccctggcaaggggcttgaatgggtcgcgttcatcagctccgacagatctaacaaattttacgctgatagcgtgaagggacggttctccattagccgcgacaattctaaatatacgctgtacctccagatgaactccctgagagccgatgacaccgccgtttatttttgtgctaaggatcttggcgtgaataaaaacgacgagtgggccacagattactatgacctgagcgtcgcttacccggtgcaagatccccggggcgttgccgggatcttcgacatttggggacagggcaccatggtgacagtctcttcc

SEQ ID NO: 40338 - RNA, 432 nt, synthetic construct
  misc_feature 1..432: note = derived and/or modified sequence opt5 from anti-HIV_cap256-048-118112_VR-Chain
  source 1..432: mol_type = other RNA
caggagcaactggtggaaagcggcgggggagtcgttcagcccggcagatccctccggctgtcttgcgccgctagccagttcaccttttccaactacgggatgcactgggtgcgccaggcccctggaaagggccttgtgtgggtcgcggggatctctttcgctggaacaaataaatattacgccgccagcgtgaagggcagatttacgatttcccgggacaactctaaaaataccctgtatctccaaatgaacagcctgcgcgctgaggatacagccctttactattgtgctaaggacatgagagaatacgagtgcgaagagtgggcctccgattattacgacttcggccgggattacccgtgtcaggacccccgcggggttgtgggaacctttgatatctggggccaggggacaatggtcaccgtgagctct

SEQ ID NO: 40339 - RNA, 432 nt, synthetic construct
  misc_feature 1..432: note = derived and/or modified sequence opt5 from anti-HIV_cap256-048-116469_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctatcattagctatgacgggtccaataaatactatgccgattctgtgaagggaagattcacaatcagccgggacaatccgaaaaacacgctgtacctccagatgaactccctgcgcgccgaggataccggcctttattactgtgctaaggacatgggcgaaagcgagaaagaagagtgggcctctgattattacgactttgggagagattaccccggacaagagcctcgggctatggttggcacattcgacatttgggggcagggaaccatggtgacagtctccagc

SEQ ID NO: 40340 - RNA, 432 nt, synthetic construct
  misc_feature 1..432: note = derived and/or modified sequence opt5 from anti-HIV_cap256-048-113917_VR-Chain
  source 1..432: mol_type = other RNA
gaggtgcagctggtcgaaagcggcgggggactcgttcaacccggcgggtccctgagactttcttgcgccgctagcggactgaccgtgtccgacacatacatgaactggctccggcaggcccctggcaaggggctggagtgggtggcggtcgtgtctagcgatggatccaataaaaactatgctgactctgttaagggccgcttcacgatcagcagagataattccaaaaacaccgtgtaccttcagatgaatagcctgcgggccgaagacacagccgtctattactgtgctaaggatctcggcgccaacaaagacgatgagtgggctaccgactattacgatctgtctgtggcctatccggttcccgaccctcgcgcggtggtcggggcctttgatgtgtggggacagggcacaatggtgaccgtctccagc

SEQ ID NO: 40341 - RNA, 432 nt, synthetic construct
  misc_feature 1..432: note = derived and/or modified sequence opt5 from anti-HIV_cap256-048-112368_VR-Chain
  source 1..432: mol_type = other RNA
caggtgcaactggtcgagagcggcgggggagttgtgcagcccggcagatccctccggctgtcttgcgccgctagcgggttcaccttttcccgcaacgccatgcactgggtgagacaggcgcctggaaagggccttgaatgggtcgctgtgatctcttacgacgggagcaataaatattacgccgattccgttaagggacggttcacaatttctcgcgacaacagcaaaaatacgctgtatctccagatgaactccctgagagccgaggataccgctgtgtactattgtgccaaggaccttggcggcggggaagtcgaggaatgggctacagattactatgactggagcaccgcctacccggtggagcatccccgggcggttgtgggagtctttgatatctggggccaagggacaaaagtgaccgtgtcttcc

SEQ ID NO: 40342 - RNA, 432 nt, synthetic construct
  misc_feature 1..432: note = derived and/or modified sequence opt5 from anti-HIV_cap256-048-112047_VR-Chain
  source 1..432: mol_type = other RNA
gaggtgcagctggtcgaaagcggcgggggactcgttcaacccggcgggtccctgagactttcttgcgccgctagcggactgaccgtgtccggctactatatgtcttgggtgcggcaggcccctgggaagggactcgagtggctggcgttcatccactttgacggcagcaaaattcattacgctggctccgtcaaggggcgcatcacagtgtctagagataacagcaaaaatacgcttgacctgcagatgaactccctccgggccgaagataccgccgtttattactgtgctaaggacgtgggagatagcaaatctgacgagtgggccacagattattacgacctgtccgtcgcttatccggtgcccgatcctcgcgccgttgtgggcgcgttcgacatttgggggcagggaaccatggtcacagtgagctct

SEQ ID NO: 40343 - RNA, 432 nt, synthetic construct
  misc_feature 1..432: note = derived and/or modified sequence opt5 from anti-HIV_cap256-048-112029_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggggatcagcttcgctggaattaaaaagtattacgccgactccgtgaaaggcagatttacaatctctcgggataacagcaagaatacgctgtatctccaaatgaactccctgcgcggcgaggacaccgccctttactattgtgctaaagatctgagagaatacgagtgcgaagagtgggccagcgactattacgatttcgggcgggactacccgtgtcaggatccccgcggagttgtgggcatttttgacatctgggggcagggaacaatggtcaccgtgtcttcc

SEQ ID NO: 40344 - RNA, 432 nt, synthetic construct
  misc_feature 1..432: note = derived and/or modified sequence opt5 from anti-HIV_cap256-048-110957_VR-Chain
  source 1..432: mol_type = other RNA
caggtgagactggtcgagagcggcgggggagttgtgcggtccggccgctctctcagactgagctgcgccgcttccgggttcaccttttctaacttcgcccttcactgggtgcggcaagcgcccggaaagggcctggaatgggtcgctgtgatcagctacgacggaaattccaaattttatgccgattctgttaaggggcgcttcacaattagcacggacaactccaaaaataccctctacctgcagatgaacagccttacagccgaggataccgctgtgtattactgtgccaaggacctgggcggcaataaagatgacgaatgggggacagattattacgacttttctgtcgcttatcctgtgcaggatccgagagccgtttccggaatcttcgacgtgtggggccatgggaccatggtcacagtgagctct

SEQ ID NO: 40345 - RNA, 432 nt, synthetic construct
  misc_feature 1..432: note = derived and/or modified sequence opt5 from anti-HIV_cap256-048-110526_VR-Chain
  source 1..432: mol_type = other RNA
caggtgcaactggtcgagagcggcgggggagttgtgcagcccggcagatccctccggctgtcttgcgccgctagcgggttcaccttttccaacttcggatttcactgggtgcgccaggcccctggcaaggggcttgaatgggtcgcggctatctctttcgccggaaataacaaatactatgccgacagcgtgaagggcagatttacaatttcccgggaaaattctaaaaacatcctgtacctccagatgaatagcctgcgcggcgaggatacggctgtttattactgtgccaaggaccttagagagttcgaatgcgaggagtgggcttccgattattacgactggagcaccgcctatccggtggaacatccccgggcggtcgtgggggtttttgatatttggggacaaggcacaaaagtgaccgtctcttcc

SEQ ID NO: 40346 - RNA, 432 nt, synthetic construct
  misc_feature 1..432: note = derived and/or modified sequence opt5 from anti-HIV_cap256-048-109336_VR-Chain
  source 1..432: mol_type = other RNA
gaggtgcagctggtcgaaagcggcgggggactcgttcaacccggcgggtcccagagactgtcttgcgccgctagcggacttaccgtgaactccaattacatgacatgggtgcggcaggcccctggcaaggggctggagtgggtcgcgatcatttctagcgacggatccggccagtattacgctgattctgtgaaaggccgcttcacgatcagcagagacaactccaagaataccctcagcctgcaaatgaactctcttcggccggaagatacagccgtttattactgtgccaaagacctgggggcttccaaggatgacgagtgggccaccgattattacgactttagcattgcttatcccgtgcaggatcctcgcgccgtcgtgggagcgttcgacatctggggccaggggacaatggttaccgtgtcttcc

SEQ ID NO: 40347 - RNA, 432 nt, synthetic construct
  misc_feature 1..432: note = derived and/or modified sequence opt5 from anti-HIV_cap256-048-108152_VR-Chain
  source 1..432: mol_type = other RNA
caggcccaactggtggagagcggcgggggagtcgttcagcccggcagatccctcgtgctgtctagcgtggcttccgggttctcttttagcacctacgccatgcactgggtccggcaggcgcctggaaagggccttgaatgggtggctgttatctcctatgacgggggaaacaaatactatgccgattctgtgaagggccgcttcagcatttccagagacaatagcaaaaacacagtctacctgcagatcaattctctccgggccgaggatacggctgtgtattactgcgccaaggacctgggcgctaacaaagatgacgaatgggccaccgattattacgacctttccgttgcgtacccggtgcccgatcctcgcgccgtcgtgggggcttttgacgtgtggggacaaggcacaatggtcaccgttagctct

SEQ ID NO: 40348 - RNA, 432 nt, synthetic construct
  misc_feature 1..432: note = derived and/or modified sequence opt5 from anti-HIV_cap256-048-107799_VR-Chain
  source 1..432: mol_type = other RNA
gaggtgcaggtcgttgaaagcggcgggggagtggtgcaacccggcagatccctgcggctctcttgcgccgctagcgggttcaccttttccaactacgccatggactgggtccgccaggcgcctggaaagggcctggagtgggtggctttcgtttctagcgatgggtccaataaaaactatgccgactctgtgaagggaagatttacaatcagccgggataattccaaaaacacgcttagcctgcagatgaactctctccgcgccgaagacaccgctgtctactattgtgccaaggaggtgggcgaaaataaagatgacgagtgggcttccgattactatgacctgagcattgcctacccgatccacgatcccagagcggttgtgggcgggttcgacatttggggacagggcacaatggtcaccgtgtcttcc

SEQ ID NO: 40349 - RNA, 432 nt, synthetic construct
  misc_feature 1..432: note = derived and/or modified sequence opt5 from anti-HIV_cap256-048-107384_VR-Chain
  source 1..432: mol_type = other RNA
gaggtgagactggtcgaaagcggcggggccctcgttaagcccggaacctccctgcggctttcttgcgctgccagcggcttcacatttacgcactacgcgatggactgggtgcgccaggctcctgggaaaggactggagtgggtggccatcatttcctctgatggcagcaccaagaactatgccgactccgtcaaagggagattcacaatctctcgggataatagcaagaacaccctctccctgcaaatgaatagccttcgcccggaagacacagctgtgtactattgtgccaaagatgttggagctaacaaggacgatgagtgggccaccgactactatgatctgtctattgcgtaccccgtgcctgaccccagagccgtcgtgggcgcttttgatatctggggccaggggacaatggttaccgtgtccagc

SEQ ID NO: 40350 - RNA, 432 nt, synthetic construct
  misc_feature 1..432: note = derived and/or modified sequence opt5 from anti-HIV_cap256-048-106530_VR-Chain
  source 1..432: mol_type = other RNA
gaggtgcagctgctcgaaagcggcgggggactggtccaacccggcgggtcccttagactgtcttgcgccgctagcggattcaccttttcctcttacgccatggactgggttcggcaggcgcctggcaaggggctcgagtgggtggctgtgatcagctccgatggatctaacaaaaattatgccgacagcgtcaagggccgcttcacaatttccagagataacagcaaaaatacgctgtaccttcagatgtcttccctgcggccggaagacaccgccgtgtattactgtgctaaggatgttggcgacagcaaatctgatgagtgggccacagactattacgatttttccatcgcttatcccattcaggaccctcgcgccgtggtcggggcgttcgatatctggggacaaggcaccatggtgacagttagctct

SEQ ID NO: 40351 - RNA, 432 nt, synthetic construct
  misc_feature 1..432: note = derived and/or modified sequence opt5 from anti-HIV_cap256-048-106464_VR-Chain
  source 1..432: mol_type = other RNA
gaggtgcagatggtccaaagcggcgggggactggttcagcccggcgggtccctcagactgtcttgcgccgctttcggatttaccttcacaaaccacgccatggactgggtgcgccaggtgcctggcaaggggcttgaatgggtcgcgtttatcagctccgatggatctaataaaaactacgctgacagcgtgaagggccggttcacgatttccagagataattctaaaaacaccgtttatctgcagatgagctccctccggccggaggacacagccgtgtactattgtgccaaggatgtcggcgacagcaaatctgatgaatgggctaccgactactatgatctgtccgtggcctaccccgttcctgacccccgcgctgtggtcggggcctttgatatctggggacaaggcacaatggtgaccgtgagctct

SEQ ID NO: 40352 - RNA, 432 nt, synthetic construct
  misc_feature 1..432: note = derived and/or modified sequence opt5 from anti-HIV_cap256-048-106411_VR-Chain
  source 1..432: mol_type = other RNA
caggtgcaactggtcgagagcggcgggggagttgtgcagcccggcagatccctccggctgtcttgcgccgctagcgggttcaccttttcctactctggaatgcactgggtgcgccaggcccctggcaaggggatggaatgggtcgcggtgatcagctatgacggatccaacaaatactatgctgattctgttaagggcagattcacaattagccgggacaattccaaaaacacgctttacctgcagatgaatagcctccgcgtggaggataccgccgtctatcattgtgccaaggacctgggcgggacaaaatctgatgaatgggctaccgactactatgatctttccatcgcctacccgattcaagaccccggagctgtggttggcgtgtttgatatctgggggcagggaacaatggtcaccgtgagctct

SEQ ID NO: 40353 - RNA, 432 nt, synthetic construct
  misc_feature 1..432: note = derived and/or modified sequence opt5 from anti-HIV_cap256-048-106306_VR-Chain
  source 1..432: mol_type = other RNA
gaggtgcagctggtcgaaagcggcgggggactcgttcaacccggcgggtccctgagactttcttgcgaggccagcggattcacctttaacaattacggcatggtgtgggtgcggcaggctcctgggaagggactggaatgggtcgccatcatttcctatgacggcacagagaaatactatgtggattctgttaagggccgcttcacgatcagcagagacaactccaaaaataccctctctctgcagatgaacagccttcgggcggaagatacagctgtgtactattgtgccaaggaggtcggggagaataaagacgatgaatgggcctccgactactatgatctgagcattgcttacccgatccacgacccccgcgccgtggttggaggctttgatatttgggggcagggaaccatggtgacagtctcttcc

SEQ ID NO: 40354 - RNA, 432 nt, synthetic construct
  misc_feature 1..432: note = derived and/or modified sequence opt5 from anti-HIV_cap256-048-104496_VR-Chain
  source 1..432: mol_type = other RNA
caggtgcaactggtcgagagcggcgggggactcgttaagcccggcgggtccctgagactttcttgcgccgctagcggattcaccttttcctcttacggcatgcactgggtgcggcaggcccctgggaaaggactggaatgggtggcgttcgtcagctccgacggcaacaataagaactatgctgattctgtgaaaggccgctttacaatcagcagagacaattccaagaacacggtttacctccagatgaatagcctgcgggtggaggataccgccgtctattactgtgccaaagaccttggggctaacaaggatgacgaatgggccacagattattacgacctgtctgtggcttatccggttcccgatcctcgcgccgtggtcggagcgttcgacgtgtggggccaggggaccatggtgacagtctccagc

SEQ ID NO: 40355 - RNA, 432 nt, synthetic construct
  misc_feature 1..432: note = derived and/or modified sequence opt5 from anti-HIV_cap256-048-103074_VR-Chain
  source 1..432: mol_type = other RNA
caggtgcacctggtcgagagcggcgccggggttgtgcaacccggaggctccctcagactgtcttgcgctgtgagcgggttcacctttaactcctacggaatgcattgggtccggcaggcccctggcaaggggcttgaatgggtggcggttatctcttatgacggaagcgataaatactatgctgactccgtgaagggccgcttcacaatttctagagatagctccaaaaatacgctgtacctccagatgaacagcctgcgggtcgaggacaccgccgtgtattactgtgccaaggatcttggcgctaataaagacgatgaatgggccacagactattacgatctgtctgttgcttacccggtgcccgaccctcgcgccgtcgtgggggcgtttgatgtgtggggacagggcaccatggtcacagtttccagc

SEQ ID NO: 40356 - RNA, 432 nt, synthetic construct
  misc_feature 1..432: note = derived and/or modified sequence opt5 from anti-HIV_cap256-048-100832_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtggttagctccgacggaacaaacaaaaattatggcgattctgtgaagggcagattcacgatcagccgggacaactcccgcaataccgtctacctgcagatgagctctctcagaccggaggatacagctgtgtattactgtgccaaagacgttggggataccaagtccgacgaatgggccacagattattacgactttagcattgcttatcccgtgcaagatcctcgggccgtcgtgggagctttcgacatctggggccaggggaccatggtgacagtctcttcc

SEQ ID NO: 40357 - RNA, 432 nt, synthetic construct
  misc_feature 1..432: note = derived and/or modified sequence opt5 from anti-HIV_cap256-048-100188_VR-Chain
  source 1..432: mol_type = other RNA
caggtgcacctggtcgagagcggcgggggagttgtgcaacccggcagatccctccggatctactgcgccgtgtctgagttcacctttcgcaactatgctatgcattgggtcagactggcccctgggaagggacttcagtgggtggcggttattagctacaatggcgggaaaaagtattacgctgactccgtgaaaggacggttcacaatctctcgcgataacagcaagaatgccctgtatctccagatgaactccctgagagccgaagacacgggcctttactattgtgctaaagatctgcgggaatttgagtgcgaagagtgggcctctgactactacgatttcggccgcgagtatccgtgtcaggaccccagaggggtcgtgggaacctttgatatttggggccaagggacaatggttaccgtgagctcc

SEQ ID NO: 40358 - RNA, 432 nt, synthetic construct
  misc_feature 1..432: note = derived and/or modified sequence opt5 from anti-HIV_cap256-048-099645_VR-Chain
  source 1..432: mol_type = other RNA
caggtgcaactggtcgagagcggcgggggagttgtgcagcccggcagatccctccggctgtcttgcgccgctagcgggttcaccttttcccgctacgcccttcactgggtgagacaggcgcctggaaagggcctggaatgggtcgctgtgatctcttatgacgggagctccaaatactatgccgattctgttaagggacggttcagcatttcccgcgacaacagcaaatacacactctatctgcagatgaactctcttagagccgatgacacggctgtgtacttttgtgccaaggatctgggcgtcaataaaaatgacgagtgggctaccgattattacgacctctccgtggcctacccggttcaagatccccggggcgtggcggggatcttcgacatttggggacagggcacaatggtcaccgtgagctct

SEQ ID NO: 40359 - RNA, 432 nt, synthetic construct
  misc_feature 1..432: note = derived and/or modified sequence opt5 from anti-HIV_cap256-048-098137_VR-Chain
  source 1..432: mol_type = other RNA
caggtgcaactggtcgagagcggcgggggagttgtgcagcccggcagatccctccggctgtcttgcgccgctagcgggttcacccttcgcaactacgccatgcactgggtgagacaggcgcctggaaagggcctggaatgggtcgctgtgatctcctctgacgggaataacaaatattacgccgatagcgttaagggacggtttacagtgtcccgcgacaattctaaagatacgctctatctgcagatgaacagccttagaccggaggacaccgccctgtactattgtgctaaggatctcggcgaacgggagtgcgaagagtgggcctccaattactatgacttcggccgcgattacccctgtcaagaccctagaggggtcgtgggaacatttgatatttggggccaggggaccatggttacagtgagctct

SEQ ID NO: 40360 - RNA, 432 nt, synthetic construct
  misc_feature 1..432: note = derived and/or modified sequence opt5 from anti-HIV_cap256-048-097878_VR-Chain
  source 1..432: mol_type = other RNA
caggtgcaactgctcgagagcggcgggggagtcgttcagcccggcaagtccctgagactttcttgcgccgctagcgggttcacctttaatacatacggaatgcactgggtgcggcaggcccctggcaaagggctgcagtgggtggcggtcatctcctatgacggaacgattcaaaagtacgctgattctgtgaaaggccgcttcaccatcagcagagaaaattccaagaacatgctctatctgcagatgaactctcttcggggcgaggacacagccgtttactattgtgccaaagatctgcgcgaatttgagtgcgaagagtgggctagcgactactatgatttcgggagagactacccgtgtcaggatccccggggagtggtcggcacctttgacgtgtgggggcatggatccctcgttacagtgagctct

SEQ ID NO: 40361 - RNA, 432 nt, synthetic construct
  misc_feature 1..432: note = derived and/or modified sequence opt5 from anti-HIV_cap256-048-097510_VR-Chain
  source 1..432: mol_type = other RNA
caggtgcaactggtcgagagcggcgggggagttgtgcagcccggcagatccctctggctgtcttgcgccgctagcgagttcacccttcggtcctacgggatgcactgggtgcgccaggcccctggaaagggcctggaatgggtcgcgtttgtggctttcgacgaatctgataaatattacgccgacagcgttaaggggagatttacaatctcccgggataactctaaaaatacgctcagcctgcagatgaactcccttcgcgccgaggacaccgctgtgtattactgtgccaaggaagtcggagataataaagacgatgagtgggctagcgactattacgatctgtctattgcctatccggtgcatgaccccagagcggttgtgggcggcttcgatatctgggggcaaggaacaatggtcaccgtgtccagc

SEQ ID NO: 40362 - RNA, 432 nt, synthetic construct
  misc_feature 1..432: note = derived and/or modified sequence opt5 from anti-HIV_cap256-048-097313_VR-Chain
  source 1..432: mol_type = other RNA
caggtgcaactggtcgagagcggcgggggactcgttcagcccggcggggccctgagactttcctgcctggtgtctggattcacctttgacgattacgctctccactgggtgcggcaggcccctggcaaggggccggaatgggtcgcggtgctgagctccgacggatcttataaatactatacagagagcgttcagggccgcttcacgatctccagagataactctaagaataccgtgtaccttcaaatgaacagcctgcggggcgtcgacacagctgtgtattactgtgccaaagatctcgggggaggcgaagttgaggaatgggccaccgactattacgattggtccattgcttaccccgtggagcatcctcgcgccgtcgtgggggtgtttgacatctggggacagggcacaaaggtcaccgttagctct

SEQ ID NO: 40363 - RNA, 432 nt, synthetic construct
  misc_feature 1..432: note = derived and/or modified sequence opt5 from anti-HIV_cap256-048-096626_VR-Chain
  source 1..432: mol_type = other RNA
gaggtgcagctggtcgaaagcggcgggggactcgttcaacccggcgagtccctgagactttcttgcgccgggagcggattcaccttttcctcttactggatgagctgggtgcggcaggctcctggcaaggggctggaatggatggccctcatctcctatgacggatctaacaaatactatgtggatagcgtcaagggccgcttcacaatttccagagacaatagcaaaaacacgctgtaccttcagatgaactctctgcgggcggaggataccgctgtgtattactgtgccaaggacctcggcgggaataaagatgacgaatgggccacagattattacgacctgtccatcgcttacccggttcaggatccccgcgtggtcgtgggaatttttgacatctggggccaagggaccatggttacagtgagctct

SEQ ID NO: 40364 - RNA, 432 nt, synthetic construct
  misc_feature 1..432: note = derived and/or modified sequence opt5 from anti-HIV_cap256-048-096483_VR-Chain
  source 1..432: mol_type = other RNA
gaggtgcagctggtcgaaagcggcgggggactcgttcaacccggcagatccctgcggctttcttgcgccgctagcgggttctcctttgaggactacgccatgcactgggtgcgccaggcgcctggaaagggcctggaatgggtggctgggatctctttcgccggaaccaaaaagtattacgccgatagcgtcaaaggcagatttacaatttcccgggacaactctaagaatgctctctatctgcagatgaacagccttcgcgccgaggatacggctctgtactattgtgccaaagacctcagagaatacgagtgcgaggaatgggcgtccgattattacgacttcggccgggattacccgtgtcaggacccccgcggggtggttggaacctttgatatctggggccaagggacaatggtgaccgtcagctct

SEQ ID NO: 40365 - RNA, 432 nt, synthetic construct
  misc_feature 1..432: note = derived and/or modified sequence opt5 from anti-HIV_cap256-048-095691_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatggcctgggtgcgccaggcgcctggcaaggggcttgaatgggtcacagctatcagcttcgccggaacgaacaaatattacgccgactccgtgaagggcagatttaccatttctcgggataatagcaaagacacactgtatctccagatggatggcctgcgcccggaggacaccgctctttactattgtgccaaggatctgggggaaagagagtgcgaagagtgggcttccaactactatgacttcggacgggattacccctgtcaagaccctcgcggcgttgtggggacatttgatatctggggacagggcaccatggtcacagtgagctct

SEQ ID NO: 40366 - RNA, 432 nt, synthetic construct
  misc_feature 1..432: note = derived and/or modified sequence opt5 from anti-HIV_cap256-048-095525_VR-Chain
  source 1..432: mol_type = other RNA
caggtgcaactggtccagagcggcgggtccgttgtgcagcccggaaagtctctcagactgagctgcgccgcttccggcttcaccttttctagcttcgggatgcactgggtgcggcagacacctggaaaaggccttgagtgggtcgccgtgatctcctacgacgggtctgaaaagagctatgcggattccgttaaaggacgctttacgattagcagagacaactctaagaataccctgtacctccaaatgaactccctgcgggctgaggatacagccgtgtattactgtgccaaagaccttggcggcaccaaggatgacgaatgggctacagattattacgacatcagcattgcctatccggtccaggatccccgcgctgtggccggggcgttcgacatctggggacagggcaccatggttacagtgtcttcc

SEQ ID NO: 40367 - RNA, 432 nt, synthetic construct
  misc_feature 1..432: note = derived and/or modified sequence opt5 from anti-HIV_cap256-048-094783_VR-Chain
  source 1..432: mol_type = other RNA
gaggtgcagctggtcgaaagcggcgggggactggttaagcccggcgggtccctgagactttcttgcgccgctagcggaatcaccttctccacatacgagatgaactgggtgcggcaagcccctggcaaagggatggaatgggtggcggtcatttcttatgacggaagcaataagtactatgctgattccgtgaaaggccgctttacgatctctagagacaacagcaagaataccgtttacctgcagatgaactccctccggggcgtggatacagccgtctattactgtgccaaagacctcgggggaggcgaggtggaagagtgggctaccgattattacgactggagcattgcctacccggttgagcacccccgcgctgtggtcggggtgttcgatatctggggacagggcacaaaggtgaccgtctcttcc

SEQ ID NO: 40368 - RNA, 432 nt, synthetic construct
  misc_feature 1..432: note = derived and/or modified sequence opt5 from anti-HIV_cap256-048-094356_VR-Chain
  source 1..432: mol_type = other RNA
caggtgcaactggtcgagagcggcgggggagttgtgcagcccggcagatccctccggctgtcttgcgccgctagcgggttcatctttacccactacgccatggactgggtgcgccaggcgcctggaaagggccttgaatgggtcgctgtgatttcctctgatgggagctccaaaaactatgccgactctgttaagggaagattcacaatcagccgggataattccaaaaacacggtgagcctgcagatgaactctctccgcccggaggacaccgccgtctactattgtgctaaggatgtgggcgacaataaatccgatgaatgggccacagactactatgattttagcattgcttaccccgttcctgaccccagagccgtggtcggcgcgttcgatctgtgggggcaaggaaccatggtgacagtgtcttcc

SEQ ID NO: 40369 - RNA, 432 nt, synthetic construct
  misc_feature 1..432: note = derived and/or modified sequence opt5 from anti-HIV_cap256-048-090756_VR-Chain
  source 1..432: mol_type = other RNA
caggtgcaactggtcgagagcggcgggggagttgtgagacccggccggtccctccgcctgtcttgcgccgtgagcgggttcaccttttccaattacgctatccactgggtcagacaggcccctggaaagggccttgaatgggtggcggttatttcttatgacgggagcgataaatactatgctgactccgtgaagggacggttcacaatctctcgcgagaatagcaaaaacatgctgtacctccagatgaactccctgagaggcgaagatacggccgtctattactgtgccaaggaccttcgggagtttgaatgcgaggagtgggctagcgattattacgacttcggccgcgattacccgtgtcaggaccccagaggggtggttggaacctttgatgtgtggggccatgggtctctggtcacagtgtccagc

SEQ ID NO: 40370 - RNA, 432 nt, synthetic construct
  misc_feature 1..432: note = derived and/or modified sequence opt5 from anti-HIV_cap256-048-089065_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgggacgaacaaatactatgtggatagcgttaagggaagattcaccatttcccgggacaattctaaaaacacactctacctgcagatgaatagccttaccgccgaggatacagccgtgtattactgtgctaaggacctgggcggcaacaaagatgacgaatgggggaccgattattacgacttttccgtcgcctacccggtgcaagatccccgcgctgttagcggaatcttcgacgtgtggggccatgggacaatggtcaccgtgtcttcc

SEQ ID NO: 40371 - RNA, 432 nt, synthetic construct
  misc_feature 1..432: note = derived and/or modified sequence opt5 from anti-HIV_cap256-048-084986_VR-Chain
  source 1..432: mol_type = other RNA
caggtgcaactggtcgagagcggcgggggagttgtgcagcccggcagatccctccggctgtcttgcgccgctagcgggttcaccttttccgactacgccatgcactgggtgcgccaggcgcctggaaagggccttgaatgggtcgctctgatctcttatgatgggagcaacaaatactatgccgactccgtgaagggaagattcacaatttctcgggataatagcaaaaacacgctctacctgcagatgtccagccttaccgccgaggacacagctgtttattactgtgccaaggatctgggcggcaataaaaacgacgaatgggctaccgattattacgacctctctatcgcctacccgattcatgatccccgcgcggtgctgggggcctttgacgtctggggacaaggcacaatgctgaccgtgtccagc

SEQ ID NO: 40372 - RNA, 432 nt, synthetic construct
  misc_feature 1..432: note = derived and/or modified sequence opt5 from anti-HIV_cap256-048-083355_VR-Chain
  source 1..432: mol_type = other RNA
caggtgcaactggtcgagagcggcgggggagttgtgcagcccggcagatccctccggctgtcttgcgccgtgagcgggttcatcttttcctcttacgctatgcgctgggtcagacaggcccctggaaagggccttgaatgggtggcggttattagctatgacgggtccaaaaccaactacgctgattctgtgaagggacggttcacaatcagccgcgacaattccaaaaacacgctgtatctccagatgaatagcctgacctctgaggatacagccgtctactattgtgccaaggaccttggcggctccaaaaccgatgaatgggggacagactactatgagttttggaacgcttacccggtgcaagatcccagagttgtggtcggagccttcgacatttggggccacgggaccatggtgacagtgagctct

SEQ ID NO: 40373 - RNA, 432 nt, synthetic construct
  misc_feature 1..432: note = derived and/or modified sequence opt5 from anti-HIV_cap256-048-082462_VR-Chain
  source 1..432: mol_type = other RNA
caggtgcacctggtcgagagcggcgggggagttgtgcaacccggcaagtccctcagactgtcttgcaccgccagccggttcatctttcgcaactacgctatggactgggtgagacaggcccctgggaaaggacttgaatgggtcgcggtgatttcctatgatggcgttaaggagcattacgctgaatctgtgaaagggcggttcacaatcagccgcgacaattccaagaacacggtctatctgcagatgaactctctcagagtggaggataccgccgtttactattgtgccaaagacctgggagctaataaggatgacgaatgggccacagattactatgaccttagcgtggcttacccggtccccgatcctcgggccgtggtgggcgcgtttgacgtctggggccaggggaccatggttacagtgtccagc

SEQ ID NO: 40374 - RNA, 432 nt, synthetic construct
  misc_feature 1..432: note = derived and/or modified sequence opt5 from anti-HIV_cap256-048-082246_VR-Chain
  source 1..432: mol_type = other RNA
caggtgcacctggtcgagagcggcgggggagttgtgcaacccggcagatccctccggatctcttgcgccgctagcgggttcaccttttccaagaatgccatgcattgggtgcgccaggcgcctggaaaaggcctggaatgggtcgctttcgtggcctttgacgagtctgataagtactatgccgacagcgttaaagggagattcacaatttcccgggataattctaagaacatccttagcctgcagatgaactccctccgcgctgaagacacggccgtgtactattgtgctaaagaggtcgatgaatacaaggacgatgagtgggccagcgactattacgatctgtctattgcgtatccggtgagagacccccgggccgttgtgggaggctttgatatctggggccaggggaccatggtcacagtgtccgct

SEQ ID NO: 40375 - RNA, 432 nt, synthetic construct
  misc_feature 1..432: note = derived and/or modified sequence opt5 from anti-HIV_cap256-048-080752_VR-Chain
  source 1..432: mol_type = other RNA
caggtgcaactggtcgagagcggcgggggagttgtgcagcccggcgggtccctcagactgtcttgcgccgctagcggattcaccttttccaattacggcatgcactgggtgcggcaggcccctgggaagggacttgaatgggtcgcgttcatccgctatgacggcgatattacatactatgtggactctgttaaaggcagatttacgatcagccgggataattccaagaacgctctgtacctccagatgaactctctgcgcgccgaggacaccgccctttattactgtgctaaagatctgagagaatatgagtgcgaagagtgggccagcgactactacgatttcgggcgggagtatccgtgtcaagacccccgcggagtggtcggcacatttgatatttgggggcagggaaccatggtgacagtttccagc

SEQ ID NO: 40376 - RNA, 435 nt, synthetic construct
  misc_feature 1..435: note = derived and/or modified sequence opt5 from anti-HIV_cap256-048-078409_VR-Chain
  source 1..435: mol_type = other RNA
caggtgcaactggtcgagagcggcgggggagttgtgcagcccggcagatccctccggctgtcttgcgccgctagcgggttcacctttaacaattacgccatggactgggtgcgccaggcgcctggaaagggccttgaatgggtcgctctgatctcctatgatgggtctaacaaatactatgccgagagcgtgaagggaagattcacaatttcccgggacaattctaaaaacacgctctacctgcagatgaatagccttcgcgccgaagataccgctgtttattactgtgccaaggacgtgggcgagaaacaatccatgatgagatgggctacagattattacgacctgagcatcgcctacccggtccccgatcctcgggcggtggttggcgcctttgacctctgggggcgcggaaccatggtgacagtctcttcc

SEQ ID NO: 40377 - RNA, 432 nt, synthetic construct
  misc_feature 1..432: note = derived and/or modified sequence opt5 from anti-HIV_cap256-048-078273_VR-Chain
  source 1..432: mol_type = other RNA
gaggtgcagctggtcgaaagcggcgggggactcgttcaacccggcgggtccctgagactttcttgcgccgctagcggattcaccgtgtcctctaactacatgagctgggtgcggcaggcccctggcaaggggctggagtgggtcgcggtgatctcctctgacggaagcaataaaaactatgctgattccgttaagggccgctttacaattagcagagacaattctaaaaacaccctcttcctgcagatgaactcccttcggccggaagatacggccgtgtacttttgtgccaaggacctgggcgctaataaagatgacgagtgggccacagattattacgacctcagcatcgcttatcccgtccacgatcctcgcgccgtggttgggattttcgacctgtggggacagggcaccatggtgacagtctcttcc

SEQ ID NO: 40378 - RNA, 432 nt, synthetic construct
  misc_feature 1..432: note = derived and/or modified sequence opt5 from anti-HIV_cap256-048-078062_VR-Chain
  source 1..432: mol_type = other RNA
gacgtgtacctggtcgagagcggcgggggactcgttcagcccggcgggtccctgagactttcttgcaccgccagcggaatcacattctccacgtatgaaatgaattgggtgcggcaagctcctggcaaggggctggagtgggtggcctttgtcgcgttcgatggatctgacaaatactatgctgatagcgtgaagggccgctttgttatttccagagacaattctaaaaacaccctcagcctgcagatgaactcccttcgggccgaagatacagccgtgtactattgtgctaaggaggtcggcgaagacaaagatgacgagtgggccagcgattactatgacctgtctatcgcttacccggtgcacgatccccgcgccgttgtcgggggattcgacatttggggccaggggaccatggtgacagtgtccagc

SEQ ID NO: 40379 - RNA, 432 nt, synthetic construct
  misc_feature 1..432: note = derived and/or modified sequence opt5 from anti-HIV_cap256-048-077798_VR-Chain
  source 1..432: mol_type = other RNA
caggtgcaactggtcgagagcggcgggggagttgtgcagcccggcagatccctccggctgtcttgcgccgctagcgggttcaccttttccaactacggaatgcactgggtgcgccagacacctggcaaggggcttgaatgggtcgccgtgatctcttatgacggaagcaataaattctacgcggattccgttaagggcagatttacgatttctcgggacaacagcaaaaataccctgtatctccagatgaactccctgcgcgtggaggatacagctgtctaccattgtgccaaggaccttggcgggagcaaatctgatgaatgggccaccgactattacgattggtccatcgcttatccggtgcacgaccccagagccgttgtgggagtcttcgatatttggggccaagggacactggtgaccgtgagctct

SEQ ID NO: 40380 - RNA, 432 nt, synthetic construct
  misc_feature 1..432: note = derived and/or modified sequence opt5 from anti-HIV_cap256-048-073853_VR-Chain
  source 1..432: mol_type = other RNA
gaggtgcagctggtcgaaagcggcgggggactcgttaagcccggcgggtccctgagactttcttgcgccgctagcggattcaccttttccgacgcctggatgaactgggtgcggcaagcgcctggcaaagggctggagtgggtggctggaatctctttcgccggcacaaataagtactatgccgatagcgtcaaaggccgctttacgatttccagagacaactctaagaataccctctacctgcagatgaacagccttcgggctgaagatacagccctgtattactgtgctaaagacatgcgcgagtatgaatgcgaggagtgggcctccgattactatgacttcgggagagattacccgtgtcaggacccccggggagtggttggcacctttgatatctgggggcagggaacaatggtgaccgtcagctct

SEQ ID NO: 40381 - RNA, 435 nt, synthetic construct
  misc_feature 1..435: note = derived and/or modified sequence opt5 from anti-HIV_cap256-048-071661_VR-Chain
  source 1..435: mol_type = other RNA
caggtgcaactggtcgagagcggcgggggagttgtgcagcccggcagatccctcgggctgtcttgcgaagtgagcggattcaccttttccgactacttcatgtcttggatccggcaggcccctggcaaggggcttgagtgggtcgctgtgattagccacgatggaaacaataaatattacccggactccgttcagggccgctttacaatctctagagaaaacagcaagaatacgctgtatctccaaatgaactccctgaaacccgaggataccgccgtgtacttctgtgcgaaggaccttggcggggaaagcgaggtcgaggaatgggcttctgattattacgactttggacgggatattcctggccccgaccctcgcggggtggttggaacactggatatctggggccatgggaccatggtgacagtctccagc

SEQ ID NO: 40382 - RNA, 432 nt, synthetic construct
  misc_feature 1..432: note = derived and/or modified sequence opt5 from anti-HIV_cap256-048-071360_VR-Chain
  source 1..432: mol_type = other RNA
caggtgcaactggtcgagagcggcgggggagttgtgcagcccggcagatccctccggctgtcttgcgccgctagcgggttcacccttacaaactacgccatggactgggtgcgccaggcgcctggaaagggcctggaatgggtcgctgtgatctcctctgatgggagcaataaaaactatgaggactccgttaagggaagatttacgatttctcgggataatagcaaaaacaccctctacctgcagatgtccagccttcgcccggaagacacagccgtgtattactgtgccaaggatgtcggcgacaataaatctgatgagtgggctaccgactattacgatttctccatcgcctatcccgtgcctgaccccagagctgttgtgggcgcctttgatctgtgggggcaaggaacaatggtcaccgtgagctct

SEQ ID NO: 40383 - RNA, 432 nt, synthetic construct
  misc_feature 1..432: note = derived and/or modified sequence opt5 from anti-HIV_cap256-048-070955_VR-Chain
  source 1..432: mol_type = other RNA
gaggtgcagctggtcgaaagcggcgggggactcgttcaacccggcgggtccgtgagactgtcttgcgccgtgagcggattcaccttttcctcttactggatgagctgggtccggcaggctcctggcaaggggcttgagtgggtggccgttatctccgactctggaagcaataaatattacgcggattccgtgaagggccgcttcacaattagcagagacaattctaaaaacacgctgtatctccagatgaactccctgcgggctgaagataccgccgtctacttttgtgccaaggaccttggcgggcgcgagacagaagagtgggctagcgattattacgacttcggaagagattttccgggccaggaccaacgggccgtggctggggttttcgatatgtggggacagggcaccatggtgacagtctcttcc

SEQ ID NO: 40384 - RNA, 432 nt, synthetic construct
  misc_feature 1..432: note = derived and/or modified sequence opt5 from anti-HIV_cap256-048-070061_VR-Chain
  source 1..432: mol_type = other RNA
gaggtgcagctgctcgaaagcggcgggggactggtccaacccggcgggtcccttagactgtcttgcgccgctagcggattcaccttttcctcttacgccatgcactgggttcggcaggcgcctggcaaggggctcgagtgggtggctgtgacaagctatgacggatccaacaaatactatgccgattctgtcaagggccgcttcacgatcagcagagacaattccaaaaacaccctgtacatgcagatgaatagccttcgggccgaagatacagctgtgtattactgtgccaaggaccagggcgagtctgaaaaagaggagtgggcttccgattattacgactttgggcgcgattacccgggaagagacccccggcgcgttgtggccaccttcgcgatttggggccaagggacaatggtcaccgtgagctct

SEQ ID NO: 40385 - RNA, 432 nt, synthetic construct
  misc_feature 1..432: note = derived and/or modified sequence opt5 from anti-HIV_cap256-048-069669_VR-Chain
  source 1..432: mol_type = other RNA
caggtgcaactggtcgagagcggcgggggagttgtgcagcccggcagatccctccggctgtcttgcgccgtgagcgggttcaccttttccaagttccctatgcactgggtccgccaggctccgggaaaaggccttgaatgggtggccgttatctcttacgacgggaacaagaaatattacgtggatagcgcgaagggaagatttacaatttcccgggacaattctcgcaaaacgctgtatctccagatgaccggcctgagacccgaggatacagctgtctactattgtgccaaggaccttggcgggggagaatgcgagacctgggccagcgattactatgacttcggcaaggattacccttgtctggacccccgggatgtggttgggacatttgacatctggggacaaggcaccctcgtgacagtctccagc

SEQ ID NO: 40386 - RNA, 432 nt, synthetic construct
  misc_feature 1..432: note = derived and/or modified sequence opt5 from anti-HIV_cap256-048-069205_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgtggttatcagcaatgacgggaataacaaatattacgctgattccgtgaagggaagattcacaatttctcgggacaatagcaaaaacacggtctatctgcagatgaactccctccgcgccgaggataccgccgtgtactattgtgctaaggacgttggcgataccaaaaaggacgaatgggccacagattactatgacctgagcatcgcttacccggtgcaagatccccaggccgtcgtgggcgcgtttgacatttgggggcagggaacaatggtgaccgtctcttcc

SEQ ID NO: 40387 - RNA, 432 nt, synthetic construct
  misc_feature 1..432: note = derived and/or modified sequence opt5 from anti-HIV_cap256-048-068882_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgggacggataaatactatgccgacagcgtgaagggaagattcaccatttcccgggataactctaaaaatacagtttacctccagatgaacagcctgcgcggcgtggacaccgccgtctattactgtgctaaggatcttggcgggggagaggtggaagagtgggccacagactattacgattggtccaccgcttacccggttgaacatcccagagccgtggtcggcgtgtttgacatctgggggcaaggaacaaaagtgaccgtcagctct

SEQ ID NO: 40388 - RNA, 432 nt, synthetic construct
  misc_feature 1..432: note = derived and/or modified sequence opt5 from anti-HIV_cap256-048-067764_VR-Chain
  source 1..432: mol_type = other RNA
gaggtgcagctggtccaaagcggcgggggactcgttaagcccggcgggtccctgagactttcttgcgccgctagcggattcaccttttccacatactctatgaactgggtgcggcaggcccctggcaaagggctggaatgggtggcggtcatcagctccgacggatctagcaagaattatgctgattccgtgaaaggccgcttcacgattagcagagacaactctaagaataccgtttccctccagatgaacagcctgcggccggaggatacagccgtgtactattgtgccaaagacgtcggcgctaataaggatgacgaatgggccaccgattactatgacctttctatcgcttaccccgtgcctgatccccgcgccgttgtgggggcgtttgacatttggggacagggcacaatggtcaccgtgtccagc

SEQ ID NO: 40389 - RNA, 432 nt, synthetic construct
  misc_feature 1..432: note = derived and/or modified sequence opt5 from anti-HIV_cap256-048-066845_VR-Chain
  source 1..432: mol_type = other RNA
caggtgctgctcgtcgagagcggcgggggagttgtgcaacccggcgggtccctgaccctttcttgcgccgctagcggattcacattttccaactacggcatgcactgggtgcggcaggcccctgggaagggactggaatgggtcgcgttcatccggtatgacggcaataacaaatactatgctgattctgtgaagggccgctttacgattagcagagacaattccaaagataccctctacctgcagatggacgggcttcggccggaggatacagccctgtattactgtgccaaggacctcggagaacgcgagtgcgaagagtgggcttctaactattacgatttcggcagagactacccctgtcaggatcctagaggggttgtgggaacctttgacatctggggccaagggacaatggtcaccgtgagctcc

SEQ ID NO: 40390 - RNA, 432 nt, synthetic construct
  misc_feature 1..432: note = derived and/or modified sequence opt5 from anti-HIV_cap256-048-065226_VR-Chain
  source 1..432: mol_type = other RNA
gaggtgcagctggtcgaaagcggcgggggactcgttaagcccggcgggtccctgagactttcttgcgtggccagcggattcaccttttccaactacggcatgcactgggtgcggcaagctcctgggaaaggactggtctgggtggccggcatctctttcgcgggcacaaataagtattacgctgccagcgttaaagggcgctttacgatttccagagacaactctaagaataccctctatctgcagatgaacagccttcgggccgaggatacagctctgtactattgtgccaaagacatgcgcgaatacgagtgcgaagagtgggcttccgattattacgacttcggaagagattacccgtgtcaggacccccggggcgtggtcgggacctttgatatctggggacagggcacaatggtgaccgttagctct

SEQ ID NO: 40391 - RNA, 432 nt, synthetic construct
  misc_feature 1..432: note = derived and/or modified sequence opt5 from anti-HIV_cap256-048-063717_VR-Chain
  source 1..432: mol_type = other RNA
caggtgcaactggtcgagagcggcgggggagttgtgcagcccggcagatccctccggctgtcttgcgccgctagcgggttctccttttctaaccacgccatggactgggtgcgccaggcgcctggaaagggccttgaatgggtcgctgtgatcagctccgatgggtctgacaaaatttacgccgagagcgttaagggaagattcaccatctcccgggataatagcaaaaacacactgtatctccagatgaactctctgcgcgtggaagacacggccgtctacttttgtgctaaggatcttggcgccaataaagacgatgagtgggctaccgactattacgatctgtccattgcctatccggtgcccgaccctagagcggttgtgggcgccttcgatatctgggggcaaggaacaatggtcagcgtgtcttcc

SEQ ID NO: 40392 - RNA, 432 nt, synthetic construct
  misc_feature 1..432: note = derived and/or modified sequence opt5 from anti-HIV_cap256-048-063150_VR-Chain
  source 1..432: mol_type = other RNA
gaggtgcagctggtcgaaagcggcgggggagttgtgcaacccggcagatccctccggctgtcttgcgccgctagcgggttcaccttttcctcttacgccatgcactgggtgcgccaggcgcctggaaagggccttgagtgggtcgctcatatcagatatgacgggagcaacaaatactatattgattccgtgcagggacggttcacaatctctcgcgacaatccgaagaacacgctgtacctccagatgaatagcctgagaaccgaagatacagccgtttattactgtgccaaagaccttggcggcggggaggtggaagagtgggctaccgattattacgactggtccattgcctaccccgtcgagcaccctcgggctgtggttggagtgtttgatatctggggccaagggacaaaggtcaccgtgagctct

SEQ ID NO: 40393 - RNA, 432 nt, synthetic construct
  misc_feature 1..432: note = derived and/or modified sequence opt5 from anti-HIV_cap256-048-062431_VR-Chain
  source 1..432: mol_type = other RNA
caggtgcaactggtcgagagcggcgggggagttgtgcagcccggcagatccctccggctgtcttgcgccgctagcgggttcaccttttccaacttcgccatggactgggtgcgccaggcgcctggaaagggccttgaatgggtcgctgtgatctctagcgatgggtccaaaaagaattacggagactctgttaaaggcagatttacaattagccgggataactccaagaatacgctgttcctccagatgaacagcctgcgcccggaggacaccgccctttattactgtgccaaagatctgggcgggtataagtctgacgaatgggctacagattactatgacctctccatcgcctaccccgtgcaagatcctagaccctggctggagctgctctatatttggggacagggcgctatggtcaccgtgagctct

SEQ ID NO: 40394 - RNA, 432 nt, synthetic construct
  misc_feature 1..432: note = derived and/or modified sequence opt5 from anti-HIV_cap256-048-060745_VR-Chain
  source 1..432: mol_type = other RNA
caggtgcaactggtcgagagcggcgggtccgttgtgcagcccggaagatctctccggctgacctgcacagccagcggcttcacgttttcccactacgctatggactgggtgcgccaggcccctgggaagggacttgaatgggtcgcggtgatctctagcgatgctaccaacaaaaattatgccgactccgttaagggcagattcacaatttctcgggataacagcaaaaataccgtgtacctgcagatggactccctccgcgccgaggatacagctgtctattactgtgccaaggacgtgggggattataaagacgatgaatgggctaccgactactatgattttagcatcgcctacccggttcccgaccctagagcggtggtcggagccttcgatttttggggccaaggcacaatggtgaccgtgtcttcc

SEQ ID NO: 40395 - RNA, 432 nt, synthetic construct
  misc_feature 1..432: note = derived and/or modified sequence opt5 from anti-HIV_cap256-048-060420_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatggcctgggtgcgccaggcgcctggcaaggggcttgaatgggtcacagtgatcagcttcgctggagttaaaaagtattacgccgactccgtgaaaggcagatttacgatttctcgggataatagcaagggcaccctgtatctccagatgaactccctgcgcgccgaggacacagctgtctactattgtgccaaagatgtgggggacaccaagaaggatgaatgggctacagactactatgatcttagcatcgcctacccggttcaagacccccaggcggtggtcggagccttcgatatttggggccaggggaccatggtgacagtgtcttcc

SEQ ID NO: 40396 - RNA, 435 nt, synthetic construct
  misc_feature 1..435: note = derived and/or modified sequence opt5 from anti-HIV_cap256-048-060014_VR-Chain
  source 1..435: mol_type = other RNA
caggtgcaactggtcgagagcggcgggggagttgtgcagcccggcagatccctccggctgtcttgcgccgctagcgggttcaccttttccaattacggaatgcactgggtgcgccaggcccctggcaaggggcttgaatgggtcgcgctgatctctcatgacggaagcaataaaaacttcgctgattccgtgaagggcagatttacaatttctcgggacaatagcaaaaacacgctctatctgcagatgaactcccttcgcaccgaggatacagccatctactattgtgccaaggacctgggcggggaaagcgagattgaagagtggccgtctgattactatgacttcggaagagattaccccgttcctgacccccggggcgtggtcgggacctttgatttctggggacaaggcacaatggtgaccgtttccagc

SEQ ID NO: 40397 - RNA, 432 nt, synthetic construct
  misc_feature 1..432: note = derived and/or modified sequence opt5 from anti-HIV_cap256-048-059747_VR-Chain
  source 1..432: mol_type = other RNA
caggtgcaactggtcgagagcggcgggggagttgtgcagcccggcagatccctccggctgtcttgcgccgctagcgggttcacctttacacactacgccatggactgggtgcgccaggcgcctggaaagggccttgaatgggtcgctgtgatctcctctgatgggagctccaaagactatgccgattctgttaagggaagattcacgattagccgggacaactccaaaaataccctgagcctccagatgaactctctgcgcccggaggatacagccgtgtactattgtgctaaggaccttggcgcctccaaagatgacgaatgggctaccgattactatgacctgagcatcgcctaccccgtccatgatcctagagcggtggttggcgggtttgacatttggggacaaggcacaatggtgaccgtctcttcc

SEQ ID NO: 40398 - RNA, 432 nt, synthetic construct
  misc_feature 1..432: note = derived and/or modified sequence opt5 from anti-HIV_cap256-048-058393_VR-Chain
  source 1..432: mol_type = other RNA
caggtgcaactggtcgagagcggcgggggagttgtgcagcccggcgggtccctcagactgtcttgcgccgctagcggattcacctttaacacatacggcatgcactgggtgcggcaggcccctgggaagggacttgaatgggtcacgttcatccgctatgacggctccaatgagtactatgcggattctgtgaaaggcagatttaccattagccgggacaactccaagaatacactgtacctccagatgaactctctgagcgttgaagataccgctgtgtattactgtgccaaagaccttgggaagaataaagatgacgagtgggccacagattattacgacatctccattgcttacccggtccccgatcctcgcgccgtggttggagtgttcgacatctggggccaagggaccgtcgtgacagtgagctct

SEQ ID NO: 40399 - RNA, 432 nt, synthetic construct
  misc_feature 1..432: note = derived and/or modified sequence opt5 from anti-HIV_cap256-048-058159_VR-Chain
  source 1..432: mol_type = other RNA
caggtgcaactggtcgagagcggcgggggagttgtgcagcccggcagatccctccggctgtcttgcgccgctagcgggttcaccttttcctcttaccctatgcactgggtgcgccaggccccgggaaagggccttgaatgggtcgcggtgatcagcttcgctgggacaaataaatattacgcccattccgttaagggaagatttacgatttctcgggacaatagcaaaaacaccctgtatctccagatgaactccctgcgcgccgaggatacagctctttactattgtgccagagacctgcgggaaagcgagtgcgaagagtgggcttctgattactatgacttcggccgcgagtacccctgtcaagatcctagaggcgtggtcgggacctttgacatctggggacggggcacaatggtgaccgtttccagc

SEQ ID NO: 40400 - RNA, 432 nt, synthetic construct
  misc_feature 1..432: note = derived and/or modified sequence opt5 from anti-HIV_cap256-048-057127_VR-Chain
  source 1..432: mol_type = other RNA
gacgtgtacctggtcgagagcggcgggggactcgttcagcccggcgggtccctgagactttcttgcgtggccagcggaatcaccttctcctcttatggcatgcactgggtgcggcaagctcctgggaagggactggaatgggccgcgtttattcgctacgatggcagaaacaaatattacgctgacagcgtcaagggccggttcacaatctcccgcgataattctaaaaacacgctcagcctgcagatgaataaccttagagccgaggacaccgccgtgtattactgtgctaaggaagttggggataataaagacgatgagtgggcctccgactattacgatctgagcattgcttacccggtgcaggacccccgggccgtcgtgggaggctatgatatctgggggcagggaacaatggttaccgtgtcttcc

SEQ ID NO: 40401 - RNA, 432 nt, synthetic construct
  misc_feature 1..432: note = derived and/or modified sequence opt5 from anti-HIV_cap256-048-056251_VR-Chain
  source 1..432: mol_type = other RNA
gaggtgcagctggtcgaaagcggcgggggactcgttcaacccggcagatccctgcggctttcttgcgccgggagcggattcaccttttccaacttcggctttcactgggtgcgccaggctcctgggaagggactggagtgggtggccgcgatctctttcgctggctacaataaatattacgccgacagcgtcaagggcagatttacaatttcccgggaaaactctaataacatgctctatctgcagatgagctcccttcgcgccgaggatacggctgtgtactattgtgccaaagacctgagagaaagcgagtgcgaggaatgggcttctgattactatgacttcgggaaggattacccgtgtcaggacccccggggagttgtgggcacctttgatgtctgggggcatggatccctcgtgacagttagctct

SEQ ID NO: 40402 - RNA, 432 nt, synthetic construct
  misc_feature 1..432: note = derived and/or modified sequence opt5 from anti-HIV_cap256-048-055421_VR-Chain
  source 1..432: mol_type = other RNA
caggtgcaactggtcgagagcggcgggggagttgtgcagcccgccagatccctccggctgtcttgcgctgccagcggcttcatcttttccacctacgggatgcactgggtgcgccaggcgcctggaaagggccttgaatgggtcgctgtgatttctagcgacgggtcctctaaagattatgccgacagcgttaagggaagattcacaatctcccgggataacagcaaaaatacgctgtctctccagatgaactccctgcgcccggaggacaccgccgtgtactattgtgctaaggatcttggcgccagcaaagacgatgaatgggctacagactactatgatttttctattgcctaccccgtccaagaccctagagcggtggttggcgccttcgatatctgggggcagggaaccatggtgacagtctccagc

SEQ ID NO: 40403 - RNA, 432 nt, synthetic construct
  misc_feature 1..432: note = derived and/or modified sequence opt5 from anti-HIV_cap256-048-054989_VR-Chain
  source 1..432: mol_type = other RNA
caggtgcaactggtcgagagcggcgggggagttgtgcagcccggcgggtccctcagactgtcttgcgccgctagcggattcaccttttccacaaacggcatgcactgggtgcggcaggcccctgggaagggacttgaatgggtcgcgttcatccgctacgacggctctaataaatattacgctgatagcgtgaagggcagatttacgatttcccgggacaactctaaaaataccgtttatctgcagatgaacagcctccgcggggtggatacagccgtctactattgtgccaaggacctgggaggcggggaggtggaagagtgggctaccgattactatgactggtccatcgcctacccggttgaacatcccagagctgtggtcggagtgttcgatatttggggccaagggacaaaagtgaccgtcagctct

SEQ ID NO: 40404 - RNA, 435 nt, synthetic construct
  misc_feature 1..435: note = derived and/or modified sequence opt5 from anti-HIV_cap256-048-054759_VR-Chain
  source 1..435: mol_type = other RNA
caggtgcaactggtcgagagcggcgggggagttgtgcagcccggcagatccctccggctgtcttgcgccgctagcgggttctccttttctaagaacggaatgcactgggtgcgccaggcccctggcaaagggcttgaatgggtcgcgttcgtggcttttgacgagagcgataagtactatgccgactccgttaaaggaagattcaccatctctcgggataatagcaagaacacactgtccctccagatgaatagcctgcgcgtggaagacacggccgtctactattgtgctaaagaggtgggcgaaaacaaggatgacgagtgggccgctccggattactatgacttttctattgcctaccccgttcaagatcctagagcggtggtcggcgggttcgacatctggggacagggcaccatggtgacagtgtccagc

SEQ ID NO: 40405 - RNA, 432 nt, synthetic construct
  misc_feature 1..432: note = derived and/or modified sequence opt5 from anti-HIV_cap256-048-052573_VR-Chain
  source 1..432: mol_type = other RNA
caggtgaagctggtcgagagcggcgggggagttgtgcaacccggcagatccctccggctgtcttgcgccgctagcgggttctccttttctaactacgccatggactgggtgcgccaggcgcctggaaaaggccttgaatgggtcgctgtggttagctccgatgggtctaataagaactatgccgacagcgtgaaaggaagattcaccatctcccgggataatagcaagaacacagtctacctgcagatgaactctctccgcgccgaggacacggctgtgtattactgtgccaaagatctgggcgctaataaggacgatgaatgggccaccgactattacgattggtccattgcgtatccggttcacgaccccagagccgtggtcggcgtgtttgatatctgggggcagggaacacttgtgaccgtcagctct

SEQ ID NO: 40406 - RNA, 432 nt, synthetic construct
  misc_feature 1..432: note = derived and/or modified sequence opt5 from anti-HIV_cap256-048-051477_VR-Chain
  source 1..432: mol_type = other RNA
caggagcaactggtggaaagcggcgggggagtcgttcagcccggcagatccctccggctgtcttgcgccgctagcgggttcaccttttccaattacgccatgcactgggtgcgccaggcgcctggaaagggccttgagtgggtggctgccatgtctcatgacgggagcgataaatattacgccgactccgtcaagggaagattcacaatctctcgggataatagcaaaaacacgctgtatatgcagatgaactccctccgcgctgaagacaccgccgtgtactattgtgctaaggatcaaggcgagagcgaaaaagaggagtgggcctctgactactatgatctgtccattgcgtacccgatccaggaccccagagccatggttggcgcttttgatatttgggggcagggaacaatggtgaccgtcagctct

SEQ ID NO: 40407 - RNA, 432 nt, synthetic construct
  misc_feature 1..432: note = derived and/or modified sequence opt5 from anti-HIV_cap256-048-051299_VR-Chain
  source 1..432: mol_type = other RNA
caggtgcaactggtcgagagcggcgggggagttgtgcagcccggcagatccctccggctgtcttgcgccgctagcgggttcaccttttccacattcggaatgcactgggtgcgccaggcccctggcaaggggcttgaatgggtcgcgctgatctctcatgacggaaacaataaatactatgctgatagcctcaagggcagatttacgatttcccgggagaactctaaaaataccctgttccttcagatgaacagcctgcgcgccgaagacacatccgtgtactattgtgccaaggatctcggcgacagcgagtgcgaagagtgggcttctgattactatgactttgggaaagattacccgtgtctgcaccccagaggagttgtgggcaccttcgacttttgggggcatggaacaatggtcaccgtgtccagc

SEQ ID NO: 40408 - RNA, 432 nt, synthetic construct
  misc_feature 1..432: note = derived and/or modified sequence opt5 from anti-HIV_cap256-048-050815_VR-Chain
  source 1..432: mol_type = other RNA
caggtgcaactggtcgagagcggcgggggagttgtgcagcccggcgggtccctcagactgtcttgcgtggtcagcggattcaccttttcctcttacggcatgcactgggtgcggcaggcccctgggaagggacttgaatgggttagcttcatccgctttgacggcaactatgagtactatgtggattccgtcaaaggcagattcacaatttctcgggacaatagcaagaacacggtgtacctgcagatggattccctccgcgctgaagacaccgccgtttattactgtgcgaaagatgtgggggactataaggatgacgagtgggctacagattactacgactttagcatcgcctatccggtccccgatcctagagccgtggtgggagctttcgacttttggggccaagggaccatggtcacagtttcttcc

SEQ ID NO: 40409 - RNA, 432 nt, synthetic construct
  misc_feature 1..432: note = derived and/or modified sequence opt5 from anti-HIV_cap256-048-049884_VR-Chain
  source 1..432: mol_type = other RNA
caggtgcaactggtcgagagcggcgggggagttgtgcagcccggcagatccctccggctgtcttgcgccgctagcgggttctcctttaacacctacgccatgcactgggtgcgccaggcgcctggaaagggccttgaatggatggctctgatctcttatgacgggagcaataaatactatgtcgattccgtgaagggaagattcacaatttctcgggacaacagcaaaaatacgctctacctgcagatgaactcccttcgcgccgaggataccgccgtttattactgtgctaaggacctgggcggcaataaagatgacgaatgggccacagattattacgacctcagcatcgcttacccggtgcaagatcccagagtcgtggttgggatttttgacatctggggacagggcaccatggtgacagtctcttcc

SEQ ID NO: 40410 - RNA, 432 nt, synthetic construct
  misc_feature 1..432: note = derived and/or modified sequence opt5 from anti-HIV_cap256-048-049170_VR-Chain
  source 1..432: mol_type = other RNA
caggtgcaactggtcgagagcggcgggggagttgtgcagcccggcagatccctccggctgtcttgcgccgctagcgggttcatcttttcctcttacggaatgcactgggtgcgccaggcccctggcaaggggcttgaatgggtcgcggtgattagcggagacggcaccaaaaaggatttcgctgactccgttaaaggcagatttacaatctctaaggataacagcaaaaatatggtgtccctgcagatgaacagcctccgggccgaggacgccgctgtctattactgtgccaaggatctgggggaatctgacaatgaggaatggccgtccgattattacgacttcggacgcgattttacgggccaaaaccccagagctgtggttgggaccttcgacctttggggacagggcacaatggtgaccgtcagctct

SEQ ID NO: 40411 - RNA, 435 nt, synthetic construct
  misc_feature 1..435: note = derived and/or modified sequence opt5 from anti-HIV_cap256-048-048531_VR-Chain
  source 1..435: mol_type = other RNA
caggtgcaactggtcgagagcggcgggggagttgtgcagcccggcagatccctccggctgtcttgcgccgctagcgggttcaccttttcctcttacggacttcactgggtgcgccaggcccctggcaaggggctggaatgggtcgcgttcatcagctatgacggaaacaataaacattacgtggattccgttaagggcagatttacaatttctcgggacaacagcaaaaatacgctctatctgcagatgaactcccttcgcgctgaggataccgccgtgtactattgtgccaaggacctgggcggggaaagcgagatcgaagagtgggctacagattactatgacttctctattgcctacccggtcaaagagtccagaggagtggttggcatctttgatatgtgggggcaaggaaccatggtgacagtcagctct

SEQ ID NO: 40412 - RNA, 432 nt, synthetic construct
  misc_feature 1..432: note = derived and/or modified sequence opt5 from anti-HIV_cap256-048-048259_VR-Chain
  source 1..432: mol_type = other RNA
caggtgcaactggtcgagagcggcgggggagttgtgcagcccggcagatccctccggctgtcttgcgccgctagcgggttcaccttttccacatgtgccatgcactgggtgcgccaggcgcctggaaagggccttgaatgggtcgctgtgatctcttacgacgggagcaacaaatattacgttgattccgtgaagggaagattcacgatttctcgggacaatagcaaaaacaccctgtatctccagatgaactccctgcgcgccgaggatacagccgtctactattgcgctaaggaagtggacatcaataaagaggatgaatgggccagcgactactatgatttttctattgcttacccggttcaagaccccagagccgtggtcggcggcttcgatatctgggggcagggaaccatggtgacagtgtccagc

SEQ ID NO: 40413 - RNA, 432 nt, synthetic construct
  misc_feature 1..432: note = derived and/or modified sequence opt5 from anti-HIV_cap256-048-047313_VR-Chain
  source 1..432: mol_type = other RNA
caggtgcaactggtcgagagcggcgggggagttgtgcagcccggcagatccctccggctgtcttgcgccgctagcgggttcaccttttccacattcggaatgcactgggtgcgccaggcccctggcaaggggcttgaatgggtcgcggtgatctctcatgacggaaacaataaatactatgctgatagcgttaagggcagatttacgatttcccgggacaactctaaaaataccgtgtacctgcagatgaacagcctccgcgccgaggatacagccgtctattactgtgctaaggacctgggcgccaataaagatgacgaatgggctaccgattattacgacctttccgtggcctatccggttcccgatcctagagcggtggtcggggccttcgacgtgtggggacaaggcacaatggtgaccgtcagctct

SEQ ID NO: 40414 - RNA, 432 nt, synthetic construct
  misc_feature 1..432: note = derived and/or modified sequence opt5 from anti-HIV_cap256-048-046596_VR-Chain
  source 1..432: mol_type = other RNA
caggtgcaactggtcgagagcggcgggggagttgtgcagcccggcgggtccctcagactgtcttgcgccgctagcggattcaccttttcctcttacggcatgcactgggtgcggcaggcccctgggaagggacttgaatgggtcgcgttcatgcgctttgacggcagcaatagatattacggcgattccgtgaaagggcggttcacaatctctcgcgacaatagcaagaacacgctgtatctccagatgaactccctgagaaccgaggatgctgccctttactattgtgccaaagacatgcgggaatttgagtgcgaagagtgggctagcgattactatgacttcggacgcgattacccgtgtcaagaccccagaggcgttgtggggatttttgatatctggggacagggcacaatggtcaccgtgtcttcc

SEQ ID NO: 40415 - RNA, 432 nt, synthetic construct
  misc_feature 1..432: note = derived and/or modified sequence opt5 from anti-HIV_cap256-048-044781_VR-Chain
  source 1..432: mol_type = other RNA
caggtgcaactggtcgagagcggcgggggagttgtgcagcccggcagatccctccggctgtcttgcgccgctagcgggttcacctttacatcctacgccatccactgggtgcgccaggcgcctggaaagggccttgaatgggtcgctgtgatttcttatgacgggagcaaaaagaattacgccgattccgttaaaggaagattcacgatctctcgggacaatagcaagaacaccctgtatgtgcagatgaactccctccgcgccgaggatacagctgtctactattgtgccaaagaagtgggcgaggacaaggatgacgaatgggctagcgattactatgacctgtctattgcctacccggttcatgatcccagagcggtggtcggcgggtttgacatctggggacaaggcaccatggtgacagtgtccagc

SEQ ID NO: 40416 - RNA, 432 nt, synthetic construct
  misc_feature 1..432: note = derived and/or modified sequence opt5 from anti-HIV_cap256-048-042599_VR-Chain
  source 1..432: mol_type = other RNA
caggtgcaactggtcgagagcggcgggggagttgtgcagcccggcagatccctccggctgtcttgcgccgctagcgggttcaccttttccaactacggaatgcactgggtgcgccagacacctggcaaggggcttgaatgggtcgccgtgatctcttatgacggaagcaataaattctacgcggattccgttaagggcagatttacgatttctcgggacaacagcaaaaataccctgtatctccagatgtccagcctgcgcgctgatgacacagccgtgtactattgtgccaaggaggtcggcgaagataaagacgatgagtgggcttctgactactatgatctttccatcgcctacccggtgcatgaccccagagctgttgtcgggggattcgatatttggggccaagggaccatggtgacagtgagctct

SEQ ID NO: 40417 - RNA, 432 nt, synthetic construct
  misc_feature 1..432: note = derived and/or modified sequence opt5 from anti-HIV_cap256-048-041276_VR-Chain
  source 1..432: mol_type = other RNA
caggtgcaactggtcgagagcggcgggggagttgtgcagcccggcagatccctccggctgtcttgcgccgctagccgcttcaccttttcctcttacgccatgcactgggtgagacaggcgcctgggaagggacttgaatgggtcgctatcattagctatgacggctccaacaaatactatgccgattctgtgaaggggcggttcacaatcagccgcgacaattccaaaaacacgctgtttctccagatgaatagcctgagagccgaggataccgctctttactattgtgccaaggacctgggaggctacaaatctgatgaatgggctacagactattacgatctctccattgcctacccgatccaagacccccgggcggttgtgggcgccttcgatatttgggggcagggaaccatggtcacagtgagctct

SEQ ID NO: 40418 - RNA, 432 nt, synthetic construct
  misc_feature 1..432: note = derived and/or modified sequence opt5 from anti-HIV_cap256-048-040200_VR-Chain
  source 1..432: mol_type = other RNA
caggtgcaactggtcgagagcggcgggggagttgtgcagcccggccggtccctccggctgtcttgcgtggccagcgggttcaccttttcctctttcggaatgcactgggtccgccaggctcctggcaaggggcttgaatgggtggccgttatcagccatgacggacacaataaatactatgcggattccctgaagggcagatttacagtgtctcgggagaatagcaaaaacaccctcttcctgcagatgaactcccttcgcgctgaagacacgagcgtctactattgtgccaaggatctgggcgggggagagtgcgaagagtgggcctctgactactatgattttggcagagactacccgtgtctcacacccagaggggtggttggaaccttcgatatttggggccatgggacaaccgtgacagtctccagc

SEQ ID NO: 40419 - RNA, 432 nt, synthetic construct
  misc_feature 1..432: note = derived and/or modified sequence opt5 from anti-HIV_cap256-048-039061_VR-Chain
  source 1..432: mol_type = other RNA
gaggtgcagctgctgggcagcgggggaggcctggtccaacccgggggatcccttagactgacctgcgccgtttctggcttcacatttagctccttcgctatgtcttgggtgcggcaggcccctgggaagggactcgaatgggtggcgctgatcagctacgacggcacggataaatattacgctgactccgtcaagggccgctttaccatttctagagataacagcaaaaatacactttatctgcagatgaactccctccgggtggaggacaccgccatctaccactgtgccaaggatctcgggggaacaaaaagcgacgaatgggctaccgattattacgacctgtctattgcctatccgatccaggatcccggcgctgttgtgggggtcttcgacatttggggacaaggcacaatggtgaccgtttccagc

SEQ ID NO: 40420 - RNA, 432 nt, synthetic construct
  misc_feature 1..432: note = derived and/or modified sequence opt5 from anti-HIV_cap256-048-038515_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgtggttatctcttatgacgggagcaataaatactatgctgattccgtgaagggaagattcacgatttctcgggacaatagcaaaaacaccctgtttctccagatgaactccctgcgcgccgaggatacagccctttactattgtgctaaggacgtcggcgaatacaaaagcgatgagtgggccaccgactattacgatctgtctatcgcttacccgattcaagaccccagagccatggtgggcgcgttcgatatctgggggcagggaacaatggttaccgtgtccagc

SEQ ID NO: 40421 - RNA, 432 nt, synthetic construct
  misc_feature 1..432: note = derived and/or modified sequence opt5 from anti-HIV_cap256-048-038255_VR-Chain
  source 1..432: mol_type = other RNA
caggtgcaactggtcgagagcggcgggggagttgtgcagcccggcagatccctccggctgtcttgcgccgctagcgggttcaccctttcctcttacgccatgcactgggtgcgccaggcgcctggaaagggcctggaatgggtcgctgtgatcagctatgacgggtccaacaaatactatgccgattctgttaagggaagatttacaattagccgggacaattccaaaaacgccctctacctgcagatgaatagccttcgcgctgaggatacggccctgtattactgtgctaaggacctcagagaatatgagtgcgaagagtgggcctctgattactacgacttcggccgggattatccgtgtcaagacccccgcggcgtggtcgggacctttgatatctggggacagggcacaatggtgaccgtttccagc

SEQ ID NO: 40422 - RNA, 432 nt, synthetic construct
  misc_feature 1..432: note = derived and/or modified sequence opt5 from anti-HIV_cap256-048-038177_VR-Chain
  source 1..432: mol_type = other RNA
caggtgcaactggtcgagagcggcgggggagttgtgcagcccggcagatccctccggctgtcttgcgccgctagcgggttcacctttaatacatacggaatccactgggtgcgccaggcccctggcaaggggcttgaatgggtcgcgctgatttcctatgacggaacggataaatactatgctgactctgtgaagggcagattcaccatcagccgggataattccaaaaacacactctacctgcagatgaactctcttcgcgttgaggacaccgccatttatcattgtgccaaggatctgggcgggacaaaaagcgacgaatgggctaccgattactatgacctctccatcgcctacccgattcaagatcccggagctgtggtcggcgtgtttgacatctgggggcagggaacaatggttaccgtgagctct

SEQ ID NO: 40423 - RNA, 432 nt, synthetic construct
  misc_feature 1..432: note = derived and/or modified sequence opt5 from anti-HIV_cap256-048-035513_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatggcctgggtgcgccaggcgcctggcaaggggcttgaatgggtcacagtgatcagcttcgctggagttaaaaagtattacgccgactccgtgaaaggcagatttacgatttctcgggataacagcaagggcaccctgtatctccagatggacgggctgcgcccggaggatacagccctttactattgtgctaaagacctgggagaaagagagtgcgaagagtgggcctccgattactatgacttcggccgggattttccctgtcaagaccctcgcggggtcgtgggaaccttcgatatctggggccaggggacaatggttaccgtgagctct

SEQ ID NO: 40424 - RNA, 432 nt, synthetic construct
  misc_feature 1..432: note = derived and/or modified sequence opt5 from anti-HIV_cap256-048-034112_VR-Chain
  source 1..432: mol_type = other RNA
cagatgcaactggtggagagcggcgggggagtcgttcagcccggcagatccctccggctgtcttgcgccgctagcgggttcacctttaactcctacgccatgcactgggtgcgccaggcgcctggaaagggccttgaatgggtggctgtcatctcttatgacgggagcaataaatactatgccgattccgtgaagggaagattcacaatttctcgggacaacagcaaaaatacggtttacctgcagatgaactccctccgcggcgtggataccgccgtctattactgtgctaaggacctgggcgggggagaggtggaagagtgggccacagattattacgactggagcatcgcttacccggttgaacatcccagagccgtggtcggcgtgtttgatatttgggggcaaggaaccaaagtgacagtctcttcc

SEQ ID NO: 40425 - RNA, 432 nt, synthetic construct
  misc_feature 1..432: note = derived and/or modified sequence opt5 from anti-HIV_cap256-048-033983_VR-Chain
  source 1..432: mol_type = other RNA
caggtgcaactggtcgagagcggcgggggagttgtgcagcccggcgaatccctcagactgtcttgcgccgctagcgggttcaccctttcctctcacggaatccattgggtgcggcaggcccctggcaaggggctggagtgggtcgcgtttattagctccgacggatctaacaaaaattacggcgatagcgtgaagggccgcttcacaatctccagagacaacagcaaaaatacgctctttctgcagatgaactctcttcgggctgaagataccgccctgtattactgtgccaaggacgttggggagtataaatccgatgaatgggctacagactactatgatctcagcattgcctacccgatccaagacccccgcgctatggtgggagccttcgatatttggggccaggggaccatggtcacagtgtcttcc

SEQ ID NO: 40426 - RNA, 432 nt, synthetic construct
  misc_feature 1..432: note = derived and/or modified sequence opt5 from anti-HIV_cap256-048-032688_VR-Chain
  source 1..432: mol_type = other RNA
caggtgcaactggtcgagagcggcgggggagttgtgcagcccggcagatccctccggctgtcttgcgccgctagcgggttcatctttaactcctacggaatgcactgggtgcgccaggcccctggcaaggggcttgaatgggtcgcggtggttcatggagacggcggcaataaatattacgctgattctgtgaaggggagattcaccattagccgggacaactccaaaaatacactgtatctcgagatgaactctctgcgcgccgaagatacggccgagtactattgtgctaaggaccttggagaaagcgataaagaggagtggccgtccgactactatgattttggcagagacttcaccgggcaggtcccccgggccgtggttggagcttttgatatctggggccaagggacaatggtgaccgtcagctct

SEQ ID NO: 40427 - RNA, 432 nt, synthetic construct
  misc_feature 1..432: note = derived and/or modified sequence opt5 from anti-HIV_cap256-048-031092_VR-Chain
  source 1..432: mol_type = other RNA
caggtgcaactggtcgagagcggcgggggagttgtgcagcccggcagatccctccggctgtcttgcgccgctagcgggttctccttttacaatttcgccatggactgggtgcgccaggcgcctggaaagggccttgaatgggtcgctgtgatctctagcgatgggggaaataaaaactatgttgactccgtgaagggcagatttaccatttctcgggataatagcaaaaacacactgtacctccagatgaactccctgcgcgccgaggacacggccgtctattactgtgctaaggatcttggcgggaccaaagacgatgaatgggccacagactattacgatatcagcattgcttatccggtgcaagaccccagagccgttgcgggagccttcgatatctggggccaggggaccatggtgacagtctcttcc

SEQ ID NO: 40428 - RNA, 435 nt, synthetic construct
  misc_feature 1..435: note = derived and/or modified sequence opt5 from anti-HIV_cap256-048-030464_VR-Chain
  source 1..435: mol_type = other RNA
caggtgcaactggtcgagagcggcgggggactcgttaagcccggcgggtccctgagactttcttgcgaagccagcggattctcctttaccaactactatatgtcttggatccggcaggctcctggcaaagggctggagtgggtggccgtgattagcttcaatggacgcaacaagtactatgcggactttgtcaaaggcagattcacaatctcccgggataattctaagaacacgctcagcctgcagatgaactcccttcgcgtggaagacaccgctgtttactattgtgccaaagaggtgggcgaaaataaggatgacgagtgggccgctccggattactatgactttagcattgcctaccccgtccaggatcctagagctgtggttgggggattcgacatctggggccaagggacaatggtgaccgtctcttcc

SEQ ID NO: 40429 - RNA, 432 nt, synthetic construct
  misc_feature 1..432: note = derived and/or modified sequence opt5 from anti-HIV_cap256-048-030289_VR-Chain
  source 1..432: mol_type = other RNA
caggtgcaactggtcgagagcggcgggggagttgtgcagcccggcgggtccctcagactgtcttgcgccgctagcggattcaccttttcctcttacggcatgcactgggtgcggcaggcccctgggaagggacttgaatgggtcgcgttcatccgctatgacggcagcaacaaatactatgctgattccgtgaagggcagatttacaatttctcgggacaatagcaaaaacacggtttacctgcagatgaactccctccgcgtggaggataccgccgtctattactgtgccaaggacctgggggctaataaagatgacgaatgggccacagattattacgaccttagcgtggcttacccggttcccgatcctagagccgtggtcggagcgttcgacgtgtggggccaagggaccatggtgacagtctcttcc

SEQ ID NO: 40430 - RNA, 432 nt, synthetic construct
  misc_feature 1..432: note = derived and/or modified sequence opt5 from anti-HIV_cap256-048-030261_VR-Chain
  source 1..432: mol_type = other RNA
caggtgcaactggtcgagagcggcgggggagttgtgcagcccggcgggtccctcagactgtcttgcgccgctagcggattcaccttttccacattcggcatgcactgggtgcggcaggcccctgggaagggacttgaatgggtcgcggtgatctctcatgacggcagcaataaatactatgctgattccctgaagggccgctttacgatttctagagagaatagcaaaaacaccctctacctgcagatgaactcccttcggctggaagacacagccgtttatcactgtgccaaggatctcgggggaagcaaatctgacgagtgggctaccgattactatgacctgtccgtggcctacccggtccaagatccccgcgctgtggttggcgtgttcgacatctgggggcagggaacaatggtcaccgtgagctct

SEQ ID NO: 40431 - RNA, 432 nt, synthetic construct
  misc_feature 1..432: note = derived and/or modified sequence opt5 from anti-HIV_cap256-048-029362_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggggatcagcttcgctggaacaaataaatattacgccgactccgtgaagggcagatttacgatttctcgggataatagcaaaaacaccctgtatctccaaatgaactccctgcgcacagaggacgccgctctttactattgtgccaaggatatgagagagttcgaatgcgaagagtgggctagcgactactatgattttggccgggactacccgtgtcaggatccccgcggggttgtgggaatcttcgacatttggggccaggggaccatggtcacagtgtcttcc

SEQ ID NO: 40432 - RNA, 432 nt, synthetic construct
  misc_feature 1..432: note = derived and/or modified sequence opt5 from anti-HIV_cap256-048-027638_VR-Chain
  source 1..432: mol_type = other RNA
caggtgcaactggtcgagagcggcgggggagttgtgcagcccggcagatccctccggctgtcttgcgtggccagcgggttcatcttttcctcttacggcattcactgggtccgccaggctcctggaaaggggcttgaatgggtggccgttatcagcggagacggcaccaataaatattgtgcggattccgtgaagggcagattcacaatttctcgggacaatagcaaaaacacggtctttctgcagatgaactccctccgcgctgaggataccgccgtgttctactgcgccaaggacctgggggaaagcgataaagaggaatggccgtctgactattacgattttggaagagacttcacaggccaagttccccgggctgtggtcggggcctttgatatctggggacagggcaccatggtgacagtgtccagc

SEQ ID NO: 40433 - RNA, 432 nt, synthetic construct
  misc_feature 1..432: note = derived and/or modified sequence opt5 from anti-HIV_cap256-048-027613_VR-Chain
  source 1..432: mol_type = other RNA
gtgcagcaactggtcgagagcggcggggacgttgtgcagcccggaacctccctgagactgtcttgcgaagccagcggccttatcctgtccgggtacggactccactgggtgcggcaggctcctggcaaggggatggagtgggtcgccgtgatttcttatgatggaagcaataaatactatgcggactccgttaagggccgcttcacaatctctagagataatagcaaaaacacggtgtacctgcagatgaactcccttcggggcgtcgacaccgctgtgtattactgtgccaaggatctcgggggaggcgaagttgaggaatgggccacagactattacgattggagcaccgcttacccggtggagcatccccgcgccgtcgtgggggtgtttgacatttggggacaaggcacaaaagtcaccgtttcttcc

SEQ ID NO: 40434 - RNA, 432 nt, synthetic construct
  misc_feature 1..432: note = derived and/or modified sequence opt5 from anti-HIV_cap256-048-026627_VR-Chain
  source 1..432: mol_type = other RNA
caggtgcaactgctcggcagcgggggaggctccgtccagcccgggggatctctgagacttacctgcgccgttagcggcttcacattttcctctttcgctatgagctgggtgcggcaggcccctgggaagggactggagtgggtggcgtttatctcctctgacggcacgaacaaaaattacggcgatagcgtcaaggggcgcttcaccatttccagagacaacagcaaaaatacactctttctgcagatgaactctcttcgggctgaagataccgccctgtattactgtgccaaggacctcggaggctataaatccgatgagtgggctacagactactatgatctgagcatcgcctacccgattcaagacccccgcgctgtggttggggccttcgatatctggggacagggcaccatggtgacagtctcttcc

SEQ ID NO: 40435 - RNA, 432 nt, synthetic construct
  misc_feature 1..432: note = derived and/or modified sequence opt5 from anti-HIV_cap256-048-026239_VR-Chain
  source 1..432: mol_type = other RNA
cagatgcaactggtggagagcggcgggggagtcgttcagcccggcagatccctccggctgtcttgcgccgctagcgggttcacctttaactcctacgccatgcactgggtgcgccaggcgcctggaaagggccttgaatgggtggctgtcatctcttatgacgggagcaataaatactatgccgattccgtgaagggaagattcacaatttctcgggacaacagcaaaaatacgctgtacctccagatgaactccctgcgcaccgaggatgccgctctttattactgtgccaaggacatgagagaatttgagtgcgaagagtgggctagcgattattacgacttcggccgggattacccgtgtcaagacccccgcggcgttgtggggatctttgatatttggggacagggcacaatggtcaccgtgtcttcc

SEQ ID NO: 40436 - RNA, 432 nt, synthetic construct
  misc_feature 1..432: note = derived and/or modified sequence opt5 from anti-HIV_cap256-048-025518_VR-Chain
  source 1..432: mol_type = other RNA
caggtgcaactggtcgagagcggcgggggagttgtgcagcccggcagatccctccggctgtcttgcgccgtgagcgggttcaccttttcccagcacgctatgcattgggtccgccaggcccctggaaagggccttgaatgggtgacactgatctctaacgacgggacggagaaattctacgcggatagcgttaagggaagatttaccatttcccgggacaattctaaaaacacactctatctgcaaatgaatagcctttccgtggaagataccgctgtctactattgtgccaaggacctgggcaaaaacaaggatgacgagtgggccacagattactatgacatcagcattgcttacccggtgcccgatcctcgcgccgttgtgggcgtcttcgacatctgggggcagggaaccgtggtgacagtctcttcc

SEQ ID NO: 40437 - RNA, 432 nt, synthetic construct
  misc_feature 1..432: note = derived and/or modified sequence opt5 from anti-HIV_cap256-048-024854_VR-Chain
  source 1..432: mol_type = other RNA
caggtgcaactggtcgagagcggcgggggagttgtgcagcccggcagatccctcaccctgtcttgcgccgctagcgggttcacatttaataattacgacatgcactgggtgcggcaggcccctggaaagggccttgaatgggtcgcgttcacgcgctatgatgggtccaaccagtactatgctgactctgtgaccggaagatttacaatcagccgggataattccaaaaacaccgtttacctgcaaatgaactctctccgcggcgtggacacagccgtctattactgtgccaaggatctgggcgggggagaggtggaagagtgggctaccgactattacgattggagcattgcctacccggttgaacatcccagagctgtggtcggcgtgttcgacatctgggggcagggaacaaaagtgaccgtctccagc

SEQ ID NO: 40438 - RNA, 432 nt, synthetic construct
  misc_feature 1..432: note = derived and/or modified sequence opt5 from anti-HIV_cap256-048-024537_VR-Chain
  source 1..432: mol_type = other RNA
caggtgcaactggtcgagagcggcggggccgttgtgcagcccggaagatccctccggctgtcttgcgtggctagcggcttcaccttttcctcttacgccatgcactgggtccgccaggcgcctgggaagggacttgactgggtggctctgatcagctatgatggctccaacaaatacttcgccgactctgttaaggggagatttgccattagccgggataattccaaaaacacactctatctgcagatgaatagccttcgcccggaagacacggctgtgtactattgtgccaaggatctgggaggcggcgagtgcgaaacctgggcttctgactactatgatttcgggaaagactacccctgtctcgatcctagagacgtcgtgggaacatttgatatctgggttcaaggcaccctggtgacagtctccagc

SEQ ID NO: 40439 - RNA, 432 nt, synthetic construct
  misc_feature 1..432: note = derived and/or modified sequence opt5 from anti-HIV_cap256-048-021781_VR-Chain
  source 1..432: mol_type = other RNA
caggtgcacctggtcgagagcggcgggggactcgttaagcccggcgggtccctgagactttcttgcgaagccagcggattctccttttctaactacgctatggactgggtgcggcaagcccctggcaaagggctggagtgggtggcgttcgtcagctccgatggatctaataagaactatgctgacagcgtgaaaggccgctttaccatctccagagataatagcaagaacacagtttacctccagatgaactctctgcgggtggaagacacggccgtctattactgtgccaaagatcttggcgctaataaggacgatgagtgggccaccgactattacgatctgtccgtggcttatccggttcccgaccctcgcgccgtggtcggggcgttcgatgtgtggggacagggcacaatggtgaccgtcagctct

SEQ ID NO: 40440 - RNA, 432 nt, synthetic construct
  misc_feature 1..432: note = derived and/or modified sequence opt5 from anti-HIV_cap256-048-021758_VR-Chain
  source 1..432: mol_type = other RNA
caggtgcaactggtcgagagcggcgggggagttgtgcagcccggcagatccctccggctgtcttgcgccgctagcgggttcaccttttcccgctacggaatgcactgggtgagacaggcccctggcaaggggcttgaatgggtcgcggtgatctcttatgacggaagcaaagagtactatgctgattccgttaagggccggttcacaatttctcgcgacaacagcaaagatacgctgtacctccagatgtccagcctgagagtggaagacaccgccgtctattactgtgccaaggatgtgggcgctaataaagacgatgagtgggccacagactattacgatctttctatcgcttacccggttcccgaccctcgggccgtggtcggggcgtttgatatttggggacaaggcaccatggtgacagtgtccagc

SEQ ID NO: 40441 - RNA, 432 nt, synthetic construct
  misc_feature 1..432: note = derived and/or modified sequence opt5 from anti-HIV_cap256-048-020988_VR-Chain
  source 1..432: mol_type = other RNA
caggtgcaactggtcgaaagcggcgggggagttgtgcagcccggcagatccctccggctgtcttgcgaagccagcgctttcaccttttcctcttacgggatgcactgggtgcgccaggcccctggaaagggccttgagtgggtcacattcatcagctattccgggaacaataaatactatgcggactctgtgaagggaagatttacggttagccgggataactccaaaaataccctgtacctccagatgaacagcctgacatctgaagacaccgctgtgtattactgtgccaaggatcttggcggctccaaaacagacgagtgggggaccgattattacgagttctggaatgcctacccggtccaagacccccgcgtggttgtgggagcttttgatatttggggccatgggacaatggtcaccgtgagctct

SEQ ID NO: 40442 - RNA, 435 nt, synthetic construct
  misc_feature 1..435: note = derived and/or modified sequence opt5 from anti-HIV_cap256-048-020663_VR-Chain
  source 1..435: mol_type = other RNA
caggtgcaactggtcgagagcggcgggggagttgtgcagcccggcatgtccctcagactgtcttgcgccgctagcgggttcaccttttccaacttcggaatgcactgggtgcggcaggcccctggcaaggggcttgaatgggtcgcggtgatctctcatgacggaaataacaaatactatccggatagcgttcagggccgctttacaatttccagagaaaattctaagaacacgctgtacctccaaatgaatagcctgaaacccgaggacaccgctgtgtatttctgtgccaaggatcttggcggggagtccgaagtcgaggagtgggccagcgactactatgattttggacgggacatccctggccccgatcctcgcggggtggttggaacactggacatttggggccacgggaccatggtgacagtctcttcc

SEQ ID NO: 40443 - RNA, 432 nt, synthetic construct
  misc_feature 1..432: note = derived and/or modified sequence opt5 from anti-HIV_cap256-048-020590_VR-Chain
  source 1..432: mol_type = other RNA
caggtgcaactggtcgagagcggcgggggagttgtgcagcccggcggggtgcctagactcgcctgcgctgcctccggattcaccttttctagctacgcgatgcactgggtccggcaggctccgggcaaggggctggaatgggtgacagttatctcctatgacggatctaacaaatactatgccgatagcgtgaagggccgcttcacgatttccagagacaattctaaaaacaccctttacctgcagatgaatagcctccgggccgaggatacagctgtctattactgtgccaaggacctgggcgggaccaaagatgacgaatgggctacagattattacgacatctccattgcctaccccgtgcaagatcctcgcgcggttgccggagcttttgacatctggggccaggggaccatggtgacagtcagctct

SEQ ID NO: 40444 - RNA, 432 nt, synthetic construct
  misc_feature 1..432: note = derived and/or modified sequence opt5 from anti-HIV_cap256-048-019765_VR-Chain
  source 1..432: mol_type = other RNA
caggtgcaactggtcgagagcggcgggggagttgtgcagcccggcagatccctccggctgtcttgcgccgctagcgggttcatctttaccaactacgccatggactgggtgcgccaggcgcctggaaagggccttgaatgggtcgctgtgatttcctctgatgggagcaataaaaactatgccgactccgttaagggaagattcacaatctctcgggataatagcaaaaacacggtgtccctgcagatgaatagcctccgcgccgaggacaccgctgtctactattgtgccaaggatctgggcgactctaaaaaggatgaatgggctacagactactatgatctttccattgcctacccggtgcccgaccctagagcggttgtgggcgcctttgatatctgggggcaaggaaccatggtcacagtgagctct

SEQ ID NO: 40445 - RNA, 432 nt, synthetic construct
  misc_feature 1..432: note = derived and/or modified sequence opt5 from anti-HIV_cap256-048-019254_VR-Chain
  source 1..432: mol_type = other RNA
caggtgcaactggtcgagagcggcgggggagttgtgcagcccggcagatccctccggctgtcttgcgccgctagcgggttcacctcctctacatacgccatgcactgggtgcgccaggcgcctggaaagggccttgaatgggtcgctctgatcagctatgacgggacggataaatactatgccgactccgtgaagggaagatttaccatttctcgggataacagcaaaaatacactctacctgcagatgaactcccttcgcgttgaggacaccgccgtgtatcattgtgctaaggatctgggcggcaataaaccggacgaatgggccacagattactatgacctcagcatcgcttaccccgtccaagatcctagagccgtggttggggtgttcgacatttggggacagggcaccatcattacagtctcttcc

SEQ ID NO: 40446 - RNA, 432 nt, synthetic construct
  misc_feature 1..432: note = derived and/or modified sequence opt5 from anti-HIV_cap256-048-018073_VR-Chain
  source 1..432: mol_type = other RNA
caggtgcaactggtcgagagcggcgggggagttgtgcagcccggcagatccctccggctgtcttgcgccgctagcgggttctccctttctagctacgccatggactgggtgcgccaggcgcctggaaagggcctggaatgggtcgctgtgatctcctctgatgggaccaacaaatattacgccgacagcgttaagggaagatttacaattacgcgggataattccaaaaacaccctctatctgcagatgaatagccttcgcgtggaggacacagccctgtactattgtgctaaggatatgggcgaatctgagaaagaagagtgggcctccgactactatgatttcggcagagacatcccggggcaagatccccggggagaggtcggcagctttgacatttgggggcagggaaccatggtgacagtttcttcc

SEQ ID NO: 40447 - RNA, 432 nt, synthetic construct
  misc_feature 1..432: note = derived and/or modified sequence opt5 from anti-HIV_cap256-048-016775_VR-Chain
  source 1..432: mol_type = other RNA
gaggtgcagctggtcgagttcggcgggggactcgttcaacccggcagaagcctgcggctttcctgcgccgcttctgcctttaccttcagccactacgggatccattgggtgcgccaggcgcctggaaagggcctggaatgggtggctgtcatttcccacgacgggtctacaaaagattatgccgacagcgtgaagggaagatttacgatctcccgggataactctaaaaataccatgtacctccagatgaacagcctgcgcgccgaagacacagctgtttattactgtgccagagatcttggcgagtccgaaaccgaggagtgggctacagactattacgatttcagcattgcctatccggtgcagaatccccggggcgtcatcggggtgctggacatttggggactcggcaccatggttacagtgtcttcc

SEQ ID NO: 40448 - RNA, 432 nt, synthetic construct
  misc_feature 1..432: note = derived and/or modified sequence opt5 from anti-HIV_cap256-048-016069_VR-Chain
  source 1..432: mol_type = other RNA
caggtgcaactggtcgagagcggcgggggagttgtgcagcccggcagatccctccggctgtcttgcgccgctagcgggttcaccttttccaagtacgccatgcactgggtgcgccaggcgcctggaaaaggccttgaatgggtcgctttcgtggcctttgacgagtctgccaagttctatgctgatagcgttaaagggagatttacaatctcccgggacaactctaagaatacgctgagcctccagatgaactccctgcgcgccgaagataccgctgtgtactattgtgccaaagaggtcggagaaaataaggacgatgagtgggcgagcgactactatgatctttctattgcctacccggtgcatgaccccagagctgttgtgggcggcttcgatgtctgggggcaaggaacaatggtgaccgtgtccagc

SEQ ID NO: 40449 - RNA, 432 nt, synthetic construct
  misc_feature 1..432: note = derived and/or modified sequence opt5 from anti-HIV_cap256-048-015867_VR-Chain
  source 1..432: mol_type = other RNA
caggtgcaactggtcgagagcggcgggggagttgtgcagcccggcagatccctccggctgtcttgcagcgcctccgggttctcttttaccaactacgctatggactgggtgcgccaggcccctggaaagggccttgaatgggtcgcggtgatcagctccgatgggtctaataaaaactatgctgacagcgttaagggaagattcacaatttcccgggataatagcaaaaacacgctgtttctccagatgaactctctgcgcccggaggacaccgccgtgtacttctgtgccaaggatcttggcgctaataaagacgatgaatgggccacagactattacgatctgtccatcgcttatcccgtccacgaccctagagccgtggttggcatttttgatctctgggggcaaggaaccatggtgacagtcagctct

SEQ ID NO: 40450 - RNA, 432 nt, synthetic construct
  misc_feature 1..432: note = derived and/or modified sequence opt5 from anti-HIV_cap256-048-015673_VR-Chain
  source 1..432: mol_type = other RNA
caggtgcacctggtcgagagcggcgggggagttgtgcaacccggcagatccctccggctgtcttgcgccgctagcgggttcaccttttccaatttcgccatgggatgggtgcgccaggcgcctggcaaggggcttgaatgggtcgcttttatctctagcgacggaacaaataaaaactacggcgattccgtgaagggcagattcacgatttctcgggacaatagcaaaaacaccctgtttctccagatgaactccctgcgcgccgaggatacagccctttattactgtgctaaggacctcgggggatataaaagcgatgaatgggccaccgactactatgatctgtctatcgcttacccgattcaggaccccagagccgttgtgggcgcgttcgatatctgggggcaaggaacaatggtcaccgtgtccagc

SEQ ID NO: 40451 - RNA, 432 nt, synthetic construct
  misc_feature 1..432: note = derived and/or modified sequence opt5 from anti-HIV_cap256-048-015156_VR-Chain
  source 1..432: mol_type = other RNA
caggtgcaactggtcgagagcggcgggggagttgtgcagcccggcagatccctccggctgtcttgcgccgctagcgggttcaccttttccgtgtacgcccttcactgggtccgccagacacctggaaagggcctggaatgggtggcgctcatctcttatgacgggacgaacaaatactatgttgatagcgtgaagggaagattcaccatttcccgggacaattctaaaaacacactgtaccttcagatgaatagcctgaccgctgaggatacagccgtctattactgtgccaaggacctcggcggctccaaaaacgatgaatgggctaccgactattacgatctgagcatcgcctacccgattcaagacccccgcgctgtggccgggatctttgatgtttggggaagaggcacaatggtgaccgtctcttcc

SEQ ID NO: 40452 - RNA, 432 nt, synthetic construct
  misc_feature 1..432: note = derived and/or modified sequence opt5 from anti-HIV_cap256-048-014521_VR-Chain
  source 1..432: mol_type = other RNA
gaggtgcagctggtcgaaagcggcgggggactcgttcaacccggcagatccctgcggctttcttgcgccgctagcgggttcatcttttcctcttacggcattcactgggtgcgccagggacctgggaagggactggagtgggtggccctcatcagcggcgacggcaacaataaatattacgcggattccgtccaggggagattctctattagccgggacaactccaagaataccctgtatcttcagatgaacagcctgcgcgctgaagatacagccgtgtactattgtgccaaagacctcggagagtctgataaggaagagtggccgtccgactactatgattttggcagagacttcacggggcaagatccccgggctgttgtgggagtctttgacatctggggccaggggaccacagtgattgttagctct

SEQ ID NO: 40453 - RNA, 432 nt, synthetic construct
  misc_feature 1..432: note = derived and/or modified sequence opt5 from anti-HIV_cap256-048-014475_VR-Chain
  source 1..432: mol_type = other RNA
caggtgcaactggtcgagagcggcgggggagttgtgcagcccggcagatccctccggctgtcttgcgccgctagcgggttcacctttaatacattcggaatgcactgggtgcgccaggcccctggcaaggggcttgaatgggtcgcggtgatctcccatgacggaaataacaaatactatgctgattctctgaagggcagatttacgattagccgggaaaattccaaaaacaccctcttcctgcagatgaactctcttcgcgccgaggacacaagcgtttactattgtgccaaggatctgggccacggggagtgcgaagagtgggcttccgactactatgattttggaaaagactacccgtgtctcacccccagaggcgtggccgggacattcgatatctggggacatggcaccacagtcaccgtgagctct

SEQ ID NO: 40454 - RNA, 432 nt, synthetic construct
  misc_feature 1..432: note = derived and/or modified sequence opt5 from anti-HIV_cap256-048-013798_VR-Chain
  source 1..432: mol_type = other RNA
caggtgcaactggtcgagagcggcgggggagttgtgcagcccggcagatccctccggctgtcttgcgccgctagcgggttcacctttaataattacggaacacactgggtgcgccaggcccctggcaaggggcttgaatgggtcgcggtgatctccgactctggaagcaacaaatattacgctgattccgttaagggcagattcacgatttctcgggacaatagcaaaaacaccctgtatctccagatgaactccctgcgcgccgaggatacagccgtgtacttttgtgctaaggaccttggcgggagagaaaccgaggaatgggccagcgattattacgacttcggacgggattttccgggccaagaccagcgcgctgtcgccggggtgttcgatatgtggggacagggcacaatggttaccgtgtcttcc

SEQ ID NO: 40455 - RNA, 432 nt, synthetic construct
  misc_feature 1..432: note = derived and/or modified sequence opt5 from anti-HIV_cap256-048-013271_VR-Chain
  source 1..432: mol_type = other RNA
gaggtgcagctggtcgaaagcggcgggggagttgtgagacccggcgggtccctccggctgtcttgcgccgctagcggattcatcttttcctcttacggcattcactgggtgcgccaagcccctgggaagggacttgagtgggtcgcggtgatcagcggcgacggcaccaacaaatattgtgctgattccgttaaggggagattcacaatttctcgggacaatagcaaaaacacgctgtacctccagatcaattccctgcgcgtggaagataccgccgtctattactgcgccaaggaccttggcaaaaacaaggatgacgagtgggctacagattattacgacctgagcattgcctatccggtgcccgatcctagagctgttgtgggagtctttgacatctgggggcagggaaccgtggtgacagtctcttcc

SEQ ID NO: 40456 - RNA, 432 nt, synthetic construct
  misc_feature 1..432: note = derived and/or modified sequence opt5 from anti-HIV_cap256-048-013180_VR-Chain
  source 1..432: mol_type = other RNA
caggtgcaactggtcgagagcggcgggggagttgtgcagcccggcagatccctccggctgtcttgcgccgctagcgggttcaccttttccaagaatggaatgcactgggtgcgccaggcccctggcaaagggcttgaatgggtcgcgttcgtggcttttgacggatctgataagtactatgccgacagcgttaaaggcagattcgtgatctcccgggataattctaagaacacactgagcctccagatgaactccctgcgcgccgaggacacggctgtctactattgtgccaaagaagtgggcgaggataaggacgatgaatgggctagcgactactatgatctttctattgcctacccggttcatgaccccagagcggtggtcgggggatttgatatctggggccaagggaccatggtgacagtgtccagc

SEQ ID NO: 40457 - RNA, 432 nt, synthetic construct
  misc_feature 1..432: note = derived and/or modified sequence opt5 from anti-HIV_cap256-048-012148_VR-Chain
  source 1..432: mol_type = other RNA
caggtgcaactggtcgagagcggcgggggagttgtgcagcccggcagatccctccggctgtcttgcgccgctagcgggttcacctttacacactacgccatggactgggtgcgccaggcgcctggaaagggccttgaatgggtcgctgtgatctcctctgatgggagctccaaaaactatgccgactctgttagaggacggttcacgattagccgcgataattccaagaacaccctgagcctcctgatgaatggccttagaccggaggacacagccgtgtactattgtgctaaagatgtcggcgacgtgaagaacgatgaatgggccaccgactactatgatctgtctatcgcttaccccgttcaggaccctcgggccgtggtcggggcgtttgatttctggggacaaggcacaatggtgaccgtgtccgcc

SEQ ID NO: 40458 - RNA, 432 nt, synthetic construct
  misc_feature 1..432: note = derived and/or modified sequence opt5 from anti-HIV_cap256-048-011870_VR-Chain
  source 1..432: mol_type = other RNA
caggtgcaactggtcgagagcggcgggggagttgtgcagcccggcagatccctccggctgtcttgcgccgtgagcgggttcaccttttccttctacggaatgcactgggtccgccaggctcctggcaaggggcttgaatgggtggccgttatctcttatgacggaaacaataaatactatgtggatagcgtcaagggcagatttattatctcccgggacaactctaaaaatacactgtacctccagatgaacagcctgcgcgtggaggatacggcggtttattactgtgctagagaccttggcgaacgggagaatgaagagtgggccaccgattattacgacttctccattgcctacccgatcgaggggccccgcggagtggtcggcgtgtttgatatttgggggagaggaacaatggtgaccgtcagctct

SEQ ID NO: 40459 - RNA, 432 nt, synthetic construct
  misc_feature 1..432: note = derived and/or modified sequence opt5 from anti-HIV_cap256-048-011530_VR-Chain
  source 1..432: mol_type = other RNA
caggtgcacctggtcgagagcggcgggggagttgtgcaacccggcagatccctccggctgtcttgcgccgctagcgggttctcctttcgcaactacgccatggactgggtgagacaggcgcctggaaagggccttgaatgggtcgctgtgatctctagcgatgggtccgacaaacattatgccgattctgttcggggacgcttcaccattagcagagacaattccaagaacacactgtacctccagatgaatagcctgcgggtggaggatacggccgtctattactgtgctaaagaccttggcgccaacaagaatgatgaatgggctaccgactattacgatttttctatcgcctatccggtgcccgaccctcgcgcggttgtgggcgccttcgatatttgggggcagggaacaatggtcaccgtgtccagc

SEQ ID NO: 40460 - RNA, 432 nt, synthetic construct
  misc_feature 1..432: note = derived and/or modified sequence opt5 from anti-HIV_cap256-048-010968_VR-Chain
  source 1..432: mol_type = other RNA
caggtgcaactggtcgagagcggcgggggagttgtgcagcccggcagatccctccggctgtcttgcgccgctagcgggttcatcttttcctcttacggaatgcactgggtgcgccaggcccctggcaaggggcttgaatgggtcgcgctgattagcggagacggctccaacaaatattacgctgattctgtgaagggcagattcaccatcagccgggacaattccaaaaacacactctatctgcagatgaatagccttcgcgccgaggattctgccctgtacttttgtgctaaggacctcggggaatccgataaagaggaatggccgagcgactattacgatttcggaagagactttacgggccaagttccccgggccgtggtcgggattttcgatatgtggggacagggcaccatggtgacagtttcttcc

SEQ ID NO: 40461 - RNA, 426 nt, synthetic construct
  misc_feature 1..426: note = derived and/or modified sequence opt5 from anti-HIV_cap256-048-010224_VR-Chain
  source 1..426: mol_type = other RNA
gaggtgcacctggtcgaaagcggcggggacctcgttcagcccggaggctccctgagactttcttgcgtggtgagcgagttcaccttttcctcttacgggatgcattgggtccggcaagcccctggaaagggcctggaatgggtggctttcatccgctatgatgggagcaacaaatactatgccgactccgttaagggaagatttacaatttctcgggataatagcaaagtgtacctcgagatgaactccctgcgcgcggaagacacggctgtctattactgtgccaaggaggtgggcgagaataaagatgacgaatgggccagcgattattacgacctttctatcgcttacccgattcacgatcccagagccgttgtgggcgggttcgacatctggggacagggcaccatggtcacagtgtccagc

SEQ ID NO: 40462 - RNA, 432 nt, synthetic construct
  misc_feature 1..432: note = derived and/or modified sequence opt5 from anti-HIV_cap256-048-009749_VR-Chain
  source 1..432: mol_type = other RNA
caggtgcaactggtcgagagcggcgggggagttgtgcagcccggcagatccctccggctgtcttgcggggccagcggattcaccttttcctcttacgctatgcactgggtgcgccaggcccctggcagagggcttgaatgggtcgcgttcacaagctccgacggatctaacaagaattatggcgatagcgtgaaaggccggtttacgatctcccgcgacaacagcaagaataccctgttcctccagatgaactctctgagagctgaggatacagccctttactattgtgccaaagacgttggggaatacaagtccgatgagtgggctaccgactattacgatctgagcattgcctatccgatccaagacccccgggctatggtgggagcctttgatatttggggccaggggacaatggtcaccgtgtcttcc

SEQ ID NO: 40463 - RNA, 432 nt, synthetic construct
  misc_feature 1..432: note = derived and/or modified sequence opt5 from anti-HIV_cap256-048-009623_VR-Chain
  source 1..432: mol_type = other RNA
caggtgcaactggtcgagagcggcgggggagttgtgcagcccggcagatccctccggctgtcttgcgccgctagcgggttctccttttctaagtacggaatgcactgggtgcgccaggcccctggcaaagggcttgaatgggtcgcgttcgtggcttttgacgagggagataagtattacgttgacagcgtgaaaggcagattcaccatctcccgggataactctaagaatacactgagcctccagatgaactccctgcgcgccgaagacacggccgtctattactgtgctaaagaggtgggcgaaaataaggatgacgagtgggccagcgattattacgacctttctattgcttatccgatccatgatcccagagccgttgtcgggggatttgacatttggggccaagggaccatggtgacagtgtccagc

SEQ ID NO: 40464 - RNA, 432 nt, synthetic construct
  misc_feature 1..432: note = derived and/or modified sequence opt5 from anti-HIV_cap256-048-008234_VR-Chain
  source 1..432: mol_type = other RNA
caggtgcaactggtcgagagcggcgggggagttgtgcagcccggcagatccctccggctgtcttgcgccgctagcgggttcacctttacaaactacgccatggactgggtgcgccaggcgcctggaaagggccttgaatgggtcgctgtgatctcctctgatgggagcaataaaaactatgccgactccgttaagggaagattcacgatttctcgggataatagcaaaaacaccgtgtacctgcagatgtccagcctccgcccggaggacacagccgtctattactgtgctaaggatgtgggcgacaccaaatctgatgaatgggccacagactattacgatctgtccatcgcttatcccgttcaagaccctagagccgtggtcggcgcgtttgatatttgggggcagggaaccatggtgacagtgagctct

SEQ ID NO: 40465 - RNA, 432 nt, synthetic construct
  misc_feature 1..432: note = derived and/or modified sequence opt5 from anti-HIV_cap256-048-008149_VR-Chain
  source 1..432: mol_type = other RNA
caggtgcaactggtcgagagcggcgggggagttgtgcagcccggcagatccctccggctgtcttgcgccgctagcgggttcaccttttccgtgtacacaatgcactgggtccgccaggcccctggaaagggccttgaatgggtggcggttatctcttatgacgggagaaacaaatactatgctgatagcgtgaagggacggttcacgatttcccgcgacaattctaaaaacaccgtctacctgcagatgaatagcctcagagtggaggatacagccgtttattactgtgccaaggacctgggcgctaacaaagatgacgaatgggccaccgattattacgacctttccgtggcttacccggtccccgatcctcgggccgtggtgggcgcgtttgacgtctgggggcaaggaacaatggttaccgtgagctct

SEQ ID NO: 40466 - RNA, 432 nt, synthetic construct
  misc_feature 1..432: note = derived and/or modified sequence opt5 from anti-HIV_cap256-048-007301_VR-Chain
  source 1..432: mol_type = other RNA
caggtgcaactggtcgagagcggcgggggagttgtgcagcccggcagatccctccggctgtcttgcgccgctagcgggttctcctttaactactatgccatggactgggtgcgccaggcgcctggaaagggccttgaatgggtcgctgtgatctctagcgatgggagaaataaaaactacgccgactccgttaagggacggttcaccatttctcgcgataatagcaaaaacacactgtatctccagatgaactccctgagcgtggaggacacggccgtctactattgtgctaaggatcttggcaaaaataaggacgatgaatgggccaccgactactatgatatctctattgcttacccggtgcccgaccctagagccgttgtgggcgtctttgatatctgggggcaaggaacagtggtgaccgtctccagc

SEQ ID NO: 40467 - RNA, 432 nt, synthetic construct
  misc_feature 1..432: note = derived and/or modified sequence opt5 from anti-HIV_cap256-048-007174_VR-Chain
  source 1..432: mol_type = other RNA
caggtgcaactggtcgagagcggcgggggagttgtgcagcccggcagatccctccggctgtcttgcgccgctagcgggttcacctttaactcctacggaatggcctgggtgcgccaggcgcctggcaaggggcttgaatgggtcgctctgatctcttatgacggaagcaataaatactatgccgattccgtgagaggccggttcacaatttctcgcgacaacagcaaggatacgctctacctgcagatggacggccttagaccggaggataccgccctgtattactgtgctaaagacctcggggaatccgagtgcgaagagtgggccagcgattattacgactttggacgggattacccctgtctggctcctcgcggcgttcccgggacattcgacatctggggacaaggcaccatggtgacagtctcttcc

SEQ ID NO: 40468 - RNA, 432 nt, synthetic construct
  misc_feature 1..432: note = derived and/or modified sequence opt5 from anti-HIV_cap256-048-007079_VR-Chain
  source 1..432: mol_type = other RNA
caggtgcaactggccgagagcggcgggggagtcgttcagcccggcagatccctccggctgtcttgcgctgccagcgggttcaccttttccatctacggaatgcactgggtgcgccaggcgcctggcaaggggcttgaatgggtggctttcattctgtctgacggaacagataaatatagcgccgactccgtcaagggcagatttacgatctctcgggataacagcaaaaataccctctacctgcagatgaactcccttcgcgccgaggacacagctgtgtattactgtgccaaggatctgggcaaagctaaggacgatgaatgggccaccgactattacgatttcagcattgcgtatccggttcatgaccccagaggggtggccggaatctttgatatttggggccaagggacaatggtcaccgtgtcttcc

SEQ ID NO: 40469 - RNA, 432 nt, synthetic construct
  misc_feature 1..432: note = derived and/or modified sequence opt5 from anti-HIV_cap256-048-007033_VR-Chain
  source 1..432: mol_type = other RNA
caggtgcaactggtcgagagcggcgggggagttgtgcagcccggcagatccctccggctgtcttgcgccgctagcgggttcaccttttccaacttcggatttcactgggtgcgccaggcccctggcaaggggcttgaatgggtcgcggctatctctttcgccggaaataacaaatactatgccgacagcgtgaagggcagatttacaatttcccgggaaaattctaaaaacatcctgtacctccagatgaatagcctgcgcggcgaggatacggctgtttattactgtgccaaggaccttagagagttcgaatgcgaggagtgggcttccgattattacgactttgggcgggattatccgtgtcaagacccccgcggagtggtcggcaccttcgatgtgtgggggcatggaagcctggttacagtgtcttcc

SEQ ID NO: 40470 - RNA, 432 nt, synthetic construct
  misc_feature 1..432: note = derived and/or modified sequence opt5 from anti-HIV_cap256-048-006128_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgggacggataaatactatgccgacagcgtgaagggaagattcaccatttcccgggataactctaaaaatacactctacctgcagatgaacagccttcgcgttgaggacaccgccgtgtatcattgtgctaaggatctgggcggctccaaaagcgacgaatgggccacagattactatgactggtctatcgcttacccggtccacgatcccagagccgtggttggggtgtttgacatttggggacaaggcaccctcgtcacagtgtccagc

SEQ ID NO: 40471 - RNA, 432 nt, synthetic construct
  misc_feature 1..432: note = derived and/or modified sequence opt5 from anti-HIV_cap256-048-005999_VR-Chain
  source 1..432: mol_type = other RNA
caggtgcaactggtcgagagcggcgggggagttgtgcagcccggcagatccctccggctgtcttgcgccgctagcgggttcacctttacacacttcgccatggactgggtgcgccaggcgcctggaaagggccttgaatgggtcgctgtgatctcctctgatgggagctccaaaaactacgccgactctgttaagggaagatttacgattagccgggataattccaaaaacaccgtgagcctgcagatgaactctctccgcccggaggacacagccgtctattactgtgctaaggatctgggcgccaataaagacgatgaatgggctaccgactattacgatctttccatcgcctatcccgtgcctgaccccagagcggttgtgggcgccttcgatatttgggggcaaggaacaatggtcaccgtgagctct

SEQ ID NO: 40472 - RNA, 432 nt, synthetic construct
  misc_feature 1..432: note = derived and/or modified sequence opt5 from anti-HIV_cap256-048-005394_VR-Chain
  source 1..432: mol_type = other RNA
caggtgcaactggtcgagagcggcgggggagttgtgcagcccggcagatccctccggctgtcttgcgccgctagccagttcaccttttcctcttacgggatgcactgggtgcgccaggcccctggaaagggccttgaatgggtcgcggctatcagcttcgccgggacaaataaatattacgccgactccgtgaagggaagatttacgatttctcgggataatagcaaaaacgctctgtatctccaaatgaactccctgcgcgccgaggacaccgctctttactattgtgccaaggatctgagagagttcgaatgcgaagagtgggcgagcgactactatgattttggccgggactacccgtgtcaggatccccgcggcgttgtggggacattcgacatctggggacagggcaccatggtcacagtgtcttcc

SEQ ID NO: 40473 - RNA, 432 nt, synthetic construct
  misc_feature 1..432: note = derived and/or modified sequence opt5 from anti-HIV_cap256-048-004226_VR-Chain
  source 1..432: mol_type = other RNA
caggtgcaactggtcgagagcggcgggggagttgtgcagcccggcagatccctccggctgtcttgcgccgctagcgggttcacctttaacaagcacggaatgcattgggtgcgccaggcccctggcaaagggcttgaatgggtcgcgttcgtggcttttgacggatccgataagtactatgccgactctgttaaaggcagattcacaatcagccgggataattccaagaacacgctgtctctccagatgaataacctgcgcgccgaggacaccgctgtgtactattgtgccaaagaagtcggcgataataaggacgatgagtgggctagcgactactatgatctttccattgcctacccggtgcaagaccccagagcggttgtcgggggatatgatatctggggccaggggacaatggtgaccgtgagctct

SEQ ID NO: 40474 - RNA, 432 nt, synthetic construct
  misc_feature 1..432: note = derived and/or modified sequence opt5 from anti-HIV_cap256-048-004097_VR-Chain
  source 1..432: mol_type = other RNA
caggtgcaactggtcgagagcggcgggggagttgtgcagcccggcagatccctccggctgtcttgcgccgctagcgggttcaccttttccgcctacacagtgcactgggtccgccaggcgcctggaagaggccttgaatgggtgtctgttatcagctatgacgatcggaacaagtactatgctcattccgtgaaagggcgcttcacgatttctagagacaatagcaagaacaccctgtacctccagatgaactccctgcggcgcgaggatacagccgtctattactgtgccaaagaccttggagctaataaggatgacgaatgggccaccgattattacgacctgagcatcgcttacccggtgcccgatcctagagccgttgtgggcgcgtttgacatttggggccaagggacaatggtcaccgtgtcttcc

SEQ ID NO: 40475 - RNA, 432 nt, synthetic construct
  misc_feature 1..432: note = derived and/or modified sequence opt5 from anti-HIV_cap256-048-003289_VR-Chain
  source 1..432: mol_type = other RNA
caggtgcaactggtcgagagcggcgggggagttgtgcagcccggcagatccctccggctgtcttgcgccgctagcgggttcaccttttccaagtacggaatgcactgggtgcgccaggcccctggcaaagggcttgaatgggtcgcgttcgtggcttttgacggatctagcaagaactatgccgattccgttaaaggcagattcacaatctctcgggacaatagcaagaacacggtgtccctgcagatgaatagcctccgcccggaggataccgccgtctactattgtgctaaagacctgggcgccaacaaggatgacgaatgggctacagattactatgacctttctattgcctaccccgtgcctgatcccagagcggttgtgggggcctttgacatctggggacaaggcaccatggtcacagtgtccagc

SEQ ID NO: 40476 - RNA, 432 nt, synthetic construct
  misc_feature 1..432: note = derived and/or modified sequence opt5 from anti-HIV_cap256-048-002601_VR-Chain
  source 1..432: mol_type = other RNA
caggtgcaactggtcgagagcggcgggggagttgtgcagcccggcagatccctccggctgtcttgcgccgctagcgggttctcctttaacaattacgccatggactgggtgcgccaggcgcctggaaagggccttgaatgggtcgctgtgatctctagcgatgggagaaacaaaaattatgccgagtccgttaagggacggttcaccatttctcgcgacaacagcaaaaatacagtgtacctgcagatgaactccctcagagccgaagatacggctgtctattactgtgccaaggacgtgggcgataccaaaaaggacgagtgggctacagattattacgacctgagcatcgcctatccggttcaagatccccaggcggtggtcggcgcctttgacatttgggggcagggaaccatggtgacagtgtcttcc

SEQ ID NO: 40477 - RNA, 432 nt, synthetic construct
  misc_feature 1..432: note = derived and/or modified sequence opt5 from anti-HIV_cap256-048-002129_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctctgatctcttatgacgggacggataaatactatgccgacagcgtgaagggaagattcattatctcccgggataattctcgcagcaccctctacctgcagatgaactcccttagactggaggacacagccgtttatcattgtgctaaagatctcggcggcagcaagtctgacgaatgggccaccgattactatgacctgtccgtggcttacccggtccaagatccccgggccgtggttggggtgtttgacatttggggacagggcacaatggtcaccgtgagctct

SEQ ID NO: 40478 - RNA, 432 nt, synthetic construct
  misc_feature 1..432: note = derived and/or modified sequence opt5 from anti-HIV_cap256-048-001875_VR-Chain
  source 1..432: mol_type = other RNA
caggtgcaactggtcgagagcggcgggggagttgtgcagcccggcgggtccctcagactgtcttgcgccaccagcggacttacattctccaactacggcatgcactgggtgcggcaggctcctgggcgcggactggaatgggtcgcctttacgagatatgacggcacctacaattattacgcggattctgtgaagggccggttcacaatcagccgcgacaactccaaagggaccctctatctgcagatggatggacttagaccggaggacacagctctgtactattgtgccaaggatctcggcgaacgggagtgcgaagagtgggcctctgactactacgattttgggcgcgacttcccctgtcaagatcctagaggagttgtgggcacctttgacatttgggggcagggaacaatggtcaccgtgagctcc

SEQ ID NO: 40479 - RNA, 432 nt, synthetic construct
  misc_feature 1..432: note = derived and/or modified sequence opt5 from anti-HIV_cap256-048-001302_VR-Chain
  source 1..432: mol_type = other RNA
caggtgcaactggtcgagagcggcgggggagttgtgcagcccggcagatccctccggctgtcttgcgccgctagcgggttcaccttttcctactctggaatgcactgggtgcgccaggcccctggcaaggggatggaatgggtcgcggtgatcagctatgacggatccaacaaatactatgctgattctgttaagggcagattcacaattagccgggacaattccaaaaacacggtgtaccttcagatgaatagcctgcgcggcgtcgataccgccgtgtattactgtgccaaggacctcgggggaggcgaggttgaagagtgggctacagattattacgactggtctatcgcctacccggtggaacatcccagagctgtcgtgggggtgtttgatatttggggacaaggcaccaaagtcacagtttccagc

SEQ ID NO: 40480 - RNA, 432 nt, synthetic construct
  misc_feature 1..432: note = derived and/or modified sequence opt5 from anti-HIV_cap256-048-001203_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctatcattagctatgacgggacaatcaaatactatgccgattccgtgaagggaagattcacgatttctcgggacaacagcaaaaataccgtttccctgcagatgaacagcctccgcccggaggatacagccgtgtactattgtgctaaggacgtcggcgccaataaagatgacgaatgggctaccgattactatgacctgtctatcgcctaccccgtgcctgatcccagagcggttgtgggcgcctttgacatttgggggcaaggaacaatggtcaccgtgtccagc

SEQ ID NO: 40481 - RNA, 432 nt, synthetic construct
  misc_feature 1..432: note = derived and/or modified sequence opt5 from anti-HIV_cap256-048-000383_VR-Chain
  source 1..432: mol_type = other RNA
caggtgcaactggtcgagagcggcgggggagttgtgcagcccggcagatccctccggctgtcttgcaccgccagcgggttcacatttaatcactacgctatggactgggtgcgccaggcccctggaaagggccttgaatgggtcgcggtgatctcctctgatgggagcgacaaaacgtatgctgattccgttaagggaagattcaccatttctcgggacaatagcaaaaacacagtgtacctgcagatgaactccctccgcgccgaggataccgccgtctattactgtgctaaggacgtgggcggcagcaaagatgacgaatgggccacagattattacgacctgtctatcgcttatccggttcccgatcctagagccgtggtcggggcgtttgacttctggggacccggcaccatggtgacagtgtccagc

SEQ ID NO: 40482 - RNA, 432 nt, synthetic construct
  misc_feature 1..432: note = derived and/or modified sequence opt5 from anti-HIV_cap256-038-261791_VR-Chain
  source 1..432: mol_type = other RNA
caggtgcaactggtcgagttcggcgggggagttgtgcagcccggcgggagcctcagactgtcctgcgccgcttttggattcaccatctctagctacggcatgcactgggtgcggcaggcccctgggaagggacttcagtgggtcgcgtttattcgctatgacgaatcctctaaattctacgctgatagcgtgaagggcagatttacaatctcccgggacaactctgagaatacgctgtatctccaaatgaacagcctgcgcgccgaagataccgccgtttactattgtgctaaagaccttggcgagtccgaaaatgaggagtgggccacagattactatgacttcagcattgcttacccggggcaggatcccagaggagtggtcggcatctttgacatttgggggcagggaaccatggtgacagtttcttcc

SEQ ID NO: 40483 - RNA, 432 nt, synthetic construct
  misc_feature 1..432: note = derived and/or modified sequence opt5 from anti-HIV_cap256-038-241540_VR-Chain
  source 1..432: mol_type = other RNA
caggtgcaactggtcgagagcggcgggggagttgtgcagcccggcagatccctccggctgtcttgcgccgctagcgggttcaccttttccaactctgccatgcactgggtgcgccaggcgcctggaaagggccttgaatgggtcgctctgatcagctacgttgggggaaatatttattacgccgactccgtgaaaggcagattcacagtgtctcgggataacagcaagaaaacgctctatctgcagatgaactcccttcgcgtcgaggacaccgccgtgtactattgtgttaaggatgtgggcgaaagcgagaatgaagagtgggcttctgactactatgattttgggagagactacccgggacaagatacacgggccgtcgtgggcgctttcgacatctgggggcagggaaccatggtgacagtctccagc

SEQ ID NO: 40484 - RNA, 432 nt, synthetic construct
  misc_feature 1..432: note = derived and/or modified sequence opt5 from anti-HIV_cap256-038-235677_VR-Chain
  source 1..432: mol_type = other RNA
ctggtgcagctcgtcgagagcggcgggggagttgtgcaacccggcgggtccctgagactttcttgcgccgctagcggattccggttttcctcttacggcatgcactgggtgcgccaggcccctgggaagggactggaatgggtcgcgttcatcagatatgacggcagctttaaagattacgctgactccgtgcggggccgcttcaccatttctagagagaacagcaagaatacactctatctgcagatgaactcccttcggacggatgacaccgccgtttactattgtgccaaagatctgggggaaagcgagacagaagagtggccgtctgactactatgattttggacgcgactaccccggccaggatcctagaggggtggtcggaaccttcgacatctggggccatgggacaatggtgaccgtttccagc

SEQ ID NO: 40485 - RNA, 435 nt, synthetic construct
  misc_feature 1..435: note = derived and/or modified sequence opt5 from anti-HIV_cap256-038-234314_VR-Chain
  source 1..435: mol_type = other RNA
gaggtgcagctgctcgaaagcggcgggggactggtccaacccggcgggtcccttagactgtcttgcgccgctagcggattcaccttttcccggtacgccatgtcttgggttcgccaggcgcctggcaaggggctcgagtgggtggctgtgatcagctatgacggatccaacaaatactatgccgattctgtcaagggcagattcacaattagccgggacaattccaaaaacacgctgtaccttcagatgaatagcctgcgcgccgtggataccgctgtttattactgtgccaaggacctcggcgaaggggagaacgaagagtgggctacagattattacgacttttcttactggctgccgtgccccaaatatcacggagcctggctggagctcctgtacatctggggccaggggaccatggtgacagtctccagc

SEQ ID NO: 40486 - RNA, 432 nt, synthetic construct
  misc_feature 1..432: note = derived and/or modified sequence opt5 from anti-HIV_cap256-038-234273_VR-Chain
  source 1..432: mol_type = other RNA
gaggtgcagctggtcgaaagcggcgggggactcatccaacccggcgggtccctgagactttcttgcgccgctagcggattcaccgtttccacaaattttatgtcttgggtgcggcaggcccctggcaaggggctggagtgggtggcggtcattagctacgacggaaataacaaatattacgctgattccgtgaagggccgcttcacgatctctagagaaaatagcaaaaacaccctctatctgcagatgaactcccttcggacagacgataccgccgtttactattgtgccaaggacctgggcgagagcgaaacagaggagtggccgtctgattactatgactttgggcgcgattaccccggacaggaccctagaggcgtggtcgggaccttcgatatttggggacacggcacaatggtgaccgtttccagc

SEQ ID NO: 40487 - RNA, 432 nt, synthetic construct
  misc_feature 1..432: note = derived and/or modified sequence opt5 from anti-HIV_cap256-038-223164_VR-Chain
  source 1..432: mol_type = other RNA
gaggtgcagctggtcgaaagcggcgggggactcgttcggcccggcgggtccctgcggctttcttgcgccgctagcggattctccctgggctcttactggatgacctgggtgcgccaagcccctgggaagggactcgagtgggtggcggtcatcagctatgacggctccaacaaatactatgctgattctgtgaagggcagatttacaattagccgggacaattccaaaaacacgctgtaccttcagatgaatagcctgcgcgccgaagataccgccctctattactgtgctaaggacctgggggagtctgaaaacgaggagtgggcctccgattattacgacttcggaagagattacccgggccaggaccccagaggggttgtgggaacatttgatatctggggccaggggaccatggtcacagtgagctct

SEQ ID NO: 40488 - RNA, 432 nt, synthetic construct
  misc_feature 1..432: note = derived and/or modified sequence opt5 from anti-HIV_cap256-038-220289_VR-Chain
  source 1..432: mol_type = other RNA
gaggtgcagctggtcgaaagcggcgggggactcgttcaacccggcgggtccctgagactttcttgcaccgccagcggattcacattttcctcttacgagatgaattgggtgcggcaggctcctggcaaggggccggaatgggtggccgtcatcagctatgacggaaataacaaatactatgcggattccgtgaagggccgcttcacgatttctagagagaatagcaaaaacaccctgtacctccagatgaactccctgcggacagacgataccgctgtttattactgtgccaaggaccttggcgaaagcgagacagaggaatggccctctgattattacgactttgggcgcgattaccctggacaggaccccagaggcgtggtcgggaccttcgatatctggggacacggcacaatggtgaccgtttccagc

SEQ ID NO: 40489 - RNA, 432 nt, synthetic construct
  misc_feature 1..432: note = derived and/or modified sequence opt5 from anti-HIV_cap256-038-220020_VR-Chain
  source 1..432: mol_type = other RNA
caggtgcaactggtcgagagcggcgggggagttgtgcagcccggcagatccctccggctgtcttgcgccgctagcgggttcaccttttcccgcaacgccatgcactgggtgagacaggcgcctggaaagggccttgaatgggtcgctctgatctcttacgacgggagcaataaatattacgtggattccgttaagggacggttcacaatttctcgcgacaacagcaaaaatacgctctatctgcagatgaactcccttagagccgatgacaccgccgtgtactattgtgctaaggatctgggcgagagcgaaacagaggaatggggcaccgactactatgatttttctacagggtacccggtccaagacccccggggagtggttggcgccttcgatatctgggggcagggaaccatggtgtccgtcagctct

SEQ ID NO: 40490 - RNA, 432 nt, synthetic construct
  misc_feature 1..432: note = derived and/or modified sequence opt5 from anti-HIV_cap256-038-216853_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacaaatactatgccgattctgttaagggaagattcacaattagccgggacaattccaaaaacacgctgtacgtgcagatgaatagcctccgcgccgaggataccgctgtctattactgtgccagagacctgggcgaatctgagacagaagagtggccgtccgattattacgactttggccgggattaccccgggcaagaccctcgcggagtggttggcaccttcgatatctgggggcatggaacaatggtgaccgtcagctct

SEQ ID NO: 40491 - RNA, 432 nt, synthetic construct
  misc_feature 1..432: note = derived and/or modified sequence opt5 from anti-HIV_cap256-038-213466_VR-Chain
  source 1..432: mol_type = other RNA
gaggtgcagctggtcgaaagcggcgggggactcgttcaacccggcagatccctgcgggtgtcttgcgccgctagcgggttcacctttgaggactacgccatgcactgggtgcgccaggcgcctggaaagggccttgaatgggtcgctgtgatctccgatgacgggaacaataaatattacgccgattctgttaagggaagattcacaattagccgggacaactccaaaaatacgctgtatctccagatgaactctctgcgcgtggaggataccgccgtctactattgtgtgaaggacgttggcgaaagcgagaatgaggaatgggcttccgattactatgactttggcagagattacccggggcaggacacacgggccgtggtcggagctttcgatatctggggccaagggaccatggtgacagtgagctct

SEQ ID NO: 40492 - RNA, 432 nt, synthetic construct
  misc_feature 1..432: note = derived and/or modified sequence opt5 from anti-HIV_cap256-038-213212_VR-Chain
  source 1..432: mol_type = other RNA
caggtgcaactggtcgagagcggcgggggagttgtgcagcccggcgggtccctcagactgtcttgcgccgctagcggattcatcttttccgactacggcatgcactgggtgcggcaggcccctgggaagggacttgaatgggtcgcgtctatttggcatgatggcagcaaaaagtattacgctgactccgtgaaaggccgcttcaccatctctagagagaacagcaagaatacactgtatctccagatgaactccctgcgggccgaagatacggccgtttaccactgtgctaaagaccttggggagagcgaaattgaggagtggacctctgattattacgactttggacgcgattatccgggccaagaccccagaggggtgttcggaacatttgatatctggggccatgggaccatggtcacagtgtccagc

SEQ ID NO: 40493 - RNA, 432 nt, synthetic construct
  misc_feature 1..432: note = derived and/or modified sequence opt5 from anti-HIV_cap256-038-213120_VR-Chain
  source 1..432: mol_type = other RNA
caggtgcacctggtcgagagcggcgggggactcgttaagcccggcgggtccctgagactttcttgcgccgctagcggattcaccttttccgactactatatgatctggattcggcaagcccctggcaaagggctggaatgggtggcggtgatctctagcgatggatccaacaagaattacgctgactctgtcaaaggccgcttcacaattagcagagataactccaagaatacgctctatctgcagatgaacagccttcgggccgaggacaccgccgtgtactattgtgctaaagatctgggcgaatctgagaatgaagagtgggccacagactactatgattttgctaccgggtacccggttcaggacccccgcgccgtggtcggagcgttcgatatctggggccaggggacaatggtgaccgtttcccct

SEQ ID NO: 40494 - RNA, 432 nt, synthetic construct
  misc_feature 1..432: note = derived and/or modified sequence opt5 from anti-HIV_cap256-038-212592_VR-Chain
  source 1..432: mol_type = other RNA
ctggtgcagctcgtcgagagcggcgggggagttgtgcaacccggcaagtccctgagactttcttgcgccgctagcgggttcaccttttcctcttacgccatgcactggatccggcaggcgcctggaaaaggcctggaatgggtggctgtcattagcgacgatgggtccatcaagaactatgccgactctgtgaaaggacgcttcacaattagcagagatacgtccaagaaactcatgtacctgcagatgaatagcctttctgccaacgacaccgctgtttattactgtgccaaggatctgggcgagcgggaaaatgaggaatgggcttccgactattacgattttggccgcgactatccggggcaggatcccagaggagtggtcggcagcatcgacacatgggggcatggaaccatggtgacagtttcttcc

SEQ ID NO: 40495 - RNA, 432 nt, synthetic construct
  misc_feature 1..432: note = derived and/or modified sequence opt5 from anti-HIV_cap256-038-211790_VR-Chain
  source 1..432: mol_type = other RNA
gagctgcagctcgtggaaagcggcgggggactggtccaacccggcgggtcccttagactgtcttgcgttgtgagcggattcaccgtgtccacaaactacatctcttgggtccggcaggcccctggcaaggggctcgagtgggtggctgttattagctatgacggatccaataaatactatgccgattctgtgaagggccgctttacgatcagcagagacaactccaaaaataccctgtaccttcagatgaacagcctgcgggcggaagatacagctctctattactgtgccaaggacctgggcgagtctgaaaatgaggagtgggcctccgattattacgacttcgggcgcgattacccgggacaggaccccagaggcgtcgtggggacctttgatatttggggacaaggcacaatggttaccgtgagctct

SEQ ID NO: 40496 - RNA, 432 nt, synthetic construct
  misc_feature 1..432: note = derived and/or modified sequence opt5 from anti-HIV_cap256-038-209916_VR-Chain
  source 1..432: mol_type = other RNA
caggtgcaactggtcgagagcggcgggggagttgtgcagcccggcgggtccctcagactgtcttgcgccgctagcggattcaccttttcctctttcggcatgcactgggtgcggcaggcccctgggaagggacttgaatgggtcagctttatccgcaacgacggcggcattagatactccgcggattctgtgcgggggcgcttcacaatcagcagagacaattccaaaaacacgctgtatctccagatgaatagcctgcggaccgatgacacagctgtttactattgtgccaaggatcttggagagtctgaaaccgaggaatggccgtccgactactatgattttggccgcgactaccccgggcaagatcctagaggagtggtcggcacattcgacatttgggggcatggaaccatggtgacagttagctct

SEQ ID NO: 40497 - RNA, 432 nt, synthetic construct
  misc_feature 1..432: note = derived and/or modified sequence opt5 from anti-HIV_cap256-038-207938_VR-Chain
  source 1..432: mol_type = other RNA
caggtgcaactggtcgagagcggcgggggagttgtgcaccccggcagatccctccggctgtcttgcgccgctagcgggttcaccttttcctcttacggaatgcattgggtgcgccaggcccctggcaaggggcttgaatgggtcgcggtgatcagccacgacggatccaacaaatattacgctgattctgttaagggcagattcacaattagccgggacaattccaaaaacacgctgtatctccagatgaatagcctgcgcgccgaggataccgccgtgtactattgtgctaaggaccttggcgaatctgagaacgaagagtgggcctccgattactatgactttgggagagattacccgggacaggacccccggggcgtcgtgggggttttcgatatctggggacaaggcacaatggtgaccgtcagctct

SEQ ID NO: 40498 - RNA, 432 nt, synthetic construct
  misc_feature 1..432: note = derived and/or modified sequence opt5 from anti-HIV_cap256-038-202245_VR-Chain
  source 1..432: mol_type = other RNA
caggtgcacctggtcgagagcggcgggggagttgtgcaacccggcagatccctccggctgtcttgcaccgtgagcgggttcacatttggatcctacgcccttcattgggtccgccaggctcctggcaaggggctggaatggctctctgtgatcagctatgacggaaacaataaatactatgccgattccgttaagggcagattcacgatttctcgggagaacagcaaaaataccctgtaccttcagatgaactccctgcgcgcggaagacacagctgtgtatcactgtgccaaggatctcggcgagagcgaaaaagaggagtgggcctctgactactatgattttgggagagactacccgggacaggatccccggggcgtcgtggggaccttcgacatctggggacatggcacaatggttaccgtgtccagc

SEQ ID NO: 40499 - RNA, 432 nt, synthetic construct
  misc_feature 1..432: note = derived and/or modified sequence opt5 from anti-HIV_cap256-038-197721_VR-Chain
  source 1..432: mol_type = other RNA
caggtgcaactggtcgagagcggcgggggagttgtgcagcccggcaagtccctcagactgtcttgcgccgggagcggattcatcttttccaactaccctatgcactgggtgcggcaggctccgggcaaagggcttgaatggatggccgacgtctcttatgatggaagcaataaggactacgcggattccgtgaaaggccgcttcaccatttctagagacaacagcaagaatacactgtatctccagatgaactccctgcgggctgaggatacggccgtttactattgtgtgaaagacgtcggcgaaagcgagaatgaagagtgggcctctgattactatgactttgggcgcgattaccccggacaagacaccagagctgtggttggcgccttcgatatctgggggcagggaacaatggtgaccgtctccagc

SEQ ID NO: 40500 - RNA, 432 nt, synthetic construct
  misc_feature 1..432: note = derived and/or modified sequence opt5 from anti-HIV_cap256-038-196679_VR-Chain
  source 1..432: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtggctgtgatctcctatgacggaggcaacaaatactatgccgattctgtcaagggccgcttcacaattagcagagacaattccaaaaacacgctgtaccttcagatgaatagcctgcgggccgaagataccgctctctattactgtgccaaggacctgggggagtctgaaaacgaggagtgggcttccgattattacgactttggacgcgattacccgggccaggacagcagaggggtggttggaacattcgatgtgtggggccaagggaccatggtcacagtgtcttcc

SEQ ID NO: 40501 - RNA, 438 nt, synthetic construct
  misc_feature 1..438: note = derived and/or modified sequence opt5 from anti-HIV_cap256-038-196118_VR-Chain
  source 1..438: mol_type = other RNA
caggtgcaactggtcgagagcggcgggggagttgtgcagcccggcgggtccctccggctgtcttgcgccgctagcggattcaccttttccacatacggcatgcactgggtgcggcaggcccctgggaagggacttgaatgggtcacgttcatccgcaacgacggcaccaataaatattacgcggattctgtgaagggcagatttacaattagccgggacaacaccaaaaatacactgtatctccagatgtactccctgcgcgctgaggataccgccgtttattactgtgccaaggaccttggggaatctgagaacgaagatgaggagtgggctagcgactattacgatttcggaagagactacccgggccaagattccagaggggtggtcggaacatttgacatgtggggccaggggaccatggtgacggttagctct

SEQ ID NO: 40502 - RNA, 429 nt, synthetic construct
  misc_feature 1..429: note = derived and/or modified sequence opt5 from anti-HIV_cap256-038-195382_VR-Chain
  source 1..429: mol_type = other RNA
caggtgcacctggtcgagagcggcgggggagttgtgcaacccggcagatccctccggctgtcttgcgccgctagcgggttcaccttttccaactaccctgtgcattgggtccgccaggccccgggaaagggccttgaatgggtggcggttatctctttcgacgggattaataactatgctggaagcgtgaaaggcagatttatcatttcccgggataattctaagaacacactgtacctccagatgaatagcctgcgcgccgaggacacggccgtctattactgtgtgaaagatcttggcgaatccgagaaggaagagtggcccagcgactattacgatttcgggagagactatcctggacaggattctcggggcgttgtgggggtctttgacatctggggacaaggcaccatggtgacagtgtccagc

SEQ ID NO: 40503 - RNA, 432 nt, synthetic construct
  misc_feature 1..432: note = derived and/or modified sequence opt5 from anti-HIV_cap256-038-180001_VR-Chain
  source 1..432: mol_type = other RNA
gaggtgcagctggtcgaaagcggcgggggactcgttcaacccggcagatccctgcggctttcttgcaccgccagcgggttcacatttggagactacgctatgtcctggttccgccaggcccctggcaaggggctggagtgggtggcggatatctcttatgacggaagcaataaatactatgctgattccgtgaagggcagactcacgatttctcgggacaatagcaaaaacaccctgtaccttcagatgaactccctgcgcgccgaagatacagccgtctattactgtgtgaaggacctcggcgagagcgaaaaagaggagtggccgtctgattattacgactttgggagagattaccccggacaggactcccggggcgttgtgggggtcttcgatatctggggacaaggcaccatggtgacagttagctct

SEQ ID NO: 40504 - RNA, 432 nt, synthetic construct
  misc_feature 1..432: note = derived and/or modified sequence opt5 from anti-HIV_cap256-038-178021_VR-Chain
  source 1..432: mol_type = other RNA
caggtgaagctggtcgagagcggcgggggagttgtgcaacccggcgggtccctcagactgtcttgcgccgctgccggattcatctttagcaactccggcatgcactgggtgcggcaggcgcctgacaaagggcttgaatgggtcgctttcgtgccgtacgatggatctaataagtattacgccgacagcgttaaaggccgctttaccatttccagagataactctaagaatacactgagcctccagatgaactccctgcggacggaggacaccgccgtgtattactgtgctaaagatcttggcgaaagcgagacagaagagtggccctctgactattacgatttcgggcgcgactatcctggacaggatcccagaggcgtcgtggggacctttgacatctggggacatggcacaatggttaccgtgtccagc

SEQ ID NO: 40505 - RNA, 432 nt, synthetic construct
  misc_feature 1..432: note = derived and/or modified sequence opt5 from anti-HIV_cap256-038-177104_VR-Chain
  source 1..432: mol_type = other RNA
gaggtgcagctgctcgaaagcggcgggggactggtccaacccggcgggtcccttagactgtcttgcgccgctagcggattcaccttttcctcttacgccatgaactgggttcggcaggcgcctggcaaggggctcgagtgggtggctgtgatcagctatgacggaggcgataaatactatgccgactccgtcaagggccgcttcacaatttctagagataatagcaaaaacacgctgtaccttcagatgaactccctgcgggtggaagacaccgccgtttattactgtgtgaaggatgtcggggagagcgaaaatgaggagtgggcttctgactattacgattttggacgcgactacccgggccaggatacaagagccgtggttggggctttcgacatctggggacaaggcaccatggtgacagtctccagc

SEQ ID NO: 40506 - RNA, 432 nt, synthetic construct
  misc_feature 1..432: note = derived and/or modified sequence opt5 from anti-HIV_cap256-038-171261_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgtattgggtgcgccaggcgcctggaaagggccttgaatgggtcgctgtgatcagctccgacgggtctgataaaaactacgccgacagcgttaagggaagattcacaatttcccgggataatagcaacaatacgctgtatctccagatgaactctctgcgcgccgaggacaccgctgtgtactattgtgccagagatcttggcgaatccgagaatgaagagtggccgagcgactactatgattttggccgggactaccccgggcaagatcctcgcggagtcatcggcacattcgacgtgtgggggcagggaaccatggttacagtgtcttcc

SEQ ID NO: 40507 - RNA, 432 nt, synthetic construct
  misc_feature 1..432: note = derived and/or modified sequence opt5 from anti-HIV_cap256-038-169090_VR-Chain
  source 1..432: mol_type = other RNA
caggtgcaactggtcgagagcggcgggggagttgtgcagcccggcagatccctccggctgtcttgcgccgctagccgcttcacctttaagacatacacgatgcactgggtgagacaggcccctgggaaaggacttgaatgggtcgcgctgatctcctatgacggctctaacaagtactatgctgatagcgtgaaagggcggctcaccatttcccgcgacaattctaagaacacactgtaccttcagatgaatagcctgagagccgaggataccgccgtttattactgtgtgaaagacctcggagaatccgagaaggaagagtggccgagcgattattacgacttcggccgggattaccccggccaagactctcgcggggtcgtgggagtttttgatatctggggccaggggacaatggtgaccgtctccagc

SEQ ID NO: 40508 - RNA, 432 nt, synthetic construct
  misc_feature 1..432: note = derived and/or modified sequence opt5 from anti-HIV_cap256-038-168705_VR-Chain
  source 1..432: mol_type = other RNA
gaggtgcagctggtcgaaagcggcgggggactcgttaagcccggcgggtccctgagactttcttgcgccgctagcggattcaccttttcctcttacagcatgaactgggtgcggcgcgcccctggcaaagggctggagtgggtggcgctcatctcctatgacgaaaataagaaatactatgctgattctgtcaagggaagattcacaattagccgggagaactccaaaaatacgctgtaccttcaaatgaacagcctgcgcgccgaagacaccgccgtgtattactgtgctaaggatctcggcgagagagagaatgaagagtgggcctctgactattacgattttggccgggactacccggggcaggatccccgcggagttgtgggctccatcgacacatgggggcacggaaccatggtcacagtgagctct

SEQ ID NO: 40509 - RNA, 432 nt, synthetic construct
  misc_feature 1..432: note = derived and/or modified sequence opt5 from anti-HIV_cap256-038-167685_VR-Chain
  source 1..432: mol_type = other RNA
caggtgcaactggtcgagagcggcgggggagttgtgcagcccggcagatccctccggctgtcttgcgccgctagcgggatcaccttctcctcttacgccattcactgggtgcgccaggcgcctggaaagggccttgaatgggtcgctgtgatcagctatgacgggtccaacaaatactatgccgattctgttaagggaagatttacaattagccgggacaattccaaaaacacgctgtacctccagatgaatagcctgcgcgccgaggataccgctgtgtattactgtgccaaggaccttggcgaatctgagaacgaagagtgggctacagattattacgacttctccatcggctacccggggcaagatcccagaggagtcgtgggcgcctttgacatttgggggcagggaaccatggttacagtgagcctg

SEQ ID NO: 40510 - RNA, 432 nt, synthetic construct
  misc_feature 1..432: note = derived and/or modified sequence opt5 from anti-HIV_cap256-038-158775_VR-Chain
  source 1..432: mol_type = other RNA
caggtgcaactggtcgagagcggcgggggagttgtgcagcccggcgggtccctccggctgtcttgcgccgctagcggattcaccttttccacatacggcatgcactgggtgcggcaggcccctgggaagggacttgaatgggtcgcgttcatccgcgacaacggctctaataaatattacgctgatagcgtgaagggcagatttacgatttcccgggacaactctaaaaataccctgtatctccagatgaacagcctgcgcgccgaggatacagccctttactattgtgctaaggacctgggggaatccgagaatgaagagtgggccagcgattactatgacttcggaagagattacccgggccaagactctagaggggttgtgggaacctttgatgtctggggccaggggacaatggtgaccgtttccagc

SEQ ID NO: 40511 - RNA, 432 nt, synthetic construct
  misc_feature 1..432: note = derived and/or modified sequence opt5 from anti-HIV_cap256-038-157318_VR-Chain
  source 1..432: mol_type = other RNA
cacgtgcagctggtcgagagcggcgggggagttgtgcaacccggcagatccctccggctgtcttgcgccgctagcgggatcaccttctccacatacgacatgcattgggtgcgccaggcccctggaaagggccttgaatgggtcgcggtgatttctaacgatgggagcaataaatattacgctgactccgttaagggaagatttacgatctctcgggataacagcaaaaataccctgtatctccagatgaactccctgcgcgccgaggacacagccctttactattgtgctaaggatctgggcgaaagcgagaaagaagagtgggcctctgactactatgatttcggcagagactacccggggcaggatccccggggagtggtcgctacctttgacatttggggccaagggacaatggtgaccgtttccagc

SEQ ID NO: 40512 - RNA, 432 nt, synthetic construct
  misc_feature 1..432: note = derived and/or modified sequence opt5 from anti-HIV_cap256-038-153058_VR-Chain
  source 1..432: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctgtgatctcttatgacgggagccattcctactatgccggatctgttaaaggcagattcacgaccagccgggataactccaagaatacactgaacctccagatgaatagcctgcgcccggaggacaccgccctttactattgtgctaaagatctgggcgaatctgagaacgaagagtgggcctccgactactatgattttgggagagactaccccggacaagatagccggggcgtggtcgggacattcgacgtgtggggacagggcaccatggttacagtgtcttcc

SEQ ID NO: 40513 - RNA, 432 nt, synthetic construct
  misc_feature 1..432: note = derived and/or modified sequence opt5 from anti-HIV_cap256-038-150027_VR-Chain
  source 1..432: mol_type = other RNA
ctggtgcagctcgtcgagagcggcgggggagttgtgcaacccggcgggtccctgagactttcttgcgccgctagcggattccggttttcctcttacggcatgcactgggtgcgccaggcccctgggaagggactggaatgggtcgcgttcatcagatatgacggcagctttaaagattacgctgactccgtgcggggccgcttcaccatttctagagataacagcaagaatacagtttatgtgcagatgaactccctccgggccgaggacacggccgtctactattgtgctaaagatctgggggaaagcgagaatgaagagtgggccaccgactactatgattttgctacaggatacccggtgcaggacccccgcgccgttgtgggcgcgttcgatatctgggggcaaggaaccatggtcacagtgtctcct

SEQ ID NO: 40514 - RNA, 432 nt, synthetic construct
  misc_feature 1..432: note = derived and/or modified sequence opt5 from anti-HIV_cap256-038-146372_VR-Chain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccagagccctggcaaggggcttgaatgggtcgccgtgatctcctacgacggaaacaataaatattacgcggattctgttaagggcagatttacaattagccgggagaactccaaaaatacgctgtatctccagatgaacagcctgcgcaccgacgatacagctgtgtactattgtgccaaggaccttggcgaatctgagaccgaagagtgggccacagattactatgacttcgctaccgggtacccggtccaagatcccagagccgtggttggagcttttgacatctggggccaggggacaatggtgaccgtctcccct

SEQ ID NO: 40515 - RNA, 432 nt, synthetic construct
  misc_feature 1..432: note = derived and/or modified sequence opt5 from anti-HIV_cap256-038-141868_VR-Chain
  source 1..432: mol_type = other RNA
gagctgagactcgtggaaagcggcgggaacctggtccagcccggaggctcccttaccctgtcttgcgttgccagcgggttcacatttgactcctacggaatgtcttgggtgcggcaagctcctggcaaggggctcgagtgggtggccctgatcagctatgatgaaaataaaaagtactatgcggactccgtcaaaggacgcttcacgatttctagagagaacagcaagaataccctttacctgcagatgaactccctccgggctgaagatacagccgtgtattactgtgccaaagacctgggcgagcgcgagaatgaagagtgggctagcgattattacgactttggcagagattacccggggcaggacccccggggagttgtgggctctatcgatacctgggggcacggaacaatggtcaccgtgtccagc

SEQ ID NO: 40516 - RNA, 432 nt, synthetic construct
  misc_feature 1..432: note = derived and/or modified sequence opt5 from anti-HIV_cap256-038-141616_VR-Chain
  source 1..432: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtggctgtgatctccaaagacggatctgataacagctatgtcgactccgtgaagggccgcttcacaattagcagagataattctaaaaacacgctgtaccttcagatgaactccctgcgggccgaagacaccgccgtttattactgtgctcgcgatctcggcgagagcgaaaatgaggagtggccgtctgactattacgattttgggagagactatcccggacaggatcctcggggcgtgatcgggacattcgacgtctggggacaaggcaccatggtgacagtttccagc

SEQ ID NO: 40517 - RNA, 432 nt, synthetic construct
  misc_feature 1..432: note = derived and/or modified sequence opt5 from anti-HIV_cap256-038-127989_VR-Chain
  source 1..432: mol_type = other RNA
caggcccaactggtggagagcggcgggggagtcgttcagcccggcagatccctccggctgtcttgcgctgccagcgggttcaccttttccaacttcgcgatgcactgggtgcgccaggctcctggaaagggccttgaatgggtggccgtcatgtctgacgatgggagcaataaatactatgccgactccgtgaagggaagatttacaatctctcgggataacagcgagaatacgctgtacctccagatgaactccctgcgcgctgaagacaccgccgtttattactgtgctaaagatcttggcgagagcgaaacagaggagtgggccaccgactattacgatttcggcacagggtatccgggacaagaccccagagcgatgattggcacctttgatatctgggggcggggaacaatggtgaccgtctcttcc

SEQ ID NO: 40518 - RNA, 432 nt, synthetic construct
  misc_feature 1..432: note = derived and/or modified sequence opt5 from anti-HIV_cap256-038-118109_VR-Chain
  source 1..432: mol_type = other RNA
caggtgcaactggtcgagagcggcgggggagttgtgcagcccggcgggtccctcagactgtcttgcaccgccagcggattcacattttccgcttacgacatgcactggatccggcaggcccctggcaaggggcttggatgggtggcgttcattacgaacgaaggctctagcaaaaattatgtcgattccgtgaagggccgctttaccatctctagagacaacagcaaaaatacactgtacctccagatgaactccctgcgggctgaggataccgccgtttattactgtgccaaggaccttggggaaagcgagaatgaagagtgggctacagattattacgacttctctattgcctatccgggacaagatccccgcggcgtggtcgggatctttgacatttggggacagggcaccatggtgacagtttccagc

SEQ ID NO: 40519 - RNA, 432 nt, synthetic construct
  misc_feature 1..432: note = derived and/or modified sequence opt5 from anti-HIV_cap256-038-112226_VR-Chain
  source 1..432: mol_type = other RNA
gaggtgcagctggtcgaaagcggcgggggactcgttcaacccggcgggtccctgagactttcttgcgccgctagcggattcaccttttcctcttactggatgacatgggtgcggcaggcccctggcaaggggctggagtgggtggcggtcatcagcgacgatggaaacaataaatattacgctgactccgtgaagggccgcttcacgatttctagagataacagcaaaaataccctctatctgcagatgaactcccttcgggttgaagacacagccgtgtactattgtgtcaaggatgtgggcgagagcgaaaatgaggagtgggcctctgactactatgattttgggcgcgactacccgggacaggataccagagctgttgtgggcgccttcgacatctgggggcaaggaacaatggtcaccgtgtccagc

SEQ ID NO: 40520 - RNA, 432 nt, synthetic construct
  misc_feature 1..432: note = derived and/or modified sequence opt5 from anti-HIV_cap256-038-105918_VR-Chain
  source 1..432: mol_type = other RNA
gaggtgcagctgctcgaaagcggcgggggactggtccaacccggcgggtcccttagactgtcttgcgccgctagcggattcacctttaatatccaccctatgcattgggttcggcaggccccgggcaaggggctcgagtgggtggcggtgatttcctacgacggaaataacaaatattacgctgattctgtcaagggccgcttcacaatcagcagagaaaattccaaaaacacgctgtatcttcagatgaactctctgcggaccgacgatacagccgtgtactattgtgccaaggacctcggcgagagcgaaaccgaggagtggccctccgattactatgactttgggcgcgattaccctggacaggaccccagaggcgttgtggggacattcgatatttggggacacggcaccatggtcacagtgagctct

SEQ ID NO: 40521 - RNA, 432 nt, synthetic construct
  misc_feature 1..432: note = derived and/or modified sequence opt5 from anti-HIV_cap256-038-104487_VR-Chain
  source 1..432: mol_type = other RNA
ctggtgcagctcgtcgagagcggcgggggagttgtgcaacccggcaagtccctgagactttcttgcgccgctagcgggttcaccttttcctcttacgccatgcactggatccggcaggcgcctggaaaaggcctggaatgggtggctgtcattagcgacgatgggtccatcaagaactatgccgactctgtgaaaggacgcttcacaattagcagagataattccaagaacacgctctacctgcagatgaatagccttcgggccgaggacaccgctgtttattactgtgccaaagatctgggcgaatctgagaacgaagagtgggctacagactattacggcttttccatcgggtatccgggacaggatccccgcggcgtggtcgggattttcgacatctgggcccaaggaaccatggtgacagttagctct

SEQ ID NO: 40522 - RNA, 432 nt, synthetic construct
  misc_feature 1..432: note = derived and/or modified sequence opt5 from anti-HIV_cap256-038-102308_VR-Chain
  source 1..432: mol_type = other RNA
caggtgcaactggtcgagagcggcgggggagttgtgcagcccggcgggtccctccggctgtcttgcgccgctcttgacttcccttttagctccttcggaatgcactgggtgcggcagaccccgggccgcgggctggaatgggtcgccatcatttggtctgatggaagcaacagatactatgtggactccgttaagggccggtttacaatctctcgcgataatagcaaaaacacgctctacctgcagatgaactcccttagacccgacgataccgcggtgtattactgtgtcaaggacctgggcgagagcgaaaatgaggaatgggctacagattattacgacttctctgtggggtatcctggacaaggccccagaggggttgtgggaatttttgatatctggggccaggggaccatggtcacagtgtccagc

SEQ ID NO: 40523 - RNA, 432 nt, synthetic construct
  misc_feature 1..432: note = derived and/or modified sequence opt5 from anti-HIV_cap256-038-091115_VR-Chain
  source 1..432: mol_type = other RNA
caggtgcaactggtcgagagcggcgggggagttgtgcagcccggcagatccctccggctgtcttgcgccgtgagcgggttcaccttttcctcttacggacttcactgggtccgccaggctcctggcaaggggctggaatgggtggccgttatcagctatgacggatccaacaaatactatgcggattctgtgaagggcagattcacaattagccgggacaattccaaaaacacgctctacctgcagatcaatagccttcgcgctgaggataccgccgtctattactgtgccaaggacctgggcgaatctgagaacgaagagtgggctacagattattacgacttttccattgggtacccgggacaagatcccagagccgtggttggcgctttcgacatctgggggcagggaaccatggtgacagtcagctct

SEQ ID NO: 40524 - RNA, 432 nt, synthetic construct
  misc_feature 1..432: note = derived and/or modified sequence opt5 from anti-HIV_cap256-038-090262_VR-Chain
  source 1..432: mol_type = other RNA
caggtgcaactggtcgagagcggcgggggagttgtgcaggccggcgggtccctcagactgtcttgcgctgccagcggattcacctttaacaattacggcatgcactgggtgcggcaggcgcccgggaagggacttgaatgggctgccttcatccgctatgacggctccaacaaatactatgccgattctgtcagaggccggtttacaattagccgcgacaattccaagaacacgctgtacctccagatgaactctctgagagctgaggataccgccgtgtattactgtgttaaagacgtgggggaaagcgagaatgaagagtgggcttccgattattacgacttcggacgggattaccctggccaagacacacgcgccgtcgtgggggcgtttgatatctggggacagggcaccatggttacagtgagctct

SEQ ID NO: 40525 - RNA, 432 nt, synthetic construct
  misc_feature 1..432: note = derived and/or modified sequence opt5 from anti-HIV_cap256-038-083260_VR-Chain
  source 1..432: mol_type = other RNA
caggtgcaactggtcgagagcggcgggggactcgttaagcccggcgggtccctgagactttcttgcgccgctagcggattcaccttttccgactactatatgacatggatccggcaggcccctggcaaagggctggaatgggtggcggtgatttcttacgatggaggcaacaagtattacgctgacagcgtcaaaggccgcttcacgatctccagagataattctaagaacaccctctatctgcagatgaatagccttcgggccgaggacacagccctgtactattgtgctaaagatctcggggaatccgagaacgaagagtgggccagcgactactacgattttggacgcgactatccgggccaggattctagaggggtggttggaaccttcgacgtgtggggccaagggacaatggtcaccgtgtccagc

SEQ ID NO: 40526 - RNA, 432 nt, synthetic construct
  misc_feature 1..432: note = derived and/or modified sequence opt5 from anti-HIV_cap256-038-080981_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggatggaatgggtcgcggtgatcagctatgacggatccaacaaatactatgctgattctgttaagggcagattcacaattagccgggacaattccaaaaacacgctttacctgcagatgaatagcctccgcgccgtggataccgccgtctattactgtgctaaggacctgggcgagggggaaaacgaggaatgggccacagattattacgacttttctatcggatacccgggccaagatcccagaggggtggttggagctttcgacatttggggccaggggaccatggtgacagtctccagc

SEQ ID NO: 40527 - RNA, 432 nt, synthetic construct
  misc_feature 1..432: note = derived and/or modified sequence opt5 from anti-HIV_cap256-038-080873_VR-Chain
  source 1..432: mol_type = other RNA
ctggtgcagctcgtcgagagcggcgggggagttgtgcaacccggcgggtccctgagactttcttgcgccgctagcggattccggttttcctcttacggcatgcactgggtgcgccaggcccctgggaagggactggaatgggtcgcgttcatcagatatgacggcagctttaaagattacgctgactccgtgcggggccgcttcaccatttctagagataacagcaagaatacagtttatctccagatgaactccctgcgggccgaggacacggccgtgtactattgtgtcaaagatcttggggaaagcgagaaggaagagtggccgtctgactactatgattttggacgcgactaccccggccaggattccagaggggtggttggagtgttcgacatctggggccaagggaccatggtcacagtgagctct

SEQ ID NO: 40528 - RNA, 432 nt, synthetic construct
  misc_feature 1..432: note = derived and/or modified sequence opt5 from anti-HIV_cap256-038-074413_VR-Chain
  source 1..432: mol_type = other RNA
caggtgcaactggtcgagagcggcgggggagttgtgcagcccggcgggtccctccggctgtcttgcgccgctagcggattcaccttttccacatacggcatgcactgggtgcggcagcctccggggaagggacttgaatgggtcgccttcatccgctatgacggctctaacacgtactatgcggatagcgtgaaaggcagatttaccatttcccgggacaattctaagaacacactgtacctccagatgaatagcctgcgcgctgaggataccgccgtttattactgtgccaaagaccttggggaatccgagaacgaagagtgggctagcgattattacgacttcggaagagattaccccggccaagaccctagaggggtggtcggagtgtttgatatctggggccaggggacaatggttaccgtgtcttcc

SEQ ID NO: 40529 - RNA, 432 nt, synthetic construct
  misc_feature 1..432: note = derived and/or modified sequence opt5 from anti-HIV_cap256-038-073153_VR-Chain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcgctgatcagctatgacggaacaaacaaatactatgctgattccgtgaagggcagattcacgatttctcgggacaatagcaaaaacaccctctttctgcagatgaactcccttcgcgccgaggatacagccctgtactattgtgctaaggacctcggcgaaagcgagaatgaagagtgggcctctgattactatgacttcgggagagattacccgggacaagacccccggggcgttgtggggacctttgatatctggggacagggcacaatggtcaccgtgtccagc

SEQ ID NO: 40530 - RNA, 432 nt, synthetic construct
  misc_feature 1..432: note = derived and/or modified sequence opt5 from anti-HIV_cap256-038-064227_VR-Chain
  source 1..432: mol_type = other RNA
gaggtgcaggtcgttgaaagcggcgggggactggtgcaacccggcgggtccctcagactgtcttgcgccgctagcggattcaccttttccaactactggatgtcttgggtgcggcaggcccctggcaaggggcttgagtgggtcgcggtgatgagcttctccggatctggcagctattacgctgactccgttaaaggccgctttacaatcagctctgatgactccatgaatacggtgtatctgcagatgaacagcctcagagccgaagataccgccgtctactattgtgctaaggacctgggggagcgggaaaatgaggagtgggcctctgattactatgacttcggacgcgattacccgggccaggaccccagaggggtggttggatccattgatacatggggccacgggaccatggtgacagtcagctct

SEQ ID NO: 40531 - RNA, 432 nt, synthetic construct
  misc_feature 1..432: note = derived and/or modified sequence opt5 from anti-HIV_cap256-038-061640_VR-Chain
  source 1..432: mol_type = other RNA
caggtgcaactggtcgagagcggcgggggagttgtgcagcccggcagatccctccggctgtcttgcaccgccagccgcttctcctttaacaattacgctatgcactgggtgagacaggcccctgggaagggacttgaatgggtcgcgatcatttctaaagacggcagcgataactcctatgtggactctgttaaggggcggttcacaatcagccgcgataattccaaaaacacgctgtacctccagatgaatagcctgagagctgaggacaccgccgtgtattactgtgcccgggatcttggagaatctgagaacgaagagtggccgtccgactattacgattttggccgcgactatcccggccaagatcctagaggggtcattggaacattcgacgtgtggggccaggggaccatggttacagtgagctct

SEQ ID NO: 40532 - RNA, 414 nt, synthetic construct
  misc_feature 1..414: note = derived and/or modified sequence opt5 from anti-HIV_cap256-038-059482_VR-Chain
  source 1..414: mol_type = other RNA
agaggcgtgcagtgccaagtccagctggttgagagcgggggaggcgtggtgcagcccgggttcaccttttcctcttacgtcatgcactgggtgcggcaggcccctggaaagggcctcgaatgggttgctgacatcagctatgatgggtccaataaatactatgccgactctgtgaagggacgcctgacaattagcagagataattccaaaaacacgctttacctgcaaatgaactctctccgggcggaggacaccgctgtctattactgtgtgaaggatctgggcgaaagcgagaaagaagagtggccgtccgactattacgatttcgccacaggctaccccgttcaggaccctcgcgccgtggtcggggcttttgatatctggggacagggcaccatggtgacagtgagcccc

SEQ ID NO: 40533 - RNA, 432 nt, synthetic construct
  misc_feature 1..432: note = derived and/or modified sequence opt5 from anti-HIV_cap256-038-054000_VR-Chain
  source 1..432: mol_type = other RNA
gaggtgcagctggtcgaaagcggcgggtccgttgtgagacccggaggctctctccggctgagctgcgccgcttccgggttcacctttgacgattctggaatgagctgggtgcgccaaggccctgggaagggacttgagtgggtcgccgtgatctcctacgacggcggcaacaaatattacgcggattctgttaaggggagattcacaattagccgggacaattccaaaaacacgctgtatctccagatgaatagcctgcgcgctgaagataccgccctttactattgtgccaaggacctgggagagtctgaaaacgaggagtgggcttccgattactatgactttggcagagattacccggggcaggacagccggggagtggtcggcacattcgatgtgtgggggcagggaaccatggttacagtgtcttcc

SEQ ID NO: 40534 - RNA, 432 nt, synthetic construct
  misc_feature 1..432: note = derived and/or modified sequence opt5 from anti-HIV_cap256-038-050554_VR-Chain
  source 1..432: mol_type = other RNA
gaggtgcagctgctcgaaagcggcggggacctggtccaatccggaggctctcttagactgagctgcgttgcctccgggttcaccttttctacacacgctatgacgtgggtgcggcaggcccccggaaagggcctcgagtgggtggcggtcatcagctccgatgggtctaacaaaaatttcgctgacagcgtgaagggacgctttaccatttccagagataacagcaaaaatacactgtaccttcagatgaactctctgcggcctgaagacaccgccgtttattactgtgccaaggatctcggcgagtccgaaaatgaggagtgggctacagactattacgatttcagcaccggctatccggtgcaggacccccgcgccgtcgtgggggcttttgatatctggggacaaggcacaatggttaccgtgtcttcc

SEQ ID NO: 40535 - RNA, 432 nt, synthetic construct
  misc_feature 1..432: note = derived and/or modified sequence opt5 from anti-HIV_cap256-038-044256_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacaaataccatgccggatctgttaagggcagattcattatcagccgggataattccaaaaacacactgtatctccagatgaatagcctgcgcgccgaggacacggctctttactattgtgccaaggatctgggcgaatctgagaacgaagagtgggcttccgactactatgattttgggagagactacccgggacaagatccccggggcgtggtcgggaccttcgacatttggggacagggcacaatggtgaccgttagctct

SEQ ID NO: 40536 - RNA, 432 nt, synthetic construct
  misc_feature 1..432: note = derived and/or modified sequence opt5 from anti-HIV_cap256-038-040944_VR-Chain
  source 1..432: mol_type = other RNA
caggtgcaactggtcgagagcggcgggggagttgtgcagcccggcagatccctccggctgtcttgcgccgctagcgggttcaccttttccaactacgccatggactgggtgcgccaggcgcctggaaagggccttgaatgggtcgctgtgatctcttatgatgggagcaataaatactatgccgactccgttaagggaagattcacaatttctcgggataacagcaaaaatacgctgtacctccagatgaactccctgcgcgccgaggacaccgctgtgtattactgtgccaaggatcttggcgaaagcgagaatgaagagtgggctacagactattacgatttttctaccggctacccggggcaagaccccagagccgtcgtgggagcgttcgatatctggggccaggggacaatggttaccgtgtccagc

SEQ ID NO: 40537 - RNA, 432 nt, synthetic construct
  misc_feature 1..432: note = derived and/or modified sequence opt5 from anti-HIV_cap256-038-040090_VR-Chain
  source 1..432: mol_type = other RNA
caggtgcaactggtcgagagcggcgggggagttgtgcagcccggcagatccctccggctgtcttgcgccgctagcgggttctccttttctaactacgccatggactgggtgcgccaggcgcctggaaagggccttgaatgggtcgctgtgatcagctccgatgggtctaataaaaactatgccgacagcgttaagggaagattcaccatttcccgggataatagcaaaaacacactgtacctccagatggactctctgcgcgccgatgacacggctgtgtattactgtgccaaggatcttggcgagtccgaaaatgaggaatgggctaccgactattacgattttagcatcggctatccggtccaagaccccagaggggtggttggaattttcgatatctggggccaggggacaatggtgaccgtctcttcc

SEQ ID NO: 40538 - RNA, 432 nt, synthetic construct
  misc_feature 1..432: note = derived and/or modified sequence opt5 from anti-HIV_cap256-038-032874_VR-Chain
  source 1..432: mol_type = other RNA
caggtgcaactggtcgagagcggcgggggagttgtgcagcccggcgggtccctccggctgtcttgcgccgctagcggattcaccttttcctcttacggcatgcactgggtgcggcaggcccctgggaagggacttgaatgggtcgcgttcatccgctatgacggcaacaataaatactatgctgatagcgtgaagggcagatttacaatttcccgggagaactctaaaaatacgctgtacctccagatgaacagcctgcgcgccgaagacaccgccgtttatcattgtgctaaggatcttggggagtccgaaaaagaggagtgggccagcgactactatgatttcggaagagactacccgggccaagatcccagaggggtggtcggaacatttgacatctggggccacgggaccatggtgacagtttcttcc

SEQ ID NO: 40539 - RNA, 432 nt, synthetic construct
  misc_feature 1..432: note = derived and/or modified sequence opt5 from anti-HIV_cap256-038-025899_VR-Chain
  source 1..432: mol_type = other RNA
caggtgcaactggtcgagagcggcgggggagttgtgcagcccggcagatccctccggctgtcttgcgtggccagcgggttcaccttttccaactacgctatgtattgggtccgccaggcccctggaaagggccttgaatgggtgacaatcatttctttcgacgggagcaatcagtactatgcggattccgttaaaggaagatttacgatctctcgggagaacagcaagaataccctgtacctccaaatgaactccctgcgcgctgaagacacagccgtgtattactgtgccaaagatcttggcgagagagaaaatgaggagtgggctagcgactattacgatttcggccgggactacccggggcaggatccccgcggagtcgtgggctctattgacacctgggggcacggaacaatggttaccgtgtccagc

SEQ ID NO: 40540 - RNA, 432 nt, synthetic construct
  misc_feature 1..432: note = derived and/or modified sequence opt5 from anti-HIV_cap256-038-024581_VR-Chain
  source 1..432: mol_type = other RNA
cacatccagctggtggagagcggcgggggagtcgttcaacccggcgggtccctcagactgtcttgcgccgctagcggattccctttttcctctttcggcatgcattgggtgcggcagaccccggggcgcggacttgaatgggtggccattatctggagcgacggctcccacaaggagtacacagattctgtcaaaggcagatttacgattagccgggacaactcccgcagcaccatggatctgcagatgaataacctcagacccgaagacacagcggtgtattactgtgctaaggatctgggggagcgggaaaatgaggagtgggcctctgactattacgatttcggacgcgactatcctggccaggatcccagaggggttgtgggatccatcgacacctggggccatgggacaatggtcaccgtgagctct

SEQ ID NO: 40541 - RNA, 432 nt, synthetic construct
  misc_feature 1..432: note = derived and/or modified sequence opt5 from anti-HIV_cap256-038-013345_VR-Chain
  source 1..432: mol_type = other RNA
caggtgcaactggtcgagagcggcgggggagttgtgcagcccggcagatccctccggctgtcttgcgccgtgagcgggttcaccttttcctcttacggaatgcactgggtccgccaggctcctggcaaggggcttgaatgggtggccgcgatcagctatgacggatccaacaaatactatgttgattctgtgaagggcagattcacaattagccgggacaattccaaaaacacgctgtacctccagatgaatagcctgcgcgctgaggataccgccgtctattactgtgccagagaccttggcgaacgggagatcgaagagtgggctacagattattacgacttttctattgggtacccgggacaagatccccgcggcgtggttggggtgttcgacatctggggacagggcaccatggtcacagtgtccagc

SEQ ID NO: 40542 - RNA, 438 nt, synthetic construct
  misc_feature 1..438: note = derived and/or modified sequence opt5 from anti-HIV_cap256-038-011559_VR-Chain
  source 1..438: mol_type = other RNA
caggtgcaactggtcgagagcggcgggggagttgtgcagcccggcagatccctccggctgtcttgcgaagccagcgggttcaccttttcctcttacggaatggactgggtgcgccaggctcctggcaaggggcttgagtgggtcgccctgatcagccacgatggatccaacaaacattatgcggactctgtgaagggcagattcacaattagccgggataattcccgcaacacgctctacctgcagatgaatagccttagagctgaagacaccgccctgtattactgtgccaaagatctcggcgagtctgaaaacgaggacgaggaatgggcttccgattattacgactttgggcgggattatccgggacaagacagccgcggcgttgtggggacattcgatatgtggggacagggcaccatggtcacagtgtcttcc

SEQ ID NO: 40543 - RNA, 432 nt, synthetic construct
  misc_feature 1..432: note = derived and/or modified sequence opt5 from anti-HIV_cap256-038-009634_VR-Chain
  source 1..432: mol_type = other RNA
caggtgcaactggtcgagagcggcgggggagttgtgcagcccggcagatccctccggctgtcttgcgccgctagcgggttcacctttacatccttcggaatgcactgggtgcgccaggcccctggcaaggggcttgaatgggtcgcggtgatctcttacgacggaaacaataaatattacgctgatagcgttaagggcagatttacgatttcccgggagaactctaaaaataccctgtatctccagatgaacagcctgcgcgccgaagacacagccgtgtaccattgtgctaaggatcttggcgagtccgaaatcgaggagtggaccagcgactattacgatttcgggagagactatccgggacaagatccccggggcgtctttgggacattcgacatttggggacacggcaccatggtgacagtttcttcc

SEQ ID NO: 40544 - RNA, 432 nt, synthetic construct
  misc_feature 1..432: note = derived and/or modified sequence opt5 from anti-HIV_cap256-038-006730_VR-Chain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagcaaagacggatccgataactcttacgttgacagcgtgaagggcagatttacaatttcccgggataatagcaaaaacacgctgtatctccagatgaactctctgcgcgctgaggacaccgccgtctactattgtgccagagatcttggcgaatccgagaatgaagagtggccgagcgactactatgatttcgggcgggactaccccggacaagatcctcgcggcgtgatcgggacatttgacgtttggggacagggcaccatggtgacagtctcttcc

SEQ ID NO: 40545 - RNA, 432 nt, synthetic construct
  misc_feature 1..432: note = derived and/or modified sequence opt5 from anti-HIV_cap256-038-004887_VR-Chain
  source 1..432: mol_type = other RNA
caggtgcaactggtcgagagcggcgggggagttgtgcagcccggcagatccctccggctgtcttgcgccgctagcgggttctccttttctaccagcggaatgcactgggtgcgccaggcccctggcaaggggatggaatgggtcgcggtgatctcctacgacggatctaacaaatattacgctgatagcgttaagggcagattcacaatttcccgggacaatagcaaaaacacgctttatctgcagatgaactctctccgcgccgtggataccgccgtctactattgtgctaaggacctgggcgagggggaaaatgaggaatgggccacagattactatgacttttccatcggatacccggtgcaaaatcccagaggccttgttggggctttcgatatttggggacagggcaccatggtgacagtcagctct

SEQ ID NO: 40546 - RNA, 432 nt, synthetic construct
  misc_feature 1..432: note = derived and/or modified sequence opt5 from anti-HIV_cap256-038-004840_VR-Chain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccagagccctggcaaggggcttgaatgggtcgccgtgatctcctacgacggaaacaataaatattacgcggattctgttaagggcagatttacaattagccgggagaactccaaaaatacgctgtatctccagatgaacagcctgcgcaccgacgatacagctgtgtactattgtgccaaggaccttggcgaatctgagaccgaagagtggccgtccgattactatgacttcgggagagattaccccggacaagaccctcggggcgtcgtggggacatttgatatctggggacatggcaccatggttacagtgagctct

SEQ ID NO: 40547 - RNA, 432 nt, synthetic construct
  misc_feature 1..432: note = derived and/or modified sequence opt5 from anti-HIV_cap256-038-002181_VR-Chain
  source 1..432: mol_type = other RNA
gaggtgcagctggtcgaaagcggcgggggactcgttcaacccggcagatccctgcggctttcttgcgccgctagcgggttcacctttgaggactacgccatgcactgggtgcgccaggcgcctggaaagggcctggaatgggtggctgtcatctcctatgatgggtctaacaaatactatgtggacagcgttaagggaagattcacaatttcccgggataattctaaaaacacgctctacctgcagatgaatagccttcgcgccgaggacaccgccgtgtattactgtgctaaggatctgggcgaatccgagaacgaggaatgggccacagactattacgattttagcatcggctacccggggcaggaccccagaggagtcgtgggcattttcgatatctgggggcaaggaaccatggttacagtgtcttcc

SEQ ID NO: 40548 - RNA, 432 nt, synthetic construct
  misc_feature 1..432: note = derived and/or modified sequence opt5 from anti-HIV_cap256-038-001902_VR-Chain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagctacgacggaaacaataaatattacgctgattccgttaagggcagatttacaatttctcgggagaacagcgaaaatacgctgtatctccagatgaactccctgcgcgccgacgataccgccgtgtactattgtgctaaagaccttggcgagagcgaaaatgaggagtgggcctctgattactatgacttcgggagagattacccgggacaagacacacggggcgtcgtggggacctttgatatctggggacatggcacaatggttaccgtgtccagc

SEQ ID NO: 40549 - RNA, 432 nt, synthetic construct
  misc_feature 1..432: note = derived and/or modified sequence opt5 from anti-HIV_cap256-038-000976_VR-Chain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagcgacgatggaaacaataaatactatgctgactccgttaagggcagatttacaatttctcgggataacagcaaaaatacgctgtacctccagatgaactccctgcgcgtggaggacaccgccgtctattactgtgtgaaggatgttggcgaaagcgagaatgaagagtgggcctctgactattacgatttcgggagagactatccgggacaagatacacgggctgtggtcggcgcctttgacatctgggggcagggaaccatggtgacagtgtccagc

SEQ ID NO: 40550 - RNA, 432 nt, synthetic construct
  misc_feature 1..432: note = derived and/or modified sequence opt5 from anti-HIV_cap256-038-000384_VR-Chain
  source 1..432: mol_type = other RNA
caggtgcaactggtcgagagcggcgggggagttgtgcagcccggcaagtccctcagactgtcttgcgccgctagcgggttcaccttttcctcttacgtgatgcactgggtccggcaggcccctggaaaaggccttgaatgggtggcggacatcagctatgatgggtccaacaagtactatgctgactctgttaaaggacgcctgacaattagcagagataattccaagaacacgctctacctgcagatgaatagccttcgggccgaggacaccgccgtgtattactgtgtcaaagatctgggcgaatctgagaaggaagagtggccgtccgactattacgatttcggccgcgactaccccgggcaagatagcagaggagtggttggcgtgtttgacatctgggggcagggaacaatggtcaccgtgtcttcc

SEQ ID NO: 40551 - RNA, 321 nt, synthetic construct
  misc_feature 1..321: note = derived and/or modified sequence opt5 from anti-HIV_206-314431_VR-Chain
  source 1..321: mol_type = other RNA
cagttcgtgctgacccaaccccctagcgtctccgccgctccgggccagaacgttacaatctcttgcagcgggcccccttcccacattgagaagaatgacgtgtcttggtaccagagactccccggaatggcccctaaaatggtgatctatgaaagccggcgcagacccctgggcattcctgtccggtttacggcgtcccgctctgggagctccgctacccttgtgatcacaggactgcagaccgccgatgaggccgactactattgtggcacatgggatgggagaatgaacttcggaaccggcacaaccgttacggtgctc

SEQ ID NO: 40552 - RNA, 321 nt, synthetic construct
  misc_feature 1..321: note = derived and/or modified sequence opt5 from anti-HIV_206-247594_VR-Chain
  source 1..321: mol_type = other RNA
cagagcatcctgacccaacccccttccgtgtctgccgctccgggccagaacgtcacaattagctgctccgggcccccttctcacatcgagaagaatgacgttagctggtaccagagattccccggaatggcccctaaaatgattatctatgaatccaagcggcgcccctttggcgtgcctgggagattctctgcgagccggtccggaaaaagcgctacgctcgccattaccggcctgcagacaggggatgaggccgactactattgtggaacctgggatggccgcatgaactttggcacagggaccacagtgaccgtcctt

SEQ ID NO: 40553 - RNA, 321 nt, synthetic construct
  misc_feature 1..321: note = derived and/or modified sequence opt5 from anti-HIV_206-116890_VR-Chain
  source 1..321: mol_type = other RNA
cagagcgtgctgacccaacccccttccgtctctgccgctccgggccagaacgttacaatcagctgctccgggcccccttctcacattgagaagaatgacgtgagctggtaccagcatctccccggagaagcccctaaaatgatcatttatgagtcctggagacggcccgcgggcatccctgctcgcttctctgccagcagatccggaaagagcgggacgctggccattaccggccttcagacaggggatgaagctgactactattgtggaacctggaacggccggatgaattttggcacagggaccacagtgaccgtcctg

SEQ ID NO: 40554 - RNA, 333 nt, synthetic construct
  misc_feature 1..333: note = derived and/or modified sequence opt5 from anti-HIV_206-072383_VR-Chain
  source 1..333: mol_type = other RNA
cagagcgtgctgacccaacccccttccgtctctgccgctccgggccagagagttatcattagctgctccgggaacaattctacaatcggaaacaatttcgtgagctggtaccaacaggtgcccggcacggcccctaagctcctgatttatgagaccaaccggcgcccctccgggatccctgacagattttctggaagcaaatccggcacaagcgcgacccttgctatttctgggctgcagacaggagatgaagccgacttctactgtaccgtctggggcgtgcggaagggcgttgccgctgtgtttgggacaggaacccgcctcacggtcctg

SEQ ID NO: 40555 - RNA, 333 nt, synthetic construct
  misc_feature 1..333: note = derived and/or modified sequence opt5 from anti-HIV_206-037527_VR-Chain
  source 1..333: mol_type = other RNA
cagagcgtgctgacccaacccccttccgtctctgccgctccgggccagaaggttatcattagctgctccgggaacaattctacaatcggaaaaattctcgtgagctggtaccaacaggtgcccggcacggcccctaagctggtcatctatgagaccaacagacggccctccgggattcctgaccgcttctctggaagcaaatccggcacaagcgcgacccttgctatcacagggctgcagaccggagatgaagccgactacttttgtaaggtgtggggcgttagaaaaggcgtggccgctgtcttcgggacaggaaccaaggtgacggttctc

SEQ ID NO: 40556 - RNA, 333 nt, synthetic construct
  misc_feature 1..333: note = derived and/or modified sequence opt5 from anti-HIV_206-009095_VR-Chain
  source 1..333: mol_type = other RNA
cagagcgtgctgacccaacccccttccgtctctgccgctccggcccagagagttatcattagctgctccggcgacaactctacaatcgggaataacttcgtgagctggtaccaacaggtgcccggagcggctcctaagctcctgatttatgagacgaatcggcgcccctccggcatccctgatagattttctgggagcaaatccggaaccacagccacccttgccattagcggcctgcagacaggggacgaagctgattaccactgtaccgtctggggagtgcggaagggcgttgccgctgtgttcggcacagggaccaaagtcacggtgctc

SEQ ID NO: 40557 - RNA, 321 nt, synthetic construct
  misc_feature 1..321: note = derived and/or modified sequence opt5 from anti-HIV_176-503620_VR-Chain
  source 1..321: mol_type = other RNA
cagagcgtgctgacccaacccccttccgtctctacagccccgggccagacggttaccgtgagctgctccgggggaacatctaacaccggcaataacttcgtgagctggtaccagcacctccccgggacagctcctaagctgcttatctatgagaataacaaaagacccctgggagtccctgaccggttttccggcgccaagtctgggaccagcgcgacactcgctctgaccggacttcagacgggcgatgaaggcgactactattgtgccacctggtccgggagcctgaatattggaacaggcaccaaagtgtctgttctc

SEQ ID NO: 40558 - RNA, 321 nt, synthetic construct
  misc_feature 1..321: note = derived and/or modified sequence opt5 from anti-HIV_176-478726_VR-Chain
  source 1..321: mol_type = other RNA
cagagcgtgctgacccaacccccttccgtctctgccgctccgggccagaacgttaatatcagctgctccgggcccccttctcacattgagagaaacgacgtgagctggtaccagcatctccccggagccgcgcctaagatgatcatttatgaatcctggcggcgccccgctggcatccctgatagattctctgccagccggtccggggccagcgctacactggccattacgggacttcagaccggcgacgaggctgattactattgtgggacatggaatggacgcatgaactttggcaccggcacaaccgtgacagtcctg

SEQ ID NO: 40559 - RNA, 321 nt, synthetic construct
  misc_feature 1..321: note = derived and/or modified sequence opt5 from anti-HIV_176-245056_VR-Chain
  source 1..321: mol_type = other RNA
cagagcgtgctgacccaacccccttccgtctctgccgctccgggccagaacgttacaatcagctgctccgggcccccttctcacattgagaagaatggagtgagctggtaccagcagttccccggcatggcccctaaaatggtgatctatgaatccaagagacggccctttggggtccctgcgcgcttctctgctagcagatccggaaaaagcgccacgctcgccattaccggcctgcaaacaggggacgaggctgattactattgtggaacctgggacggccggatgaactttggcacagggaccacagtgaccgttctt

SEQ ID NO: 40560 - RNA, 321 nt, synthetic construct
  misc_feature 1..321: note = derived and/or modified sequence opt5 from anti-HIV_176-164413_VR-Chain
  source 1..321: mol_type = other RNA
cagagcgtgctgacccaacccccttccgtctctgccgctccgggccagaaggttacaatcagctgctccgggggaacgtctaacattggcaataactacgtgagctggtatcagagactccccgggaccgcccctaaactgcttatctacgagaataacaagcggccctccggcattcctgaccgcttctctggacccaaaagcgggacatccgcgaccctggctatcacaggactccagcctggcgatgaagccgactattactgtgccacctggagcggctctctgaattttgggacaggaaccaaggtgacggtcctt

SEQ ID NO: 40561 - RNA, 333 nt, synthetic construct
  misc_feature 1..333: note = derived and/or modified sequence opt5 from anti-HIV_176-094308_VR-Chain
  source 1..333: mol_type = other RNA
cagagcgtgctgacccaacccccttccgtctctgccgctccgggccagaaggttatcattagctgctccgggaacaattctacaatcggaaacaatttcgtgagctggtaccaacaggtgcccggcacggcccctaaactcctggtctatgagacctacagacggccctccgggattcctgaccgctctagcggatccaagagcggcacaaccgcgacacaggctatctctgggcttcagaccggagatgaagccgactatcactgtacagtgtggggcgttagaaaaggcgtggccgctgtctttgggaccggaacgaaggtgaccgttctg

SEQ ID NO: 40562 - RNA, 333 nt, synthetic construct
  misc_feature 1..333: note = derived and/or modified sequence opt5 from anti-HIV_176-065321_VR-Chain
  source 1..333: mol_type = other RNA
cagagcgtgctgacccagcccccttccgtctctgccgctccgggcagacgggttatcattagctgctccgggaacaattctacaatcggaaacaatttcgtgagctggtaccaacaggtgcccggcacggcccctaagctcctggtctatgagaccaaccgcagaccctccgggattcctgaccggttttctggaagcaaatccggcacaagcgcgacccttgctatctctgggctgcagacaggagatgaagccgactactattgtaccgtgtggggcgttcgcaagggcgtggccgctgtcttcgggacaggaaccaaagtgacggttctc

SEQ ID NO: 40563 - RNA, 324 nt, synthetic construct
  misc_feature 1..324: note = derived and/or modified sequence opt5 from anti-HIV_119-099719_VR-Chain
  source 1..324: mol_type = other RNA
cagagcgtgctgacccaacccccttccgtctctgccgctccgggccagaaggttacaatcagctgctccgggtctaacagctacattggaaataaatatatctcctggtaccagcagttccccggcacggcccctaagctcctgatttatgagaacaataaaagaccctctggggtgcctgaccggtttagcgcgtccaagagcgctacctctgccacacttgccatcaccggactgcacacaggcgatgaagctgactactattgtgagacctgcgatgggtccggaggcgtgttcggcacagggaccaaagtcacggtgctc

SEQ ID NO: 40564 - RNA, 327 nt, synthetic construct
  misc_feature 1..327: note = derived and/or modified sequence opt5 from anti-HIV_119-099536_VR-Chain
  source 1..327: mol_type = other RNA
gagctgacccagccccctagcgtgtccgccgcttctggccaaaacgtcaatatcagctgctccgggggatctagcaacattggctccaattacgtttcttggtatcagcagttcccggggacagcccccaagctcctgatctacgaaacgaacaaaagacctagcggcattcccgaccggttttccggaagcaagtctggggcgtccgctacccttgccatcacaggactgcagaccggcgatgaggccgactattactgtgctacatgggccgatagcctcaattctgctcgcgtgttcggcaccgggacaaaagtgaccgtcctg

SEQ ID NO: 40565 - RNA, 333 nt, synthetic construct
  misc_feature 1..333: note = derived and/or modified sequence opt5 from anti-HIV_119-098907_VR-Chain
  source 1..333: mol_type = other RNA
cagagcgtgctgacccaacccccttccgtctctgccacaccgggccagaaggttacgatcagctgctccgggtctaacagcaatattggagacaaatacgtgtcctggtatcagcacttccccggcaccgctcctaagctcctggtgtacgagacatatagacggccctctgggatccctgatcgctttagcggatccaaaagcggcacctctgccacacttgcgattaccgggctgcagacaggagacgaagctgattactattgtaccatctggggcgtcagaaagggcgtgggggccgttttcggaacgggcaccaaagtgattgtcctc

SEQ ID NO: 40566 - RNA, 324 nt, synthetic construct
  misc_feature 1..324: note = derived and/or modified sequence opt5 from anti-HIV_119-098555_VR-Chain
  source 1..324: mol_type = other RNA
cagagcgtgctgacccaacccccttccgtctctgccgctccgggccagaacgttacaatcagctgctccgggtctgccagcaatattggaaagaacttcgtgtcctggtaccagcagctccccggcacggcgcctaaactgcttatctatgggtctaataacagacccagcggagtgcctgaccggttttccggcagcaagtctgggacctccgctagcctggccattacaggactccaaaccggcgatgaggccgactactattgtgaaacatgggatggctctggggctgtcttcggaaccggcacaaaagtgaccgttctg

SEQ ID NO: 40567 - RNA, 324 nt, synthetic construct
  misc_feature 1..324: note = derived and/or modified sequence opt5 from anti-HIV_119-097828_VR-Chain
  source 1..324: mol_type = other RNA
cagagcgtgctgacccaacccccttccgtctctgccgctccgggccagaaggttacaatcagctgctccgggtctagctccaacattggcaaaaattacgtgtcttggtatcagctcctgcccggaacggcccctagacttgtgatctacgagaacgacgaacggcccagcgggacccctgatcgcttctccggaagcaagtctggcacatccgcgaccctggctattacagggctccacaccggagacgaggccgattattactgtgaaacatgggacggcagcggcggggtctttggaaccggcacgaaagtgaccgttctg

SEQ ID NO: 40568 - RNA, 324 nt, synthetic construct
  misc_feature 1..324: note = derived and/or modified sequence opt5 from anti-HIV_119-096480_VR-Chain
  source 1..324: mol_type = other RNA
cagagcgtgctgacccaacccccttccgtctctggcgccccggggcagagaatcacaattagctgctccggatctacgagcaacatcggccagaattacgtttcctggtatcagcaactccccgggaccgctcctaagctgcttatttctgacaacaatcggcgccccagctggacacctgatagattctccggaagcaaatctggcacctccgccacactggcgatcaccgggctccagacaggagacgaggctgattactattgtgaaacctgggacggcagcggcggggtgtttggacccggcacgcgggtgaccgtcctg

SEQ ID NO: 40569 - RNA, 324 nt, synthetic construct
  misc_feature 1..324: note = derived and/or modified sequence opt5 from anti-HIV_119-095664_VR-Chain
  source 1..324: mol_type = other RNA
cagagcgtgctgacccaacccccttccgtctctgccgctccgggccagaaggttacaatcagctgctccgggggagccgcgaacattggcaaaaattctgtgagctggtaccagcagctccccgggacggctcctaagctgcttatctatgacaacaatagacggccctccggaacccctgatcgcttctctggcagcaaatccgggacaagcgccaccctggccatttctggactccaaacaggcgacgaggctgattactattgtgaaacctggcacggctccgggggagtgtttggcacagggaccaaggtcacggtgctg

SEQ ID NO: 40570 - RNA, 321 nt, synthetic construct
  misc_feature 1..321: note = derived and/or modified sequence opt5 from anti-HIV_119-095212_VR-Chain
  source 1..321: mol_type = other RNA
cagagcgtgctgacccaacccccttccgtctctgccgctccgggccagaaggttacaatcagctgctccgggtctacgagcaacattggaaaatccgacgtgttctggtaccagcagctccccggcaccgcccctaagctgcttatctctgagacaagcagacggccctccgggattcctgatcgctttagcggagcgaaatctggcacctccgctacactggccatcaccgggctccaaacaggagacgaagccgattatttctgtagcacctggtctggctccctgaattttggcacggggaccagagtgacagtcctt

SEQ ID NO: 40571 - RNA, 333 nt, synthetic construct
  misc_feature 1..333: note = derived and/or modified sequence opt5 from anti-HIV_119-094773_VR-Chain
  source 1..333: mol_type = other RNA
cagagcgtgctgacccaatcccccacagtctctgccgctcctggccagacggttaccatcagctgctccgggggaacatctaacgtgggcaagaatttcgtgagctggtaccagcagtttccgagaaccgcccccaaactcctgatttatgagaacaataagcggccttccgggatccccgaccgcttctctggaagcaaatccggcacaagcgcgacccttgtcattacagggctgcaaaccggagatgaagctgacttttactgtggcacgtgggatggctctctcagaaccgggggagtgatcggcacagggacccgggttacagtgctg

SEQ ID NO: 40572 - RNA, 324 nt, synthetic construct
  misc_feature 1..324: note = derived and/or modified sequence opt5 from anti-HIV_119-094508_VR-Chain
  source 1..324: mol_type = other RNA
cagagcgtgctgacccaacccccttccgtctctgccacaccgggccagagagttacggtgagctgctccgggtctagctccaacatcggaaatcactacgtgtcttggtatcagcaggtccccggcaccgctcctaagctcctgattagcgagaactcccggcgccccagcgggacacctgacagattctctggatccaaaagcggcacctctgccacacttgcgatcaccgggctgcaaacaggagatgaagctgactactattgtgagacctgggatggctccggcggggtgtttggaacgggcaccaaggttacagtgctc

SEQ ID NO: 40573 - RNA, 324 nt, synthetic construct
  misc_feature 1..324: note = derived and/or modified sequence opt5 from anti-HIV_119-093795_VR-Chain
  source 1..324: mol_type = other RNA
cagagcgtgctgacccaacccccttccgtctctgccgctccgggccagaaggttacaatcagctgctccgggtctagctccaacattggaaataactacgtgtcttggtatcagtacctccccggcacggcccctaaactgcttatcagcgagaataacagacggccctccgggacccctgaccgcttcagcggatctaagtccggcacaagcgcgaccctggctattacagggctccagaccggagatgaagccgactattactgtgagacatgggatggctctggcggggtgtttggaaccggcacgaaagtcaccgtgctg

SEQ ID NO: 40574 - RNA, 321 nt, synthetic construct
  misc_feature 1..321: note = derived and/or modified sequence opt5 from anti-HIV_119-093732_VR-Chain
  source 1..321: mol_type = other RNA
cagagcgtgctgacccaacccccttccgtctctgccgctgccggccagaacgttaatatcagctgctccgggagaaagtctaacgtgggaggcaattacgtgagctggtatcagcagttcccggggacagcgcccaaactcctgatttacgaggacaacaagcggccttcctggatccccgatcgctttacggcttctagaagcggaacctccgccacacttggcattaccgggctgcaaacaggagacgaagccgattatttctgtagcacctggtctggctccctcaattttggcacagggacccgggtcacggtgctg

SEQ ID NO: 40575 - RNA, 333 nt, synthetic construct
  misc_feature 1..333: note = derived and/or modified sequence opt5 from anti-HIV_119-092903_VR-Chain
  source 1..333: mol_type = other RNA
cagagcgtgctgacccaacccccttccgtctctgccgctccgagacagaaggttacaatcagctgctccggctctagctccaacattgggaatcactacgtgtcttggtatcagcagctccccggaacggcccctaaactgcttatctacgagaacaataagcggcccagcggcattcctgaccgcttctccgggagcaaatctggaacctccgcgacactggctatcaccggcctccaaacaggggatgaagccgactattactgtgccacctgggctcccagactgaacagcgcccgggtgtttggaaatggcacaatggtcaccgtgctt

SEQ ID NO: 40576 - RNA, 333 nt, synthetic construct
  misc_feature 1..333: note = derived and/or modified sequence opt5 from anti-HIV_119-092284_VR-Chain
  source 1..333: mol_type = other RNA
cagagcgtgctgacccaacccccttccgtctctggcgccccggggcagagagttacaatcagctgcacgggatcctctagcaacattggcgggtacgacgtgcactggtatcaacaggtgcccggaaccgctcctaagctcctgctttacgagaatgatcggcgcccctccggcatccctgacagattctctgggagcaaatccggaacaagcgccaccctggtcattacaggcctccagaccggcgatgaagcggacttttattgtgggacatgggatggatctctgcggaccggcggggtgatcggaacgggcacccgcgttacagtgctt

SEQ ID NO: 40577 - RNA, 333 nt, synthetic construct
  misc_feature 1..333: note = derived and/or modified sequence opt5 from anti-HIV_119-091586_VR-Chain
  source 1..333: mol_type = other RNA
cagagcgtgctgacccaacccccttccatgtctgccgctccgggccagagagtcacaatcagctgctccgggacgtctagcgacattggacggaactacgtttcctggtatcagcagttccccggcgccgcgcctaaggtgctcatctacgaaaattctaaccgccccagcgggattcctgatagattttccggaagcaaatctggcacctccgctacactggccatcagcgggcttcaaaccggagacgaggccgattattgttgcgctgtgtggggcgtccggcgcggcgccggggctgtgttcggagccggcacaaaggttaccgtgctg

SEQ ID NO: 40578 - RNA, 333 nt, synthetic construct
  misc_feature 1..333: note = derived and/or modified sequence opt5 from anti-HIV_119-091023_VR-Chain
  source 1..333: mol_type = other RNA
cagagcgtgctgacccaacccccttccgtctctgccgctccgggccagagagttacaatcagctgctccgggtctacgagcaacattggaaataacttcgtgtcctggtaccaccatgtgcccggcaccgcccctaagctcctgatctatgacaatgtcaaacggcccacaaacgtgcctgatcgcttttctgggagcaagtccggaaccagcgcgacacttgctatttctggcctgcagaccggggacgaggccgattactggtgtgccgtttggggagtgagacggggcgctggcgccgtcttcggggctggaacaaaagtgaccgttctc

SEQ ID NO: 40579 - RNA, 333 nt, synthetic construct
  misc_feature 1..333: note = derived and/or modified sequence opt5 from anti-HIV_119-090334_VR-Chain
  source 1..333: mol_type = other RNA
cagagcgtgctgacccaacccccttccgtctctggcgccccggggcagagagttacaatcagctgcacgggatccgcttctaacattggcgacagcgatgtgcactggtaccagcagctccccgggaccgcccctaagctgcttatcttcgacaatgataaacggccctccggcattcctgaccgcttttctggaagcaagtccgggacaagcgcgaccctggctatcacaggactccaatctggcgatgaggccgactattactgtgccgtgtggggcgtcagacagggggctggagccgtgttcggcaccgggacaaaagttaccgtgctg

SEQ ID NO: 40580 - RNA, 333 nt, synthetic construct
  misc_feature 1..333: note = derived and/or modified sequence opt5 from anti-HIV_119-088694_VR-Chain
  source 1..333: mol_type = other RNA
cagagcgtgctgacccaacccccttccgtctctgccgctccgggccagaaggttacaatcagctgctccgggtctagctccaacattcccatcaatggagtgtcttggtaccagcagttccctggcacggcccccaaactcctggtgtatgagacctacagacggcctagcgggattcccgaccgcttttccggaagcaagtctggcacatccgcgacccttgctatcacagggctgcaaaccggagatgaagccgactattactgtacagtctggggcgtgagaaaaggcgttggggccgtgttcggaaccggcacgaaggtcaccgtgctc

SEQ ID NO: 40581 - RNA, 333 nt, synthetic construct
  misc_feature 1..333: note = derived and/or modified sequence opt5 from anti-HIV_119-088499_VR-Chain
  source 1..333: mol_type = other RNA
cagagcgtgctgacccaacccccttccgtctctgccgctccgggccagaaggttacaatcagctgctccgggtctaacagctacattggaaataaatatgtgtcctggtaccagcagttccccggcacggcccctaagctcctgatctatgagaccaacaaaagaccctctgggattcctgaccggtttagcggatccaagagcggcacatctgcgacccttgctatcacagggctgcaaaccggagatgaagccgactactattgtgccacatgggctccccgcctcaattccgccagagtgttcggcaacggcaccatggtcacggtgctg

SEQ ID NO: 40582 - RNA, 333 nt, synthetic construct
  misc_feature 1..333: note = derived and/or modified sequence opt5 from anti-HIV_119-088298_VR-Chain
  source 1..333: mol_type = other RNA
cagagcgtgctgacccagcccccttccgtctctgccgctccgaaggagaaagttacaatcagctgctccggcgggacgtctaacattggaagaaattacgtgagctggtatcaacaggtgcccggcaccgcccctaagctcctgatctacgaaaacaataaacggccctccgggattcctgaccgcttctctggaagcaagtccggcacaagcgcgacccttgtcatcacagggctgcagaccggagatgaggctgacttttattgtggcacatggggcgggtctctcagaaccggaggcgtgctggggacgggaacccgggttacagtgctt

SEQ ID NO: 40583 - RNA, 324 nt, synthetic construct
  misc_feature 1..324: note = derived and/or modified sequence opt5 from anti-HIV_119-087488_VR-Chain
  source 1..324: mol_type = other RNA
cagagcgtgctgacccaacccccttccgtctctgccgctccgggccagaaggttacaatcttctgcagcgggagatactccaacattgagtctaattatgtgagctggtaccagcagctccccggaacggcccctaaactgcttatccacgaaaacaatcggcgcccctccggcacccctgacagattttctgggagcaagtccggaacaagcgcgaccctggctattacaggcctccataccggggatgaggccgactattactgtgaaacatgggatggatctggcggcgtgttcgggaccggaacgaaagtcaccgtgctg

SEQ ID NO: 40584 - RNA, 333 nt, synthetic construct
  misc_feature 1..333: note = derived and/or modified sequence opt5 from anti-HIV_119-087423_VR-Chain
  source 1..333: mol_type = other RNA
cagagcgtgctgacccaacccccttccgtctctgccgctccgggccagaaggttacaatcagctgctccgcctctagctccaacattgggaataactacgtgtcttggtatcagcagctccccgcgacggctcctaaactgcttatctacgacaccgataagagacccagcgggattcctgaccggttctccggcagcaaatctgggacatccgccaccctggccatcacaggactccaaaccggcgatgaggctgactattactgtacagtgtggggagtccgcaagggagtgggcgccgtttttggcaccgggacgaaagtgaccgtcctg

SEQ ID NO: 40585 - RNA, 324 nt, synthetic construct
  misc_feature 1..324: note = derived and/or modified sequence opt5 from anti-HIV_119-087371_VR-Chain
  source 1..324: mol_type = other RNA
cagagcgtgctgacccaacccccttccctctctgccgctccgggccagagagtcacaatcagctgctccgggggagcctctaacattggcaagaatagcgtttcctggtacgtccaggtgcccgggacggcgcctaaactgcttatctatgagaacaatcagcggccctctggaattagcgaccgcttctccggcagcaagtctgggtccagcgctaccctgggaatcacaggcctccaaaccgccgatgaagccgactactattgtgagacatgggatggctctgggggagtgtttggcaccgggacaaaagtgaccgttctg

SEQ ID NO: 40586 - RNA, 321 nt, synthetic construct
  misc_feature 1..321: note = derived and/or modified sequence opt5 from anti-HIV_119-087279_VR-Chain
  source 1..321: mol_type = other RNA
cagagcgtgctgacccaacccccttccgtctctgccgctccgggccagaaggttacaatcagctgctccgggtctagctccaacattggcaaaaattacgtgtcttggtatcagcagttccccggaacggcccctaagctcctgatgtacgagaacaataaaagacccagcggggtgcctgaccggttttccggaagcaagtctggcacctccgcgacacttgatatcagcgggctgcaaaccggagacgaagctgattattactgttctacatggtccggcagcctcaacttcggcaccgggacacgcgtcaccgtgctg

SEQ ID NO: 40587 - RNA, 324 nt, synthetic construct
  misc_feature 1..324: note = derived and/or modified sequence opt5 from anti-HIV_119-087146_VR-Chain
  source 1..324: mol_type = other RNA
cagagcgtgctgacccaacccccttccgtctctgccgctccgggccagaaggttacaatcagctgctccgggtctagctccaacattggcaaaaattctgtgagctggtaccagcagttccccggaacggcccctaagctcctgatctatgagaacaataaaagaccctccgggattcctgaccggtttagcggatctaagtccggcaccagcgcgacacttgctatcaccgggctgcacacaggagatgaagccgactactattgtgagacctgggatggctctggcggggtgttcggaacaggcaccaaagtcacggtgctc

SEQ ID NO: 40588 - RNA, 324 nt, synthetic construct
  misc_feature 1..324: note = derived and/or modified sequence opt5 from anti-HIV_119-087048_VR-Chain
  source 1..324: mol_type = other RNA
cagttcgtgctgacccaaccccctagcgtctccgccgctccgagacagaaggttatcatttcttgcagcggctcctctagcaacatcgggaaaaattacgtgtcctggtatcagcagctccccggaacagcccctaagctgcttatttacgacaacgataaacggccctctggcatcagcgaccgcttttccgcgagcaagtctgggacgtccgctaccctggccattacaggactccacaccggcgatgaggccgactattactgtgaaacatgggatgggagcggaggcgtgttcggcaccgggacaaaagtcaccgtgctg

SEQ ID NO: 40589 - RNA, 321 nt, synthetic construct
  misc_feature 1..321: note = derived and/or modified sequence opt5 from anti-HIV_119-085802_VR-Chain
  source 1..321: mol_type = other RNA
cagagcatcctgacccaacccccttccgtgtctgccgctccgggccagagagtcacaattccctgcttcgggggacacagcaacatcggctccaattacgtttcttggtatcagcatctccctgggacggcccccaagctgcttatttttgagaacaataaacggcctagcggaatccccgaccgcttctccggcgcgaagtctgggaccagcgctacactggccattaccggactccagacaggcgatgaagccgactacttttgtgctacctggtccggcgggctgaacttcggaacaggcaccaaagtgacggtgctt

SEQ ID NO: 40590 - RNA, 324 nt, synthetic construct
  misc_feature 1..324: note = derived and/or modified sequence opt5 from anti-HIV_119-085784_VR-Chain
  source 1..324: mol_type = other RNA
cagagcttcctgacccaacccccttccgtgtctgccgctccgggccagaaggtcacaatcagctgctccgggtctaacagcaatattggaaacaattacgtttcctggtatcagtacctccccggcacggcccctaaactgcttatctatgagaacgacagacggccctctgggacccctgatcgctttagcggatccaagagcggcacatctgcgaccctggctattacagggctccagaccggagacgaagccgattactattgtgagacatgggacggctccggcggggtgttcggaaccggcacgaaagtgaccgtcctg

SEQ ID NO: 40591 - RNA, 333 nt, synthetic construct
  misc_feature 1..333: note = derived and/or modified sequence opt5 from anti-HIV_119-085370_VR-Chain
  source 1..333: mol_type = other RNA
cagagcgtgctgacccaacccccttccgtctctgccgctccgggccagacagttacgatcagctgctccgggtctagctccaacattggaaatacctacgtgtcttggtatcagcacctccccggcacagcccctaagctgcttatctacgacaacaatattagacccagcgggatccctgatcggttctccgcgagcaaatctggaacctccgctacactggccattaccggcctccagacaggggacgaggccgattattactgtgctacctgggcccccagcctgaactctgctcgcgtgtttggatccggcacgagagtcgccgtgctt

SEQ ID NO: 40592 - RNA, 321 nt, synthetic construct
  misc_feature 1..321: note = derived and/or modified sequence opt5 from anti-HIV_119-085276_VR-Chain
  source 1..321: mol_type = other RNA
cagagcatcctgacccaacccccttccgtgtctgccgctccgggccagagagtcacaattagctgctccgggtctagctccaacatcggaaataactacgtttcttggtatcagcacgtgcccggcacggcccctaagctcctgatttacgagaataaccggcgccccagcgggacccctgacagattctccggagcgaaaagcggcacatctgctacccttgccatcacagggctgcagaccggagatgaagccgactatttttgttccacatggagcggctctctcaatttcggcaccgggacgaaggtgaccgtcctg

SEQ ID NO: 40593 - RNA, 333 nt, synthetic construct
  misc_feature 1..333: note = derived and/or modified sequence opt5 from anti-HIV_119-084885_VR-Chain
  source 1..333: mol_type = other RNA
cagagcgtgctgacccagcccccttccgtctctgccgctccgggcgagaaggttacaatcagctgctccgggtctagctccaaaattggaaacaatttcgtgtcttggtaccaacaggtgcccggcacggcccctaagctcctggtctatgaaagctacagacggccctccgggatccctgaccgctttagcggatctaaatccggcaccagcgcgacacttgctattaccgggctgcagacaggagatgaggccgactattactgtaccgtgtggggcgttagaaagggcgtgggggccgtcttcggaacaggcaccaaagtgacggttctc

SEQ ID NO: 40594 - RNA, 333 nt, synthetic construct
  misc_feature 1..333: note = derived and/or modified sequence opt5 from anti-HIV_119-084874_VR-Chain
  source 1..333: mol_type = other RNA
cagagcgtgctgacccaacccccttccgtctctggcgccccgagacagcgggttacaatcagctgctccgggtctgctagcaacattggaaagaactccgtgtcttggtaccaacaggtgcccggcacggcccctaaactcctgatctatgagaataataagcgccccagcgggattcctgacagattctccggaagcaaatctggcacctccgcgacacttgtcatcaccgggctgcagacaggagatgaagctgacttttactgtggcacctgggatggcagcctccggacagggggagtgattggcaccgggacgcgcgttaccgtgctg

SEQ ID NO: 40595 - RNA, 333 nt, synthetic construct
  misc_feature 1..333: note = derived and/or modified sequence opt5 from anti-HIV_119-084691_VR-Chain
  source 1..333: mol_type = other RNA
cagagcgtgctgacccaacccccttccgtctctgccgctccgggccagaaggttgtgatcagctgctccgggtctagctccattatcgagaaaaactctattagctggtaccagcagggacccggcgccgcgcctaagctcctgatctatgaaaatgacaaaagaccctccgggattcctgatcggttcagcggatctaagtccgctacaagcgccacgcttgccatcgtgggcctgcaaaccggggacgaggctgattactgttgcgccgtctggggagtgcgcagaggcgctggcgccgtttttggggcgggaacaaaagtgaccgtcctc

SEQ ID NO: 40596 - RNA, 324 nt, synthetic construct
  misc_feature 1..324: note = derived and/or modified sequence opt5 from anti-HIV_119-083793_VR-Chain
  source 1..324: mol_type = other RNA
cagagcgtgctgacccaacccccttccgtctctgccgctccgggccagaaggttacaatcagctgctccgggtctagctccaacattggcaaaaattctgtgagctggtaccagcagctccccgccacggcgcctaagctgcttatctatgagtccaacaaaagacccagcgggattcctgaccggttctctggatccaagagcggaacctctgctacactggccatcaccggcctccaaacaggggatgaagccgactactattgtgctacctgggatggacgcgtgtccgtcattggcacaggcaccaaagtgacggttctg

SEQ ID NO: 40597 - RNA, 324 nt, synthetic construct
  misc_feature 1..324: note = derived and/or modified sequence opt5 from anti-HIV_119-083163_VR-Chain
  source 1..324: mol_type = other RNA
cagagcgtgctgacccaacccccttccgtctctggcgccccggggcagagagttatcattagctgcacaggatcctctagcaacatctggggctacgacgtgcagtggtatcagcaactccccgggacggctcctaagctgcttctgtacgagaatgatcggcgcccctccggaacccctgacagattctctggcagcaaatccgggacaagcgccaccctcgcgattacaggactgcacaccggcgatgaagctgactattactgtgagacatgggatggctctgggggagtgtttggcaccgggacgaaggtcaccgtgctt

SEQ ID NO: 40598 - RNA, 333 nt, synthetic construct
  misc_feature 1..333: note = derived and/or modified sequence opt5 from anti-HIV_119-082331_VR-Chain
  source 1..333: mol_type = other RNA
cagagcgtgctgacccaacccccttccatctctgccgctccgggccagaaggtcacaattagctgctccgggggatctagcaacatcggcgccaattacgtttcctggtatcagcacctccccgggacggcgcctaaactgcttatttacgagaccaacaagagaccctctggaatccctgaccggttcagcggctcccagagcgggacatctgctaccctggtgattacaggactccaaaccggcgatgaagccgacttttattgtggcacatggggagggtccctgcgcgccggcggggtgatcggaaccggcacgagagtcaccgtgctt

SEQ ID NO: 40599 - RNA, 324 nt, synthetic construct
  misc_feature 1..324: note = derived and/or modified sequence opt5 from anti-HIV_119-082070_VR-Chain
  source 1..324: mol_type = other RNA
cagagcgtgctgacccaacccccttccgtctctgccgctccgggccagaaggttgtgatcagctgctccgggtctagctccattatcgagaaaaactctattagctggtaccagcagggacccggcgccgcgcctaagctcctgatctatgaaaatgacagacggccctccgggacacctgatcgcttcagcggatctaaatccggcacgagcgctacccttgccattacagggctgcaaaccggagacgaggccgattactattgtgaaacatgggacggctctggcggggtgtttggaaccggcacaaaggtcaccgtgctc

SEQ ID NO: 40600 - RNA, 333 nt, synthetic construct
  misc_feature 1..333: note = derived and/or modified sequence opt5 from anti-HIV_119-081512_VR-Chain
  source 1..333: mol_type = other RNA
cagagcgtgctgacccaacccccttccgtctctgccgctccgggccagaacgttacattcagctgctccgggtctaatagcaacatcggagacaattacgtgtcctggtatcagcagattcccggcacggcccctaagctcgtgatctacgataacaataaaagaccctctgggattcctgaccggtttagcggatccaagagcggcacctctgcgacactggtcatcaccgggcttcaaacaggagatgaggctgacttctattgtggcacctgggatggctccctgcgcacagggggagtgattggcaccgggacgagagttaccgtgctc

SEQ ID NO: 40601 - RNA, 333 nt, synthetic construct
  misc_feature 1..333: note = derived and/or modified sequence opt5 from anti-HIV_119-080816_VR-Chain
  source 1..333: mol_type = other RNA
cagctggtgctcacccaaccccctagcgcctccggcacaccggggcagagagtcacgatctcttgcagcggatcctctagcaacattggctccaatttcgtttcttggtaccagcagcggcccgggaccgctcctaagctgcttatctatgagacaaacaaacgccccagcggcattcctgacagattttccggaagcaagtctgggacctccgccacactggcgatcaccggactccaaacaggcgatgaagctgactactattgtgccacctgggctccccggctgaatagcgcccgcgtgttcggcaacgggacgatggtgaccgtcctt

SEQ ID NO: 40602 - RNA, 333 nt, synthetic construct
  misc_feature 1..333: note = derived and/or modified sequence opt5 from anti-HIV_119-079302_VR-Chain
  source 1..333: mol_type = other RNA
cagagcgtgctgacccaacccccttccgtctctgccgctccgggccagaaggttacaatcagctgctccgggtctagctcctacattggaaacaaatatgtgtcttggtaccagcagttccccggcacggcccctaagctcctgatctatgagaataacaaaagacttagcgggattcccgaccggttttccgcgagcaagtctgctacctccgccacactggccatcagcggactccaaaccggcgatgaagctgacttctactgtgggacatgggatggatctctgcgcaccggcggcgtgattgggacaggaaccagagtcacggtgctt

SEQ ID NO: 40603 - RNA, 327 nt, synthetic construct
  misc_feature 1..327: note = derived and/or modified sequence opt5 from anti-HIV_119-079292_VR-Chain
  source 1..327: mol_type = other RNA
cagagcgtgctgacccaacccccttccgtctctgccgctccgggccagaaggttacaatcagctgctccgggtctaacagcaatattggaaacaattacgtgtcctggtatcagcagctccccggcacggcccctaaactgcttatctacgacaacaataagagaccctctgggattcctgatcggttcagcggatccaaaagcggcacctctgcgacactggggatcaccggactccaaacaggcgacgaggctaactattactgtggcacctgggatacatccctgagcggggtgtttggaaccggcacggaagtcattgtgctt

SEQ ID NO: 40604 - RNA, 321 nt, synthetic construct
  misc_feature 1..321: note = derived and/or modified sequence opt5 from anti-HIV_119-079289_VR-Chain
  source 1..321: mol_type = other RNA
cagagcgccctgacccaacccccttccgtgtctgctgccccgggccagagagtcacaatcagctgctccgggaacaattctaacattggaaataacttcgttagctggtaccagctcctgcccggcacggcgcctaaacttctgatctatgagaataacaagcggtcctctgggattcccgaccgctttagcggatccaagagcggcacctctgctacactcgggatcaccggactgcagacaggcgatgaagccgactacttctgttccacctggagcggctctcttaattttgggacaggaaccagagtgacggtgctg

SEQ ID NO: 40605 - RNA, 324 nt, synthetic construct
  misc_feature 1..324: note = derived and/or modified sequence opt5 from anti-HIV_119-078935_VR-Chain
  source 1..324: mol_type = other RNA
cagagcgtgctgacccaacccccttccgtctctgccgctccgggccagagagttacaatcagctgctccgggacgtctgccaacattgagaattactatgtgagctggtaccagcagctccccggaaccgcgcctaagctgatcatttatgacgataacaaacggccctccggcatccctcaacgcttctctgggagcaagtccggaacaagcgctacccttggcattacagggctgcagaccggagacgaagccgagtactattgtgaaacatgggatggctctggcggggtgtttggaaccggcacgaaagtcaccgtgctc

SEQ ID NO: 40606 - RNA, 324 nt, synthetic construct
  misc_feature 1..324: note = derived and/or modified sequence opt5 from anti-HIV_119-078702_VR-Chain
  source 1..324: mol_type = other RNA
cagagcgtgctgacccaacccccttccgtctctgccgctccgggccagaaggttacaatcagctgctccgggtctagctccgtgttcggcaaaaactacgtgtcttggtatcagcacctccccggaacggcccctaagctgcttatttacgagaataccaaaagacccagcgggatccctgaccggttttccggaagcaagtctggcacatccgcgaccctggctattacagggctccagaccggagatgaagccgactattactgtgagacatgggatggcagcggcggggtcttcggatctggcaccaaagtgacggttctg

SEQ ID NO: 40607 - RNA, 324 nt, synthetic construct
  misc_feature 1..324: note = derived and/or modified sequence opt5 from anti-HIV_119-078593_VR-Chain
  source 1..324: mol_type = other RNA
cagagcttcctgacccagcccccttccgtgtctgccgctccgggccagaaggtcacaatcagctgctccgggtctaacagcaatattggaaacaattacgtttcctggtatcaacaggtgcccggcacggcccctaaactcctgatctacgagaacaataagagaccctctgggattcctgaccggtttagcggatccaaaagcggcacctctgcgacacttgtgatcaccgggctgcacacaggagatgaagctgactattactgtgagacctgggatggctccggcggggtcttcggaacaggcagcaacgtgaccctcctg

SEQ ID NO: 40608 - RNA, 333 nt, synthetic construct
  misc_feature 1..333: note = derived and/or modified sequence opt5 from anti-HIV_119-077708_VR-Chain
  source 1..333: mol_type = other RNA
cagagcgtgctgacccaacccccttccctctctgccgctccgggccagaaggtcacaatcagctgctccgggacgacctctaacattggaaataactacgttagctggtatcagcaccttcccggcacagcccctaaactgctgatctacgagaataccaagagaccctccgggattcctgaccggttctctggaagcaaatccggcacaagcgcgaccctcgggatcacaggactgcagaccggcgatgaagctgactattactgtacggtgtggggcgtgcgcaagggggtcggagccgtgtttggcaccgggacaaaagttaccgtgctt

SEQ ID NO: 40609 - RNA, 321 nt, synthetic construct
  misc_feature 1..321: note = derived and/or modified sequence opt5 from anti-HIV_119-076904_VR-Chain
  source 1..321: mol_type = other RNA
cagagcgtgctgacccaacccccttccgtctctgccgctccgggccagaaggttacaatcagctgctccagatctagctcccacattgagaactcttacgtgagctggtatcagcatctccccgggacggcccctaaactgcttatctacgaaaataacaagcggccctccggcattcctgaccgcttcagcggatctaaatccgggaccagcgcgacactgggaatctctggcctccagaccggggatgaggctgactatttttgttccacatggagcggatctctgaatttcggcaccggcacaagagtgaccgtcctt

SEQ ID NO: 40610 - RNA, 324 nt, synthetic construct
  misc_feature 1..324: note = derived and/or modified sequence opt5 from anti-HIV_119-075862_VR-Chain
  source 1..324: mol_type = other RNA
cagagcgtgctgacccaacccccttccatctctgccgctccgggccagaaggtcacaattagctgctccgggtctgccagcaacatcggcaaaaattccgtttcttggtaccagcagttccccggaacggcgcctaagctcctgatttatgagaacaatagacggcccagcgggacccctgaccgcttttccggaagcaaatctggcacatccgctacccttgccatcacagggctgcaaaccggagatgaagccgactactattgtgagacatgggatggcagcggcggggtgttcggaaccggcacgaaggtgaccgtcctc

SEQ ID NO: 40611 - RNA, 333 nt, synthetic construct
  misc_feature 1..333: note = derived and/or modified sequence opt5 from anti-HIV_119-075465_VR-Chain
  source 1..333: mol_type = other RNA
cagagcgtgctgacccaacccccttccgtctctgccgctccgggccagaaggttgtgatcagctgctccgggtctagctccattatcggaaacaattacgtgtcttggtatcagcagctccccggcacagcccctaaactgcttatttacgagaacaatagacggcccagcgggatccctgaccgcttctccggaagcaagtctggcacgtccgcgaccctggctattagcgggctccaaacaggagatgaagccgactattgttgcgccgtctggggcgtgagacggggcgctggggccgtttttggagctggcaccaaagtgacagtcctg

SEQ ID NO: 40612 - RNA, 330 nt, synthetic construct
  misc_feature 1..330: note = derived and/or modified sequence opt5 from anti-HIV_119-074822_VR-Chain
  source 1..330: mol_type = other RNA
agcgtgctgacccagcccccttccgtctctgccgctccgggccaaaacatcacaattagctgctccgggggatctagcaatatcgccaagaactacatttcctggtatcagcacctccccggcacggcgcctaaaatcgttatttacgacaatgataagagacccctggggatccctgaccggttctctgctagcaaatccggaaccagcgccacacttggcatcaccgggctgcagacaggagatgaggccgactattactgtgctgtgtggggcgtgcgcagaggcgtcggggccgtgtttggagctggcaccaaggttattgtgctc

SEQ ID NO: 40613 - RNA, 333 nt, synthetic construct
  misc_feature 1..333: note = derived and/or modified sequence opt5 from anti-HIV_119-074629_VR-Chain
  source 1..333: mol_type = other RNA
cagagcgtgctgacccaacccccttccgagtctgccgctccgggccagaaggtcacaatcagctgctccgggggaacgtctaacattggcaataactacgttagctggtatagacggctccccgggaccgcccctaaactgcttatctacgaaaataaccgcagaccctccggcattcctgaccggttctctggaagcaagtccgggacaagcgcgaccctggctatctctggactccagacaggcgatgaggccgactattgttgcgccgtgtggggcgtgcgcagaggggctggagccgtctttggcgctgggaccaaagtgacagttctg

SEQ ID NO: 40614 - RNA, 324 nt, synthetic construct
  misc_feature 1..324: note = derived and/or modified sequence opt5 from anti-HIV_119-074500_VR-Chain
  source 1..324: mol_type = other RNA
cagagcgtgctgacccaacccccttccgtctctgccgctccgggccagaaggttacaatgagctgctccgggtctagctccaacatcggaaataactacgtgtcttggtatcagtacctccccggcacggcccctaaactgcttatttatgagaatgacagacggcccagcgggatccctgatcgcttctccgcgagcaagtctggaacctccgctacactggccattaccggcctccagacaggggacgaagccgattactattgtgagacctgggacggaagcggcggcgtgtttgggacaggaaccaaagtcacggtgctg

SEQ ID NO: 40615 - RNA, 333 nt, synthetic construct
  misc_feature 1..333: note = derived and/or modified sequence opt5 from anti-HIV_119-073911_VR-Chain
  source 1..333: mol_type = other RNA
cagagcgtgctgacccaacccccttccgtctctgccgctccgggccagagagttacaatcagctgctccgggtctagctccaacattgagaataactacgtgtcttggtatcagcacctccccggaacggcccctaagctgcttgtgtacgacgataataaacggcccagcggcatccctcatcgcttctccgcgagcaagtctgggacctccgctacactggccattaccggactccagacaggcgacgaagccgattattactgtaccctgtggggagtcagaaaaggggtgggcgctgtttttggcacagggaccaaggtgacggtcctt

SEQ ID NO: 40616 - RNA, 324 nt, synthetic construct
  misc_feature 1..324: note = derived and/or modified sequence opt5 from anti-HIV_119-072765_VR-Chain
  source 1..324: mol_type = other RNA
cagagcgtgctgacccaacccccttccgtctctgccgctccgggccagaaggttacaatcagctgctccgggaactctagcaatattggaaacaatttcgtgtcctggtaccaacaggtgcccggcacggcccctaaactcctggtctatgagacctacagacggccctctgggacacctgaccgctttagcggatccaagagcggcacctctgcgacacttgctatctccgggctgcagaccggagatgaagccgactattactgtggcacatgggatggcagcgggggagtgttcggcaccgggacgaaagttaccgtgctc

SEQ ID NO: 40617 - RNA, 333 nt, synthetic construct
  misc_feature 1..333: note = derived and/or modified sequence opt5 from anti-HIV_119-072313_VR-Chain
  source 1..333: mol_type = other RNA
cagttcgtgctgacccaaccccctagcgtctccgccgctccgggccagaaggttacaatctcttgcagcgcctcctctagcattatcgggaaaaactacgtgtcctggtatcagcagtttcccggaacggcgcctaagctcctgatttacgaggacaataaaagaccctctggcatccctgatcggttcagcgggtccaagagcggaacctctgctacacttgccattaccggcctgcaaacaggggacgaagccgattattactgtaccgtgtggggagtccgcaaaggcgtgggcgctgtttttgggacaggaaccaaggtgacggtcctc

SEQ ID NO: 40618 - RNA, 333 nt, synthetic construct
  misc_feature 1..333: note = derived and/or modified sequence opt5 from anti-HIV_119-072280_VR-Chain
  source 1..333: mol_type = other RNA
cagagcgtgctgacccaacccccttccgtctctgccgctccgggccagaaggttagcatctcctgctctgggagcgactccaacctcggagataattacgtgtcttggtatcagcagttccccggcacagcccctaaactgcttattcacgacaacaataagagacccagcgggacgcctgatcggttttccggaagcaaatctggcacctccgcgacactggctatcaccgggctccaaacaggagacgaggccgattactattgtgccacctgggctccccgcctgaacagcgccagagtgttcggcaatggcacaatggtcaccgtgctt

SEQ ID NO: 40619 - RNA, 333 nt, synthetic construct
  misc_feature 1..333: note = derived and/or modified sequence opt5 from anti-HIV_119-071693_VR-Chain
  source 1..333: mol_type = other RNA
cagagcgtgctgacccaacccccttccgtctctgccgctccgggccagaaggttgtgatcagctgctccgggtctagctccattatcgagaaaaactctattagctggtaccagcagggacccggcgccgcgcctaagctcctgatctatgaaaatgacaaaagaccctccgggattcctgatcggttcagcggatctaagtccggcacaagcgctacgcttgccatcaccgggctgcaaacaggagacgaggccgattactattgtaccatctggggcgtgcgcaaaggcgtcggggctgtgtttggaacaggcaccaaggttacagtgctc

SEQ ID NO: 40620 - RNA, 321 nt, synthetic construct
  misc_feature 1..321: note = derived and/or modified sequence opt5 from anti-HIV_119-071353_VR-Chain
  source 1..321: mol_type = other RNA
cagagcgtgctgacccaacccccttccgcctctgctgccccgggccagaaggtcacaatcagctgctccgggtctaacagcaatattggaaacaatttcgtttcctggtaccagctctttcccggcacggcgcctaaactgcttatcttcgagaacaataagagaccctctgggattcctgaccggtttagcggagctaaatccggcaccagcgccacactggccatcaccgggctccagacaggagatgaagctgactatttctgttctacctggtccggcagcctgaactttggcacagggacccgcgtgacggtgctt

SEQ ID NO: 40621 - RNA, 324 nt, synthetic construct
  misc_feature 1..324: note = derived and/or modified sequence opt5 from anti-HIV_119-069711_VR-Chain
  source 1..324: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgacaataacaatagacccagcggggtgcctgatcggttctccggaagcaagtctggcacctccgcgacactggctattaccgggctccaaacaggagacgaggccgattattactgtgaaacctgggacgatagcggcggcgtctttgggacaggaaccaaagtgacggttctg

SEQ ID NO: 40622 - RNA, 333 nt, synthetic construct
  misc_feature 1..333: note = derived and/or modified sequence opt5 from anti-HIV_119-069061_VR-Chain
  source 1..333: mol_type = other RNA
cagagcgtgctgacccaacccccttccgtctctgccgctccgggccagaaggttacaatcagctgctccgggtctagctccaacattggatctaattacgtgagctggtatcagcagctccccggcacggcccctaaactgcttgtgtacgacaacaatgagagaccctccgggatccctgatcggttcagcggatctaagtccggcaccagcgcgacactggctattaccgggctccaaacaggagacgaagccgattattactgtgccacctgggctccccgcctgaactctgccagagtctttggcaatggcacaatggtgaccgttctt

SEQ ID NO: 40623 - RNA, 324 nt, synthetic construct
  misc_feature 1..324: note = derived and/or modified sequence opt5 from anti-HIV_119-068202_VR-Chain
  source 1..324: mol_type = other RNA
cagagcgtgctgacccaagagccctccgtctctggcgcccctgggcagagagttacaatcagctgcacgggatccaactctaatattggcgggcacgacgtgcattggtaccagcagctcccgggaaccgctcccaagctgcttatctatgataacgacaaacggcctagcggcattcccgatcgcttctccgggtctaagagcgacacatccgccagcctgggaatcaccggcctccaaacaggcgatgaagcggactactattgtgagacctgggatgggtctggaggcgtgtttgggacaggaaccaaagtcacggtgctg

SEQ ID NO: 40624 - RNA, 324 nt, synthetic construct
  misc_feature 1..324: note = derived and/or modified sequence opt5 from anti-HIV_119-068063_VR-Chain
  source 1..324: mol_type = other RNA
cagagcgccctgacccaacccccttccgcttctggcagcctcgggcagtccgtgacaatctcttgcacgggaaccagaagcgacgtcggcaactactatgtttcctggtaccagcagctgccggggacagcccccaaacttctgatttctgagaataaccggcgccctagcggaacccccgatagattctccggcagcaagtctgggacatccgcgaccctcgctatcagcggactgcaaacaggcgacgaagccgattattactgtggcacctgggacgggtctggaggcgtgtttgggacgggaaccaaggtgacagtcctt

SEQ ID NO: 40625 - RNA, 333 nt, synthetic construct
  misc_feature 1..333: note = derived and/or modified sequence opt5 from anti-HIV_119-067980_VR-Chain
  source 1..333: mol_type = other RNA
cagagcgtgctgacccaacccccttccgtctctgccgctccgggccagaaggttacaatcagctgctccgggaactctagcaatattggaaacaatttcgtgtcctggtaccaacaggtgcccggcacggcccctaaactcctggtctatgagacctacagacggccctctgggatccctgaccgctttagcggatccaagagcggcacatctgcgacccttgctattacagggctgcagaccggagatgaagccgactatcactgtgccatctggggcgtgagaaaaggcgttggggctgtgttcggaacaggcaccaaggtcacggtggtt

SEQ ID NO: 40626 - RNA, 324 nt, synthetic construct
  misc_feature 1..324: note = derived and/or modified sequence opt5 from anti-HIV_119-067866_VR-Chain
  source 1..324: mol_type = other RNA
cagagcgtgctgacccaacccccttccgtctctgccgctccgggccagaaggttacaatcagctgctccgggtctacgagcaccattggaaacaattacgtgtcctggtatcagcacctccccggcacagcccctaaactgcttatctacgacaacaataagagacccgcggggattcctgatcggttcaccgcttctaaaagcggaacatccgccaccctggccatcacaggcctccataccggggacgaggctgattattactgtgaaacgtgggacggaagcggcggcgtgtttgggaccggaacaaaggtcaccgtgctg

SEQ ID NO: 40627 - RNA, 321 nt, synthetic construct
  misc_feature 1..321: note = derived and/or modified sequence opt5 from anti-HIV_119-067756_VR-Chain
  source 1..321: mol_type = other RNA
cagagcgtgctgacccaacccccttccgtctctgccgctccgggccagaaggttgtgatcagctgctccgggtctacaagcaacattggcaaaaatttcgtgtcctggtaccagcagctccccggaacggcccctaagctgcttatctatgagaactctagacggcccagcgggattcctgaccgcttttccggagcgaaaagcggcacctctgctacactggccatcaccgggctccaaacaggagatgaagccgactacttctgttccacctggagcggctctctgaattttggcacagggaccagagtcacggtgctt

SEQ ID NO: 40628 - RNA, 321 nt, synthetic construct
  misc_feature 1..321: note = derived and/or modified sequence opt5 from anti-HIV_119-066859_VR-Chain
  source 1..321: mol_type = other RNA
cagagcgtgctgacccaacccccttccgtctctgccgctccgggccagaaggttacaatcacgtgcagcgggtccgcctctaacattgagaataactacgtgagctggtatcagcagttccccggacctgcgcccaaactcctgatctacgaaaatgacaagagaccttccggcattcccgatcggttttctgggagcgcttccggaaccagcgccacacttgccatcaccggcctgcaaacaggggacgaggctgattatttctgttctacctggtccggaagcctcaactttggcacaggcacccgcgtgacggtcctg

SEQ ID NO: 40629 - RNA, 333 nt, synthetic construct
  misc_feature 1..333: note = derived and/or modified sequence opt5 from anti-HIV_119-065821_VR-Chain
  source 1..333: mol_type = other RNA
cagagcgtgctgacccaacccccttccgtctctgccacaccgggccagagagttacggtgagctgctccgggtctagctccaacatcggaaatcactacgtgtcttggtatcagcaggtccccggcaccgctcctaagctcctgatttacgacaacagcaatcggccctccgggatccctgatcgcttcagcggatctaaatccggcacaagcgccacccttgggattacaggactgcaaaccggcgacgaggcggattattactgtacagtgtggggcgttagaaagggggtgggagctgtctttggcaccgggacgaaagtgaccgttctc

SEQ ID NO: 40630 - RNA, 333 nt, synthetic construct
  misc_feature 1..333: note = derived and/or modified sequence opt5 from anti-HIV_119-065191_VR-Chain
  source 1..333: mol_type = other RNA
cagagcgtgctgacccaacccccttccgtctctgccgctccgggccagaaggttacaatcagctgctccgggaacaattctaacattggaaataactacgtgagctggtatcagcagctccccggcacggcccctaaactgcttatcttcgagaatcacaagagaccctccgggattcctgaccggttttctggaagcaaatccggcaccagcgcgacactggggatcaccggactccaatctggcgatgaagctgactactattgtgccacatgggctccccgcctgaactccgccagagtgttcggcaccgggacaaaggtcaccgtgctt

SEQ ID NO: 40631 - RNA, 333 nt, synthetic construct
  misc_feature 1..333: note = derived and/or modified sequence opt5 from anti-HIV_119-064667_VR-Chain
  source 1..333: mol_type = other RNA
cagagcgtgctgacccaacccccttccgtctctgccgctccgggccagaaggttacaatcagctgctccgggtctaacagctacattggaaataaatatgtgtcctggtaccaacaggtgcccggcacggcccctaagctcctgatctatgagaacaataaaagaccctctgggattcctgaccggttcagcggatccaagagcggcacctctgcgacacttgtcatcaccgggctgcagacaggagatgaagctgacttttactgtggcacctgggatggctccctccgcacagggggagtgattggcaccgggacgagagttaccgtgctg

SEQ ID NO: 40632 - RNA, 324 nt, synthetic construct
  misc_feature 1..324: note = derived and/or modified sequence opt5 from anti-HIV_119-063791_VR-Chain
  source 1..324: mol_type = other RNA
cagagcgtgctgacccaacccccttccgtctctgccgctccgggccagaaggttcccatcagctgctccgggaactctagcaatattggaaacaattacgtgtcctggtatcagcagctccctggcacagcccccaaactgcttatctacgagaacaataagagaccttctgggattcccgaccggttcagcggatccaaaagcggcacgtctgcgaccctggctatcacagggctccacaccggagatgaagccgactattactgtgagacatgggatggctccggcggggtgtttggaaccggcacaaaggtcaccgtgctg

SEQ ID NO: 40633 - RNA, 333 nt, synthetic construct
  misc_feature 1..333: note = derived and/or modified sequence opt5 from anti-HIV_119-062989_VR-Chain
  source 1..333: mol_type = other RNA
cagagcgtgctgacccaacccccttccgtctctgccgctccgggccagagagttacaatcagctgctccgggtctagctccaacattggaaataacttcgtgtcttggtaccagcagtttcccggcacggtgcctaagctcctgatctatgagaataaccggcgccccagcgggattcctgacagattctccggaagcaaatctggcacctccgccacacttgcgatcaccgggctgcaaacaggagatgaagctgactactattgtgccgtctggggcgtgcggcgcggcgttggggccgtgtttggagctggcaccaaggtcattgtgctc

SEQ ID NO: 40634 - RNA, 321 nt, synthetic construct
  misc_feature 1..321: note = derived and/or modified sequence opt5 from anti-HIV_119-062286_VR-Chain
  source 1..321: mol_type = other RNA
cagagcgtgctgacccaacccccttccgtctctgccgctccgggccagaaggttacaatcagctgctccgggtctgccagcaacattggcaaaaatttcgtgtcctggtaccagcagctccccggaacggcgcctaagctgcttatctctgagaacaatagacggcccagcgggacccctgaccgcttttccggaagcaaatctggcgcttccgccacactggtgattagcgggctccaaaccggagatgaagccgactattactgtgctacatggtctggctccctgagcatcggcaccgggacaaaggtcaccgtgctt

SEQ ID NO: 40635 - RNA, 321 nt, synthetic construct
  misc_feature 1..321: note = derived and/or modified sequence opt5 from anti-HIV_119-061416_VR-Chain
  source 1..321: mol_type = other RNA
cagagcgtgctgacccaacccccttccgtctctgccgctccgggccagaaggttgtgatcagctgctccgggtctagctccattttcgagaaaaactctatcagctggtaccagcagggacccggcgccgcgcctaagctcctgatttatgaaaatgacaaaagacggtccgggatccccgatcgctttagcggatctaagtccgctacaagcacgacccttgccattgtgggcctgcaaacaggggacgaggccgattacttctgttctacctggtccggaagcctcaactttggcacaggcaccagagtcacagtgctg

SEQ ID NO: 40636 - RNA, 321 nt, synthetic construct
  misc_feature 1..321: note = derived and/or modified sequence opt5 from anti-HIV_119-061344_VR-Chain
  source 1..321: mol_type = other RNA
cagagcgtgctgacccaacccccttccgtctctgccgctccgggccagaaggttacaatcagctgctccgggtctagctccgtgttcggaaagaactacgtgtcttggtatcagcacctccccggcacggcccctaagctgcttatttacgagaataacaaaagacccagcgggatccctgaccggttttccggagcgaaaagcggcaccgctgccacactggccattaccgggctccagacaggagatgaagctgactattactgtgccacctggtctggctccctgaatttcggcacagggaccaaagtcacggtgctt

SEQ ID NO: 40637 - RNA, 324 nt, synthetic construct
  misc_feature 1..324: note = derived and/or modified sequence opt5 from anti-HIV_119-060240_VR-Chain
  source 1..324: mol_type = other RNA
cagagcgtgctgacccaacccccttccgagtacggcgccccggggcacaacgtcacagtttcttgcagcggaacgacctccaatatcgaaaacaatttcgtgtcttggtatctcattgtgcccggcacagctcctaagctgcttatctttgacaacgataaaagacccagcgggattcctgaccggttctccggatctaagagcggcacctccgccacactggcgatcaccgggctccagacaggagatgaggctgactactattgtgccacctgggatggccgcgtcagcgtgattggcacggggaccaaagttacagtgctg

SEQ ID NO: 40638 - RNA, 333 nt, synthetic construct
  misc_feature 1..333: note = derived and/or modified sequence opt5 from anti-HIV_119-060184_VR-Chain
  source 1..333: mol_type = other RNA
cagagcgtgctgacccaacccccttccgtctctggcgccccggggcagagagttacaatcagctgctccggatctagctccaacattggctctaatacggtgaactggtaccagcagctccccgggaccgctcctaagctgcttatctatgacaataacaaacggcccagcggcattcctgatcgcttctccggaagcaagtctgggacatccgccaccctggtgatcacaggactccaaaccggcgacgaggcggatttttactgtggcacatgggacgggagcctgagaaccggaggcgtcattgggacgggaacccgggtgacagttctt

SEQ ID NO: 40639 - RNA, 321 nt, synthetic construct
  misc_feature 1..321: note = derived and/or modified sequence opt5 from anti-HIV_119-058035_VR-Chain
  source 1..321: mol_type = other RNA
cagagcgtgctgacccaacccccttccgtctctgccgctccgggccagaaggttacaatcagctgctccgggtctgccagcaacattggcaaaaatttcgtgtcctggtaccagcagctccccggaacggcgcctaagctgcttatctatgagaacaatagacggccctctgggacccctgaccgctttagcggagctaaatccggcacaagcgccaccctggccattacagggctccaaaccggagatgaagctgactacttctgttctacatggtccggcagcctgaactttggcaccgggacgagagtgaccgtcctt

SEQ ID NO: 40640 - RNA, 321 nt, synthetic construct
  misc_feature 1..321: note = derived and/or modified sequence opt5 from anti-HIV_119-057858_VR-Chain
  source 1..321: mol_type = other RNA
cagagcgtgctgacccaacccccttccgtctctgccgctccgggccagaacgttaatatcagctgctccgggggatctagcaacattggctccaattacgtgtcttggtatcagcagttccccgggacagcccctaagctcctgatctacgagaacaataaaagacccagcggcattcctgaccggttttccggagctaagagcgggacgtctgcgacccttgccatcacaggactgcaaaccggcgatgaagccgactatttctgttccacatggagcggctctctcaactttgggaccggaacacgcgtgaccgtcctg

SEQ ID NO: 40641 - RNA, 324 nt, synthetic construct
  misc_feature 1..324: note = derived and/or modified sequence opt5 from anti-HIV_119-057473_VR-Chain
  source 1..324: mol_type = other RNA
cagagcgtgctgacccaacccccttccgtctctgccgctccgggccagaaggttacaatcagctgctccgggtctagctccaacattggaaataactacgtgtcttggtatcagcacctccccggcacggcccctaaactgcttatctacgacacctatagcagaccctccgggattcctgatcggttcagcggatctaagtccggcacaagcgcgaccctggctatcacagggctccagaccggagacgaggccgattactattgtggcacatgggacggctctgggggagtgtttggcaccgggacgaaagtcaccgtgctg

SEQ ID NO: 40642 - RNA, 321 nt, synthetic construct
  misc_feature 1..321: note = derived and/or modified sequence opt5 from anti-HIV_119-057090_VR-Chain
  source 1..321: mol_type = other RNA
cagagcgtgctgacccaacccccttccgtctctgccgctccgggccagacagttacgatcagctgctccgggtctaccagcaacattggaaagaatgacgtgtcctggtaccagcagctccccggcacagcccctaaactgcttatctctgagaacaatagacggcccagcgggacccctgatcgcttctccgcgagcaagtctggaacatccgctaccctggccattacaggcctccaaaccggggacgaagccgattatttttgtagcacgtggtctggatccctgaacttcggcaccggcacaagagtgaccgtcctt

SEQ ID NO: 40643 - RNA, 333 nt, synthetic construct
  misc_feature 1..333: note = derived and/or modified sequence opt5 from anti-HIV_119-055754_VR-Chain
  source 1..333: mol_type = other RNA
cagagcgtgctgacccaacccccttccgtctctgccgctccgggccagaaggttacaatcagctgctccgggaactctagctccattggaaataacttcgtgtcttggtaccagcagctccccggcacggcccctaaactgcttgtgtatgagaattacagacggcccagcgggatccctgaccgcttttccggaagcaagtctggcacctccgcgacactggctattgatgggctccaaacctgggacgaagccgattatcactgtgccatctggggagtcagaaaaggcgtgggcgctgttttcgggacaggaaccaaggtgacagtcgtg

SEQ ID NO: 40644 - RNA, 324 nt, synthetic construct
  misc_feature 1..324: note = derived and/or modified sequence opt5 from anti-HIV_119-054899_VR-Chain
  source 1..324: mol_type = other RNA
cagagcgtgctgacccaacccccttccgtctctgccgctccgggccagaaggttacaatcagctgctccgggtctaacagctacattggaaataaatatgtgtcctggtaccagcagttccccggcacggcccctaagctcctgatccacgagaacaatagacggccctctgggacccctgaccgctttagcggatccaaaagcggcacatctgcgacccttgctatttccgggctgcaaacaggagatgaagccgactattactgtgagacctgggatggcagcggcggggtgttcggaacaggcaccaaggtcacggtgctc

SEQ ID NO: 40645 - RNA, 324 nt, synthetic construct
  misc_feature 1..324: note = derived and/or modified sequence opt5 from anti-HIV_119-054501_VR-Chain
  source 1..324: mol_type = other RNA
cagagcgtgctgacccaacccccttccgtctctgccgctccgggccagaaggttacaatcagctgctccgggacgtctagcaacattggaaataactacgtgtcctggtatcagcacctccccggcaccgcccctaaactgcttatcttcgagacaaataagagaccctctgggattcctgaccggtttagcgcgtccaaaagcggaacctctgctacactggccatcaccggcctccagacaggggatgaagccgactactattgtgagacctgggatggatccggcggcgtgttcgggcccggaacgcgcgtcaccgtgctg

SEQ ID NO: 40646 - RNA, 324 nt, synthetic construct
  misc_feature 1..324: note = derived and/or modified sequence opt5 from anti-HIV_119-051867_VR-Chain
  source 1..324: mol_type = other RNA
cagagcgtgctgacccaacccccttccgtctctgccgctccgggccagaaggttacaatcagctgctccgggaactctagcaatattggaaacaatttcatctcctggtaccagcagctccccggcacggcccctaaactgcttatttatgagaacgacagacggccctctgggacccctgatcgctttagcggatccaagagcggcacatctgcgaccctggctatcacagggctccaaaccggagacgaagccgattactattgtgagacatgggacggctccggcggggtgttcggaaccggcacgaaagtgaccgtcctg

SEQ ID NO: 40647 - RNA, 324 nt, synthetic construct
  misc_feature 1..324: note = derived and/or modified sequence opt5 from anti-HIV_119-051814_VR-Chain
  source 1..324: mol_type = other RNA
cagagcgtgctgacccaacccccttccgtctctgccgctccgggccagaaggttacaatcagctgctccgggtctaacagcaatattggaaacaaagacgtgtcctggtaccagcagatccccgccacggcgcctaagctcctgatttatgagaataacaaaagaccctctggcatccctgatcggttcagcgggtccaagagcggaacctctgctacacttgccattaccggcctgcaaacaggggacgaagccgattactattgtgctacctgggacggacgcgtgtccgtcatcggcacaggcaccaatgtgatcgttctc

SEQ ID NO: 40648 - RNA, 321 nt, synthetic construct
  misc_feature 1..321: note = derived and/or modified sequence opt5 from anti-HIV_119-051567_VR-Chain
  source 1..321: mol_type = other RNA
cagagcgtgctgacccaacccccttccgtctctgccgctccgggccagaaggttacaatctactgcagcgggtccagatctaacattggacggaattatgccagctggtaccagcagctccccggcacggcgcctaaactgcttatcttcgacaacaatcgcagaccctccgggattcctgatcggttttctggagctaagagcggcacctccgccacactggccatcaccgggctccaaacaggagacgaggctgattatttctgtagcacctggtctggctccctgaactttggcacagggacccgcgtgacggtgctt

SEQ ID NO: 40649 - RNA, 324 nt, synthetic construct
  misc_feature 1..324: note = derived and/or modified sequence opt5 from anti-HIV_119-051483_VR-Chain
  source 1..324: mol_type = other RNA
cagagcgtgctgacccaacccccttccgtctctgccgctccgggccagaagctcacaatcagctgctccgggacgtctagcaacattggaaataactacgtttcctggtatcagcaccttcccggcaccgcccctaaactgctgatctacgagaataacagacggccctctgggattcctgaacgcttcagcgcgtccaagagcggaacatctgctaccctcggcatcacagggctgcagaccggagacgaggccgattattactgtgaaacatgggacgattccggcggcgtgtttgggaccggaacgaaagtgaccgtcctt

SEQ ID NO: 40650 - RNA, 333 nt, synthetic construct
  misc_feature 1..333: note = derived and/or modified sequence opt5 from anti-HIV_119-050913_VR-Chain
  source 1..333: mol_type = other RNA
cagagcgtgctgacccaacccccttccgtctctgccgctccgggccagaaggttacaatcagctgctccgggggaacgtctaacattggcaataactacgtgagctggtatcagcagctccccgggaccgcccctagactgcttatctacgagacaaataaacggccctccggcattcctgaccgcttctttggatctaagagcgggacctccgcgacactggctatcagcggactccaaaccggcgatgaagccgactattactgtacagtgtggggcgtcagaaaaggggtgggagccgttttcggcaccgggacgaaggtgaccgtcctg

SEQ ID NO: 40651 - RNA, 333 nt, synthetic construct
  misc_feature 1..333: note = derived and/or modified sequence opt5 from anti-HIV_119-050187_VR-Chain
  source 1..333: mol_type = other RNA
cagagcgtgctgacccaacccccttccgtctctgccgctccgggccagaaggttacaatcagctgctccgggtctagctccaacattggcaaaaattctgtgagctggtaccagcagttccccggaacggcccctaagctcctgatctatgagaacaataaaagaccctccgggattcctgaccggtttagcgattctcaatccggaaccagcgcgacacttgctatcaccggcctgcagacaggggacgaagccgattactcttgtgccacctgggctgcctccctcaacagcgctcgcgtgttcggaacaggcaccagagtcacggtgctg

SEQ ID NO: 40652 - RNA, 324 nt, synthetic construct
  misc_feature 1..324: note = derived and/or modified sequence opt5 from anti-HIV_119-049069_VR-Chain
  source 1..324: mol_type = other RNA
cagagcgtgctgacccaacccccttccgtctctgccgctccgggccagaaggttacaatcagctgctccgggtctacgagcaacattggaaaatccgacgtgttctggtaccagcagctccccggcaccgcccctaagctgcttatctctgagacaagcagacggccctccgggacccctgatcgctttagcggatctaaatccggcacaagcgcgaccctgacaattaccgggctccaaacgggagacgaagctgattattactgtgaggcctgggacggctctggcggggtgttcggaaccggcacaaaggtcaccgtgctg

SEQ ID NO: 40653 - RNA, 333 nt, synthetic construct
  misc_feature 1..333: note = derived and/or modified sequence opt5 from anti-HIV_119-048517_VR-Chain
  source 1..333: mol_type = other RNA
cagagcgtgctgacccaacccccttccgtctctgccgctccgggccagaaggttacaatcagctgctccgggtctaaattcaacattggaaataaggacgtgagctggtaccagcactcccccggcacggcccctaaactcctgatctatgagaacaataagagaccctctgggattcctgatcggtttagcggatccaaaagcggcacctctgcgacacttgggatctccggactgcagaccggcgacgaagctgattactgttgcgccgtgtggggcgtccgcagaggggccggagctgtgttcggcgccgggacaaaggttaccgtgctc

SEQ ID NO: 40654 - RNA, 333 nt, synthetic construct
  misc_feature 1..333: note = derived and/or modified sequence opt5 from anti-HIV_119-048470_VR-Chain
  source 1..333: mol_type = other RNA
cagagcgtgctgacccaacccccttccgtctctgccgctccgggccagaaggttacaatcagctgctccgggtctacgagcaacattggcaaaaatctcgtgtcctggtaccagcagttccccggaaccgcccctaagctgcttatctatgagaacaatagacggccctctgggattcctgaccgctttagcggatccaaaagcggcacatctgcgaccctggtgatcacagggctccaaaccggagatgaagctgacttctactgtggcacatggggcgggtccctgagagccggaggcgtcattgggaccggaacgcgggtgaccgttctt

SEQ ID NO: 40655 - RNA, 282 nt, synthetic construct
  misc_feature 1..282: note = derived and/or modified sequence opt5 from anti-HIV_119-048303_VR-Chain
  source 1..282: mol_type = other RNA
agcgtgctgacccagcccccttccgtctctgccgctccgggccaaaacatcacaattagctgctccgggtctatcagcaatattgcctccaacttcatctcttggtaccagcagctccccggaacggcgcctaagattatcatctatgacaatgatcagagacccctgggcattcctgctcggtttagcgggtccaaaagcggagcctctgccacccttgttatcacaggcctgcaaaccggggacgaggctgattactattgtggaacatgggacggctcc

SEQ ID NO: 40656 - RNA, 333 nt, synthetic construct
  misc_feature 1..333: note = derived and/or modified sequence opt5 from anti-HIV_119-048021_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgacaataacaagagacccagcgggattcctgatcggttctccggaagcaaatctggcacctccgcgacactggtgatcaccgggctccaaacaggagacgaggctgatttttattgtggcacctgggacggcagcctgtctgggggaggcgtcattgggacaggaacccgcgtgacggttctt

SEQ ID NO: 40657 - RNA, 324 nt, synthetic construct
  misc_feature 1..324: note = derived and/or modified sequence opt5 from anti-HIV_119-047928_VR-Chain
  source 1..324: mol_type = other RNA
cagagcgtgctgacccaacccccttccgtctctgccgctccgggccagaaggttacaatcagctgctccgggtctaacagcaatattggaaacaattgtgtgtcctggtaccaacaggtgcccggcacggcccctaaactcctgatctatgagaacaatagacggccctctgggattcctgaccgcttcagcggatccaagagcggcacctctgcgacacttgctatctccgggctgcagaccggagatgaagccgactactattgcggcacatgggatggcagcgggggagtctttggcaccgccacaaaagtgaccgttctc

SEQ ID NO: 40658 - RNA, 324 nt, synthetic construct
  misc_feature 1..324: note = derived and/or modified sequence opt5 from anti-HIV_119-047384_VR-Chain
  source 1..324: mol_type = other RNA
cagagcgtgctgacccaacccccttccgtctctgccgctccgggccagaaggttacaatcagctgctccgggtctaacagcaatattggaaacaaagacgtgtcctggtacagacaggtgccccctacggcccccaagctcctgatctatgagaataacaaacggccttctggcattcccgatcgcttcagcgggtccaagagcggaacctctgcgacacttgctatcaccggcctgcagacaggggacgaagccgattactattgtgccacctgggacggaagagtctccgtgtttggcacaggcaccaaagttgctgtgctc

SEQ ID NO: 40659 - RNA, 333 nt, synthetic construct
  misc_feature 1..333: note = derived and/or modified sequence opt5 from anti-HIV_119-047145_VR-Chain
  source 1..333: mol_type = other RNA
cagagcgtgctgacccaacccccttccgtctctgccgctccgggccagacagttaacatcagctgctccgggtctaatagcaacattggatccaagtacgtgtcttggtatcagcacttccccggcacggcccctaaactcctgatctacgagaataacaagagaagctccgggattcccgaccggtttagcggatctaaatccgcgaccagcgctacacttgccatcaccggcctgcagacaggggatgaagccgactattactgtgctacctgggccccttctctcaattccgctcgcgtgttcggaacaggcaccaaggtcacggtgctg

SEQ ID NO: 40660 - RNA, 333 nt, synthetic construct
  misc_feature 1..333: note = derived and/or modified sequence opt5 from anti-HIV_119-046752_VR-Chain
  source 1..333: mol_type = other RNA
cagagcgtgctgacccaacccccttccgtctctgccgctccgggccagaaggttacaatcagctgctccgggaactctagctccattggaaataacttcgtgtcttggtaccagcagctccccggcacggcccctaaactgcttgtgtatgagaattacagacggcccagcgggatctccgaccgctttagcggatctaagtccggcaccagcgcgacactggctattaccgggctccaaacaggagatgaagccgactattactgtaccgtctggggcgtgagaaaaggcgttggggccgtgttcggaacaggcaccaaggtcacggtgctg

SEQ ID NO: 40661 - RNA, 324 nt, synthetic construct
  misc_feature 1..324: note = derived and/or modified sequence opt5 from anti-HIV_119-046660_VR-Chain
  source 1..324: mol_type = other RNA
cagagcgtgctgacccaacccccttccgtctctgccgctccgggccagaaggttacaatcagctgctccgggtctagctccaacattggaaatcactacgtgtcttggtatcagcagctccccggcacggcccctaaactgcttatctacgacaacaataagagacccagcgggattcctgatcggttctccgcgagcaaatctggaacctccgctacactgggcatcaccgggctccaaacaggagacgaggccgattattactgtgccacctgggacggccgcgtgagcgtcattggcacagggaccaaggtgacggttgtg

SEQ ID NO: 40662 - RNA, 333 nt, synthetic construct
  misc_feature 1..333: note = derived and/or modified sequence opt5 from anti-HIV_119-046202_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttgtgtacgagaattatagacggcccagcgggatccctgaccgcttctccggaagcaagtctggcacctccgcgacactggctattaccgggctccaaacaggagatgaagccgactaccactgtgccatctggggcgtcagaaaaggcgtgggggctgtttttggaaccggcacaaaggtgaccgtcgtg

SEQ ID NO: 40663 - RNA, 333 nt, synthetic construct
  misc_feature 1..333: note = derived and/or modified sequence opt5 from anti-HIV_119-045790_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagtacctccccggcacggcccctaaactgcttttctatgaggacaatagacggcccagcgggacccctgatcgcttttccggaagcaagtctggcacatccgcgaccctggctatcagcgggctccagacaggagacgaagccgattactattgtaccatttggggcgtgagaaaaggcgtcggggccgtgttcggaacaggcaccaaggttacggtgctg

SEQ ID NO: 40664 - RNA, 333 nt, synthetic construct
  misc_feature 1..333: note = derived and/or modified sequence opt5 from anti-HIV_119-044670_VR-Chain
  source 1..333: mol_type = other RNA
cagagcgtgctgacccaacccccttccgtctctggcgccccgggggagagagttacaatcagctgcacgggaaacacctccaatattggcacatacgacgtgcagtggtatcagcacctccccgggaccgctcctcggctgcttatctaccataacgtgaatctgccctctggagtccctgatcgcttcagcgcctccaagtctggcacaagcgcgaccctcgctattacagggctgcagaccggagacgaagccgattattactgtacgatctggggcgtgagaaaaggcgttggggccgtgtttggaaccggcacaaaggtcaccgtgctt

SEQ ID NO: 40665 - RNA, 321 nt, synthetic construct
  misc_feature 1..321: note = derived and/or modified sequence opt5 from anti-HIV_119-044140_VR-Chain
  source 1..321: mol_type = other RNA
cagagcgtgctgacccaacccccttccgtctctgccgctccgggccagaaggttacaatcagctgctccgggggaacgtctaacattggcaatcacttcgtgagctggtacagacatctccccgggaccgcccctaaactgcttatctatgagaacaataaccggccctccggcattcctgaccgcttttctggagctaagagcgggacatccgcgaccctggccatcacaggactccagaccggcgatgaaggcgactactattgtgccacatggagcgggtctctgaatattggaaccggcacgaaagtgaccgtcctt

SEQ ID NO: 40666 - RNA, 333 nt, synthetic construct
  misc_feature 1..333: note = derived and/or modified sequence opt5 from anti-HIV_119-042776_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcacctccccggcacggcccctaaactgcttatctacgagagcgcgagacggccctccgggacccctgaccgcttcagcggatctaagtccggcacaagcgctaccctggccattacagggctccagaccggagatgaagccgactattactgtacactgtggggcgtgagaaaaggcgtcggggctgtgtttggaaccggcacgcgggttaccgtgctt

SEQ ID NO: 40667 - RNA, 333 nt, synthetic construct
  misc_feature 1..333: note = derived and/or modified sequence opt5 from anti-HIV_119-042581_VR-Chain
  source 1..333: mol_type = other RNA
cagagcgtgctgacccaacccccttccgtctctgccgctccgggccagaaggttacaatcagctgctccgggtctagctccaacattggaaataacttcgtgtcttggtaccagcagctccccggcacggcccctaaactgcttatctttgagacccacagacggcccagcgggattcctgaccgcttctccggaagcaagtctggcacatccgcgaccctggctatcacagggctccaaagcggagatgaagccgactattactgtgccgtgtggggcgtcagacagggcgctggggccgtgtttggaaccggcacaaaagttaccgtgctg

SEQ ID NO: 40668 - RNA, 333 nt, synthetic construct
  misc_feature 1..333: note = derived and/or modified sequence opt5 from anti-HIV_119-040905_VR-Chain
  source 1..333: mol_type = other RNA
cagagcgtgctgacccaacccccttccgtctctgccgctccgggccagaaggttacaatcagctgctccgggaactctagcaatattggagacaacttcgtgtcctggtaccagcagctccccggcatcgcccctaaactgcttgtgtatgagacgaataagagaccctctgggattcctgatcggtttgcgggaagcaaatccggcaccagcgctacactggtcatcaccgggctccaaacaggagacgaagccgatttctactgtggcacctgggacggctctctgcgcacagggggagtgattggcaccgggacgagagttaccgtgctt

SEQ ID NO: 40669 - RNA, 321 nt, synthetic construct
  misc_feature 1..321: note = derived and/or modified sequence opt5 from anti-HIV_119-040322_VR-Chain
  source 1..321: mol_type = other RNA
cagagcgtgctgacccaacccccttccgtctctgccgctccgggccagaaggttgtgatcagctgctccgggtctagctccattatcgagaaaaactctattagctggtaccagcagggacccggcgccgcgcctaagctcctgatctatgaaaatgacaaaagaccctccgggattcctgatcggttcagcggatctaagtccggcacaacggggacccttgctatcacaggactgcaaaccggcgacgaggccgattacttttgtgccacatggagcggccgcctcaacatcgggaccggaacaaaagtgaccgtcctg

SEQ ID NO: 40670 - RNA, 324 nt, synthetic construct
  misc_feature 1..324: note = derived and/or modified sequence opt5 from anti-HIV_119-039892_VR-Chain
  source 1..324: mol_type = other RNA
cagagcgtgctgacccaacccccttccgtctctgccgctccgggccagaaggttacaatcagctgctccgggtctaacgccaatattggaaacaaagacgtgagctggtaccagcagctccccgcgacggctcctaagctgcttatctatgagtccaataaaagaccctctggcattcctgatcggttcagcgggtccaagagcggaacctctgccacactggccatcaccggcctccaaacaggggacgaagctgattactattgtgccacctgggacggacgcgtgtccggcattggcacagggaccaaagtcacggtgctg

SEQ ID NO: 40671 - RNA, 324 nt, synthetic construct
  misc_feature 1..324: note = derived and/or modified sequence opt5 from anti-HIV_119-039764_VR-Chain
  source 1..324: mol_type = other RNA
cagagcgtgctgacccaacccccttccgtctctgccgctccgggccagaaggttacaatcagctgctccgggtctgccagcaacattggcaaaaatttcgtgtcctggtaccaacaggtgcccggaacggcgcctaagctcctgatctatgagaacaatagacggccctctgggacccctgaccgctttagcggatccaaaagcggcacatctgggacccttgctatttccggactgcagacaggcgatgaagccgactactattgtgagacctgggatggcagcgggggagtcttcggcacagggaccaaggtgacggttctc

SEQ ID NO: 40672 - RNA, 333 nt, synthetic construct
  misc_feature 1..333: note = derived and/or modified sequence opt5 from anti-HIV_119-039188_VR-Chain
  source 1..333: mol_type = other RNA
cagagcgtgctgacccaacccccttccctctctggcgccccggggcagacagtcacgatcagctgctccggatctagctccaacattggcaataactacgtttcttggtatcagcagctgcccgggaccgctcctaaacttctgatctacgacagcaatagacggccctccgggattcctgatcgcttcagcggctctaagtccgggacaagcgccaccctcgcgatctctggactgcaaacaggcgacgaggctgattattgttgcgccgtgtggggcgtgagacggggagccggagctgtctttggcgccgggaccaaggtgacagttctt

SEQ ID NO: 40673 - RNA, 321 nt, synthetic construct
  misc_feature 1..321: note = derived and/or modified sequence opt5 from anti-HIV_119-039058_VR-Chain
  source 1..321: mol_type = other RNA
cagagcgtgctgacccaacccccttccgtctctggcgccccggggcagagagttacaatcagctgcacgggatcctctagcaacattggcaataactacgtgtcctggtatcggcgcctccccgggaccgctcctaagctgcttatctacgagaataacaaaagaccctctggcattcctgaccggttcagcggagccaagtccgggacaagcgcgaccctggctatcacaggactccagaccggcgatgaagccgactatttttgttctacatggtccggcagcctgaatttcgggaccggaacgcgcgtgaccgtcctt

SEQ ID NO: 40674 - RNA, 321 nt, synthetic construct
  misc_feature 1..321: note = derived and/or modified sequence opt5 from anti-HIV_119-038837_VR-Chain
  source 1..321: mol_type = other RNA
cagagcgtgctgacccaacccccttccgtctctgccgctccgggccagaaggttacaatcagctgctccgggggaacgtctaacattggcaataacttcgtgagctggtaccagcacctccccgggaccgcccctaaactgcttatctttgagaataacaagagaccctccggagtgcctgaccggttctctggcgcgaaaagcgggacatccgctaccctggccattacaggactccagaccggcgatgaaggcgactattactgtgccacatggagcgggtctctgaatatcggaaccggcacgaaggtcaccgtgctt

SEQ ID NO: 40675 - RNA, 321 nt, synthetic construct
  misc_feature 1..321: note = derived and/or modified sequence opt5 from anti-HIV_119-038396_VR-Chain
  source 1..321: mol_type = other RNA
cagagcgtgctgacccagcccccttccgtctctgccacaccgggccagaaggttacgatcagctgctccgggtctaacagcaatattggaaacaaatacgtgtcctggtatcaactcttccccggcaccgctcctaagctgcttatctctgagaataacagacggcccagcgggacacctgaccgcttttccggaagcaaatctggcacctccgccacactggcgattaccgggctccagacaggagatgaagctgactactattgtgccacctggagcggctctctgaatatcggcacggggaccaaggtgacagtcctt

SEQ ID NO: 40676 - RNA, 321 nt, synthetic construct
  misc_feature 1..321: note = derived and/or modified sequence opt5 from anti-HIV_119-036918_VR-Chain
  source 1..321: mol_type = other RNA
cagagcgtgctgacccaacccccttccgtctctgccgctccgggccagaaggttacaatcagctgctccggggccacgtctaacatttgggaccactacgtgagctggtatctccaggtgcccggaaccgcgcctagactgcttatctacgataatgacaaacggccctccggcattcctgatcgcttctctgggagcaagtccggaacaagcgctaccctggccatcacaggcctccagaccggggacgagggagattattactgtgccacatggtctggctccctgaacattggcaccgggacgaaagtcaccgtgctt

SEQ ID NO: 40677 - RNA, 324 nt, synthetic construct
  misc_feature 1..324: note = derived and/or modified sequence opt5 from anti-HIV_119-036592_VR-Chain
  source 1..324: mol_type = other RNA
cagagcgtgctgacccaacccccttccgtctctgccgctccgggccagaaggttacaatcagctgctccgggtctaacagcaatacgggaaacaaagacgtgtcctggtaccaacaggtgcccgccaccgcgcctaagctcctgatttatgagtctaataaaagacccagcggcatccctgatcggttctccgggagcaagtctggaacatccgctacccttgccattacaggcctgcagaccggggacgaagccgattactattgtgctatctgggacggacgcgtcagcgtgattggcacaggcaccaaagttacggtgctc

SEQ ID NO: 40678 - RNA, 324 nt, synthetic construct
  misc_feature 1..324: note = derived and/or modified sequence opt5 from anti-HIV_119-036310_VR-Chain
  source 1..324: mol_type = other RNA
cagagcgtgctgacccaacccccttccgtctctgccgctccgggccagaaggttacaatcagctgctccgggtctacgagcaacattggacagaattacgtgtcctggtatcagcaactccccggcaccgcccctaaactgcttatctacgagaacaatagacggccctctgggagccctgaccgcttctccggaagcaagtctggcacatccgcgaccctggctattacagggctccagaccggagatgaagccgactattactgtgagacatgggatggcagcggcggggtgtttggaaccggcacgaaagtcaccgtgctg

SEQ ID NO: 40679 - RNA, 333 nt, synthetic construct
  misc_feature 1..333: note = derived and/or modified sequence opt5 from anti-HIV_119-035618_VR-Chain
  source 1..333: mol_type = other RNA
cagagcgtgctgacccaacccccttccgtctctgccgctccgggccagaaggttacaatcagctgctccgggtctagcttcacgattggaaacaatcacgtgtcctggtaccagcagctccccggcaccgcccctaaactgcttatctttgagtctcataagagacccagcggggtgcctgaccggttctccggaagcaaatctggcacatccgcgaccctggctattacagggctccaaaccggagatgaagccgactattactgtacagtctggggcgtgcgcaagggcgttggggccgtgtttggaaccggcacgaaagtcaccgtgctg

SEQ ID NO: 40680 - RNA, 321 nt, synthetic construct
  misc_feature 1..321: note = derived and/or modified sequence opt5 from anti-HIV_119-035569_VR-Chain
  source 1..321: mol_type = other RNA
cagagcgtgctgacccaacccccttccgtctctggcgccccggggcagacagttacgatcagctgcaccggatcctctagcaacattggcgggtacgacgtgcactggtatcagcagctccccggaacagctcctaagctgcttatctacgagaataacagacggccctccggcacccctgatcgcttctctggggccaaaagcggaacatccgcgaccctggctattacaggcctccaaaccggcgacgaaggggattattactgtgccacgtggagcggatctctgaatatcggcaccgggacaaaggtgaccgtcctt

SEQ ID NO: 40681 - RNA, 324 nt, synthetic construct
  misc_feature 1..324: note = derived and/or modified sequence opt5 from anti-HIV_119-035466_VR-Chain
  source 1..324: mol_type = other RNA
cagagcgtgctgacccaacccccttccgtctctgccgctgccggccagaacgttaatatcagctgctccgggaagaaatctaacattggaaataactacgtgagctggtatcagcagttcccgggcacagcgcccaagctcctgatctacgggaatacgaacagaccttccggcattcccgaccggttttctggaagcaaatccgggaccagcgctacacttgccatcaccggactgcaaacaggcgatgacgccgattattactgtgagacctgggacggctctgggggagtgttcggcacagggaccaaggtcacggtgctc

SEQ ID NO: 40682 - RNA, 333 nt, synthetic construct
  misc_feature 1..333: note = derived and/or modified sequence opt5 from anti-HIV_119-035157_VR-Chain
  source 1..333: mol_type = other RNA
cagagcgtgctgacccaacccccttccgtctctgccgctccgggccagaaggttacaatcagctgctccgggtctagctccaacattggaaataacttcgtgtcttggtaccagcagagacccggcacggcccctaaactcctgatctatgagaccaataagcggcccagcgggattcctgaccgcttttccggaagcaaatctggcacatccgcgacccttgctatcacagggctgcaaaccggagatgaagccgactactattgtgccacatgggctcccagactcaacagcgcccgggtgttcggcaatggcaccatggtcacggtgctg

SEQ ID NO: 40683 - RNA, 333 nt, synthetic construct
  misc_feature 1..333: note = derived and/or modified sequence opt5 from anti-HIV_119-035121_VR-Chain
  source 1..333: mol_type = other RNA
cagagcgtgctgacccaacccccttccgtctctgccgctccgggccagaaggttacaatcagctgctccgggtctacgagctacattggaaacaaatatgtgtcctggtaccagcagttccccggcgccgcgcctaagctcctgatctatgagaataacaaaagaccctctgggattcctgaccggtttagcgcttccaagagcgccacctctgccacacttgctatcaccggactgcaaacaggcgatgaagccgactactgttgcgctgtgtggggagtccgcagaggggccggcgcggtgttcggcgccgggaccaaagttacagtgctc

SEQ ID NO: 40684 - RNA, 324 nt, synthetic construct
  misc_feature 1..324: note = derived and/or modified sequence opt5 from anti-HIV_119-035046_VR-Chain
  source 1..324: mol_type = other RNA
cagagcgccctgacccaacccgcttccgtgtctggcagccctgggcagtccatcacaatttcttgcacgggaaccagctccgacgtcggctacgattatgtttcttggtacagacaggtgccggccacaacccccaagctcctgatctatgagaacaataaacggcctagcgggattcccgaccgcttctccggaagcaagtctggcacatccgcgacccttgctatcacagggctgcagaccggagatgaagccgactactattgtgccacgtgggatggcagagtgagcgtcattggcaccgggacaaaagtgaccgttgtg

SEQ ID NO: 40685 - RNA, 324 nt, synthetic construct
  misc_feature 1..324: note = derived and/or modified sequence opt5 from anti-HIV_119-034754_VR-Chain
  source 1..324: mol_type = other RNA
cagagcgtgctgacccaacccccttccgtctctgccgctccgggcgagaaggttacaatcagctgctccgggtctagctccaacattggaaataactacgtgtcttggtatcagcagctccccggcacggtgcctaaactgcttatctacgacaataacaagagacccagcgggacccctgatcggttctccggaagcaaatctggcacatccgccaccctggcgattacagggctccagaccggagacgaagctgattattactgtgagacatgggacggcagcggcggggtctttggaaccggcacgaaggtgaccgttctg

SEQ ID NO: 40686 - RNA, 324 nt, synthetic construct
  misc_feature 1..324: note = derived and/or modified sequence opt5 from anti-HIV_119-034318_VR-Chain
  source 1..324: mol_type = other RNA
cagagcgtgctgacccaacccccttccgtctctgccgctccgggccagaagatcacaattagctgctccgggtctagctccaacatcggaaataacgacgtttcttggtaccagcagctccccggcacggcccctaaactgcttatttatgagaatgatagacggcccagcgggacccctgaccgcttctccggaagcaagtctggcacatccgcgaccctggctatcacagggctccaaaccggagatgaagccgactactattgtgagacatgggatggcagcggcggggtgtttggaaccggcacgaaagtgaccgtcctg

SEQ ID NO: 40687 - RNA, 333 nt, synthetic construct
  misc_feature 1..333: note = derived and/or modified sequence opt5 from anti-HIV_119-033780_VR-Chain
  source 1..333: mol_type = other RNA
cagagcgtgctgacccaacccccttccgtctctgccgctccgggccagagagttacaatcagctgctccgggacgtctagcaacattggagagaattacgtgtcctggtatcagcagatccccggcaccgcccctaagctcctgatttacgaaaacaataaacggccctctgggatccctgaccgcttcagcggatccaagagcggcacatctgcgacccttgtgattacagggctgcaaaccggagatgaggctgacttttattgtggcacatggggcgggtccctcagaaccggaggcgtcctggggacgggaacccgggtgacagttctt

SEQ ID NO: 40688 - RNA, 333 nt, synthetic construct
  misc_feature 1..333: note = derived and/or modified sequence opt5 from anti-HIV_119-033632_VR-Chain
  source 1..333: mol_type = other RNA
cagagcgtgctgacccaacccccttccgtctctgccgctccgggccagagagttacaatcagctgctccgggggatctagcaacattggctccaattacgtgtcttggtatcagcagctccccgggacggcccctaagctgcttatctaccaaaacaataaacggcccagcgggattcctgaccgcttctccggcagcaagtctgggacctccgcgacactgggaatcaccggcctccagacaggcgatgaggctgactattactgtaccgtgtggggagtcagaaaaggagtgggcgccgtttttgggacaggaaccaaggtgacggtcctg

SEQ ID NO: 40689 - RNA, 333 nt, synthetic construct
  misc_feature 1..333: note = derived and/or modified sequence opt5 from anti-HIV_119-033183_VR-Chain
  source 1..333: mol_type = other RNA
cagagcgtgctgacccaacccccttccgtctctgccgctccgggccagatggttacaatcagctgctccgggggagcctctaacctcggcaagaatagcgtgtcctggtaccagcagctgcccgggacggcgcctaaacttctgatttatgaggacaacagacggccctctggaacccctgatcgcttcagcggctccagaagcgggacatctgctaccctcgccatcacaggactgcaaaccggcgacgaagccgattactattgtacaatttggggcgtgcggaagggggtcggagctgtgtttggcaccgggacgaaagttaccgtgctt

SEQ ID NO: 40690 - RNA, 333 nt, synthetic construct
  misc_feature 1..333: note = derived and/or modified sequence opt5 from anti-HIV_119-030696_VR-Chain
  source 1..333: mol_type = other RNA
cagagcgtgctgacccaacccccttccgtctctggcgccccggggcagatcgttacactcagctgcacgggagctatgaccaacattggcaataacgacgtgcactggtaccagcatctgcccgggacaggacctaaacttctgatctatgagaataacaagagaccctccggcattcctgatcggttctctgggagcaagtccggaacctctgccacactcgtgatcaccggcctgcagacaggcgacgaagcggatttttactgtgggacctgggacggaagccttcgcacgggcggggtcattggaaccggcacaagagtgaccgttctg

SEQ ID NO: 40691 - RNA, 324 nt, synthetic construct
  misc_feature 1..324: note = derived and/or modified sequence opt5 from anti-HIV_119-030059_VR-Chain
  source 1..324: mol_type = other RNA
cagagcgtgctgacccaacccccttccgtctctgccgctccgggccagaaggttgtgatcagctgctccgggtctagctccattatcgagaaaaactctattagctggtaccagcagggacccggcgccgcgcctaagctcctgatctatgaaaatgacaaaagaccctccgggattagcgatcggttctctggatccaagagcgctacatctgccacgcttgccatcaccggcctgcacacaggggacgaggctgattactattgtgaaacctgggacggatccggcggcgtgtttgggacaggaaccaaagtcacagtgctc

SEQ ID NO: 40692 - RNA, 333 nt, synthetic construct
  misc_feature 1..333: note = derived and/or modified sequence opt5 from anti-HIV_119-029589_VR-Chain
  source 1..333: mol_type = other RNA
cagagcgtgctgacccaacccccttccgtctctgccgctccgggccagaaggttacaatcagctgctccgggacgtctagcaacattggaaataacttcgtgtcctggtaccagctcctgcccggcaccgcccctagacttctgatctatgacaataacaaacggccctctgggacacctgatcgctttagcggatccaagagcggcacctctgcgacactcgggattaccggactgcagacaggcgacgaggctgatttctactgtggcacctgggacgggtcccttagaacgggaggcgtgatcgggaccggaacacgggtcaccgtgctg

SEQ ID NO: 40693 - RNA, 324 nt, synthetic construct
  misc_feature 1..324: note = derived and/or modified sequence opt5 from anti-HIV_119-029448_VR-Chain
  source 1..324: mol_type = other RNA
cagagcgtgctgacccaacccccttccgtctctgccgctccgggccagaaggttacaatcagctgctccgggaactctagcaatattggcaaaaactccgtgtcttggtaccaccagctccccggaacggcccctaagctgcttatctatgagaatgacagacggcccagcgggacccctgatcgcttctccggaagcaaatctggcacatccgcgaccctggctattacagggctccagaccggagacgaagccgattactattgtgagacatgggacggcagcggcggggtgtttggaaccggcacgaaggtcaccgtgctg

SEQ ID NO: 40694 - RNA, 333 nt, synthetic construct
  misc_feature 1..333: note = derived and/or modified sequence opt5 from anti-HIV_119-029220_VR-Chain
  source 1..333: mol_type = other RNA
cagagcgtgctgacccaacccccttccgtctctgccgctccgggccagaaggttacaatcagctgctccgggtctacgagcaacattggacagaattacgtgtcctggtatcagcaactccccggcaccgcccctaaactgcttatctacgagaacgacagacggccctctgggattcctgatcgcttcagcggatccaagagcggcacatctgcgaccctggctatctccgggctccagacaggagacgaagccgattattgttgcgccgtgtggggcgtcagacggggcgctggggccgtgtttggacccggcaccaaagttacagtgctg

SEQ ID NO: 40695 - RNA, 333 nt, synthetic construct
  misc_feature 1..333: note = derived and/or modified sequence opt5 from anti-HIV_119-028317_VR-Chain
  source 1..333: mol_type = other RNA
cagagcgtgctgacccaacccccttccgtctctgccgctccgggccagaaggttacaatcagctgctccgggtctagctccaacattggaaatgactacgtgtcttggtatcagcagctccccggcacggcccctaaactgcttatctacgagaacaataagagacccagcgggattcctgatcggttctccggaagcaaatctggcacctccgcgacactggctatcaccgggctccaaacaggagacgaagccgattattactgtaccatttggggcgtgcgcaagggcgtcggggccgtgtttggaacaggcaccaaagttacggtgctg

SEQ ID NO: 40696 - RNA, 324 nt, synthetic construct
  misc_feature 1..324: note = derived and/or modified sequence opt5 from anti-HIV_119-028165_VR-Chain
  source 1..324: mol_type = other RNA
cagagcgtgctgacccaacccccttccgtctctgccgctccgggccagacagttacgatcagctgctccgggattacctctaacatcggaaagaatgacgtgagctggtaccagcagctccccggcacagcccctaaactgcttatttccgagaacaatagacggccctctgggatccctgatcgcttcagcggatccaagagcggcacctctgcgacactggctattaccgggctccaaacaggagacgaagccgattattactgtgccatctgggacggcagagtgtccgtcatcggcaccgggacgaaagtgaccgttctg

SEQ ID NO: 40697 - RNA, 324 nt, synthetic construct
  misc_feature 1..324: note = derived and/or modified sequence opt5 from anti-HIV_119-027147_VR-Chain
  source 1..324: mol_type = other RNA
cagagcgtgctgacccaacccccttccgtctctgccgctccgggccagacagttacgatcagctgctccgggtctaccagcgacattggaaagaacgatgtgtcctggtaccagcagctccccggcatcgcccctaaactgcttatttctgagaataacagacggcccagcgggacacctgaccgcttctccggaagcaagtctggcacctccgcgacactggctatcaccgggctccaaacaggagatgaagccgactattactgtgagacctgggatggcagcggcgccgtgtttgggacgggaaccaaagtcacagtgctg

SEQ ID NO: 40698 - RNA, 333 nt, synthetic construct
  misc_feature 1..333: note = derived and/or modified sequence opt5 from anti-HIV_119-026743_VR-Chain
  source 1..333: mol_type = other RNA
cagagcgtgctgacccaacccccttccgtctctgccgctccgggccagaacgttacaatcagctgctccgggtctagctccaatattggaaacaatttcgtgtcttggtaccagcagagacccggcacggggcctaagctcctgatctatgagaccaaccggcgccccagcggcattcctgacagattttccggaagcaaatctgggacatccgccacccttgcgatcacaggactgcaaaccggcgatgaagctgactactattgtgccacatgggcccccagcctcaattctgctcgggtgttcggcaccgggacgaaggtcaccgtgctg

SEQ ID NO: 40699 - RNA, 333 nt, synthetic construct
  misc_feature 1..333: note = derived and/or modified sequence opt5 from anti-HIV_119-026508_VR-Chain
  source 1..333: mol_type = other RNA
cagagcgtgctgacccaacccccttccgtctctgccgctccgggccagaaggttacaatcagctgctccgggtctagctccacgattggaaacaattacatctcttggtatcaggtgctccccggcaccgcccctaaactggtgattttcaagaacaatgagagacccagccgggtccctgaccgcttttccgggagcaaatctggaacatccgcgacccttggcatcacagggctgcagctcggagatgaaggcgactactattgtggcacctgggagacaagcctgtctgggggaggcgtgttcgggaccggaacgaaggttaccgtgctt

SEQ ID NO: 40700 - RNA, 324 nt, synthetic construct
  misc_feature 1..324: note = derived and/or modified sequence opt5 from anti-HIV_119-025683_VR-Chain
  source 1..324: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagacccagcgggattcctgaccggttctccgatagccaatctggaacctccgcgacactggctatcaccggcctccagacaggggacgaagccgattattactgtgagacctgggacggaagcggcggcgtgtttgggacaggaaccaaagtcacggtgctg

SEQ ID NO: 40701 - RNA, 333 nt, synthetic construct
  misc_feature 1..333: note = derived and/or modified sequence opt5 from anti-HIV_119-025614_VR-Chain
  source 1..333: mol_type = other RNA
cagagcctgctcacccaacccccttccgtgtctgccgctccgggccagaacgtcatcattagctgctccgggtctagctccaatatcggaaagaactacgttgcctggtatcaacaggtgcccggcacagcgcctaaaattgtggtcttcgagacgaccaatagaccctctgggatccctgaccggtttagcggatccaagagcggcacatctgctaccctggccattacagggcttcagaccggagatgaagccgactactattgtacagtgtggggcgttcgcaaaggcgtgggggctgtcttcggaaccggcacgaaggtgaccgttctg

SEQ ID NO: 40702 - RNA, 324 nt, synthetic construct
  misc_feature 1..324: note = derived and/or modified sequence opt5 from anti-HIV_119-025548_VR-Chain
  source 1..324: mol_type = other RNA
cagagcatcctgacccaacccccttccgtgtctgccgctccgggccagaaggtcacaattagctgctccgggtctagctccaacatcggaaataactacgtttcttggtatcagcacgtgcccggcacggcccctaaactcctgatttacgagaataacagacggcccagcgggacccctgaccgcttctccggaagcaagtctggcacatccgcgacccttgctatcacagggctgcagagcggagatgaagccgactattactgtggcacctgggatggctctgggggagtgtttggcacagggaccaaagtcacggtgctc

SEQ ID NO: 40703 - RNA, 333 nt, synthetic construct
  misc_feature 1..333: note = derived and/or modified sequence opt5 from anti-HIV_119-025526_VR-Chain
  source 1..333: mol_type = other RNA
cagagcgtgctgacccaacccccttccgtctctgccgctccgggccagaaggttacaatcagctgctccgggtctgccagcaacattggcaaaaatttcgtgtcctggtaccagcagctccccggaacggcgcctaagctgcttatctatgagaacaatagacggccctctgggacccctgaccgctttagcggatccaaaagcggcacatctgctaccctggccattacagggctccaaaccggagatgaagccgactactattgtacagtgtggggcgtcagaaagggcgtgggggctgttttcggaaccggcacgaaagtgaccgtcctg

SEQ ID NO: 40704 - RNA, 324 nt, synthetic construct
  misc_feature 1..324: note = derived and/or modified sequence opt5 from anti-HIV_119-023552_VR-Chain
  source 1..324: mol_type = other RNA
cagagcgtgctgacccaacccccttccgtctctgccgctccgggccagacagttacgatcagctgctccgggtctaccagcaacattggaaagaatgacgtgtcctggtaccagcagctccccggcacagcccctaaactgcttatctctgagaacaatagacggcccagcgggacccctgatcgcttctccgcgagcaagtctggaacatccgctaccctggccattacaggcctccaaaccggggacgaagccgattattactgtgagacgtggcacggaagcggcggcgtgtttgggaccggaacaaaagtcaccgtgctg

SEQ ID NO: 40705 - RNA, 321 nt, synthetic construct
  misc_feature 1..321: note = derived and/or modified sequence opt5 from anti-HIV_119-023092_VR-Chain
  source 1..321: mol_type = other RNA
cagagcgtgctgacccaacccccttccgtctctgccgctccgggccagaaggttacaatcagctgctccgggtctacgagcgacctcggacagaccagagtgtcctggtaccagcaactgccccggtctgcccctgagcttctgattttcgaaaacaatcgcagacccagcggcatccctgatcggttttccggggcgaaaagcggaacatctgctaccctcgccattacaggcctgcagaccggggacgaggccgattatttctgttccacatggagcggatctcttaactttggcaccggcacgcgcgtgaccgtcctg

SEQ ID NO: 40706 - RNA, 324 nt, synthetic construct
  misc_feature 1..324: note = derived and/or modified sequence opt5 from anti-HIV_119-022793_VR-Chain
  source 1..324: mol_type = other RNA
cagagcgtgctgacccaacccccttccgtctctgccgctccgggccagaaggttacaatcagctgctccgggggaacgtctaacattggcaataactacgtgagctggtatagacggctccccgggaccgcccctaaactgcttatctacgagaataacaagcgcccctccggcattcctgacagattctctggagcgaaaagcgggacatccgctaccctgggaatcacaggcctccagaccggcgatgaagccgactattactgtgagacatgggatgacagcgggggagtgtttggcaccgggacgaaggtcaccgtgctg

SEQ ID NO: 40707 - RNA, 324 nt, synthetic construct
  misc_feature 1..324: note = derived and/or modified sequence opt5 from anti-HIV_119-022395_VR-Chain
  source 1..324: mol_type = other RNA
cagagcgtgctgacccaacccccttccgtctctgccgctccgggccagacagttacgatcagctgctccgggtctaccagcaacattggaaagaatgacgtgtcctggtaccagcagctccccggcacagcccctaaactgcttatctctgataacaatagacggcccagctggacccctgaccgcttctccgggagcaagtctggaacatccgcgaccctggctattacaggcctccaaaccggggatgaggccgactattactgtgaaacgtgggatggaagcggcggcgtgtttgggcccggaaccagagtcacagtgctg

SEQ ID NO: 40708 - RNA, 333 nt, synthetic construct
  misc_feature 1..333: note = derived and/or modified sequence opt5 from anti-HIV_119-022334_VR-Chain
  source 1..333: mol_type = other RNA
cagagcgtgctgacccaacccccttccgtctctgccgctccgggccagaacgttaatatcagctgctccgggggatctagcaacattggctccaattacgtgtcttggtatcagcagttccccgggacagcccctaagcacctcatctacgagaacaataaaagacccagcggcattcctgaccggttttccgatagccaatctggaacgtccgcgaccctggggatcacaggacttcagaccggcgacgaagctgattattactgtggcacatgggacgggagcctgcgcaccggaggcgtgattgggacaggaaccagagtcacggtgctc

SEQ ID NO: 40709 - RNA, 321 nt, synthetic construct
  misc_feature 1..321: note = derived and/or modified sequence opt5 from anti-HIV_119-021866_VR-Chain
  source 1..321: mol_type = other RNA
cagagcgtgctgacccaacccccttccgtctctgccgctccgggccagagagttacaatcagctgctccgggtctgccagcaacattggaaagaatttcgtgtcctggtaccagcagctccccggcaaagcgcctaagctgatcatttatgaggtgacgaaacggccctctggggtccctgctcgctttagcggatccaagagcggcacctctgccacacttgccatcaccgggctgcaaacaggagacgaagctgattacttctgttccacctggagcggctctctcaactttggcacagggaccagagtgacggttctg

SEQ ID NO: 40710 - RNA, 324 nt, synthetic construct
  misc_feature 1..324: note = derived and/or modified sequence opt5 from anti-HIV_119-021278_VR-Chain
  source 1..324: mol_type = other RNA
cagagcgtgctgacccaacccccttccgtctctgccgctccgggccagaaggttacaatcagctgctccgggtctgccagcaacattggcaaaaatttcgtgtcctggtaccagcagctccccggaacggcgcctaagctgcttatctatgagaacaatagacggccctctgggacccctgaccgctttagcggatccagaagcggcacatctgctaccctggggattacaggactccaaaccggcgatgaagcccactactattgtgagacatgggacgattccggcggggtgttcggaaccggcacgaaagtcaccgtgctg

SEQ ID NO: 40711 - RNA, 333 nt, synthetic construct
  misc_feature 1..333: note = derived and/or modified sequence opt5 from anti-HIV_119-021183_VR-Chain
  source 1..333: mol_type = other RNA
cagagcgtgctgacccaacccccttccgtctctgccgctccgggccagaaggttacaatcagctgctccgggaactctagcaatattggaaacaatttcgtgtcctggtaccagcagtttcccggcacggcccctaaactcctggtgttcgagacccacagacggccctctgggatccctgaccgctttagcggatccaagagcggcacatctgcgacccttgctattacagggctgcaaaccggagatgaagccgactattactgtgccgtctggggcgtgagacggggcgttggggctgtgttcggagccggcacaaaagtcaccgtgctc

SEQ ID NO: 40712 - RNA, 333 nt, synthetic construct
  misc_feature 1..333: note = derived and/or modified sequence opt5 from anti-HIV_119-019376_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcaacaggtgcccggcacggcccctaaactcctggtctacgagacctatagacggcccagcgggatccctgaccgcttctccggaagcaagtctggcacatccgcgacccttgctattacagggctgcagaccggagatgaagccgactactattgtacaatctggggcgtgagaaaaggcgttggggccgtgtttggaaccggcacgaaggtcaccgtgctc

SEQ ID NO: 40713 - RNA, 321 nt, synthetic construct
  misc_feature 1..321: note = derived and/or modified sequence opt5 from anti-HIV_119-019238_VR-Chain
  source 1..321: mol_type = other RNA
cagagcgtgctgacccaacccccttccgtctctgccgctccgggccagaaggttacaatcagctgctccgggacgtctagcaacattggaaataaccacgtgtcctggtaccaacaggtgcccggcaccgcccctaaactcctgatctatgagaataacaagagaccctctgggattcctgcgcggttcagcgctgccaaatccggaacaagcgccacccttgctatcacaggcctgcagaccggggacgaagccgattacttttgtgctacatggtctggacgcctcaatattggcaccggcacgaaggtcaccgtgctg

SEQ ID NO: 40714 - RNA, 333 nt, synthetic construct
  misc_feature 1..333: note = derived and/or modified sequence opt5 from anti-HIV_119-018500_VR-Chain
  source 1..333: mol_type = other RNA
cagagcgtgctgacccaacccccttccgtctctgccgctccgggccagaaggttaacatcagctgctccgggtctagctccaatattggaaacaatttcgtgtcttggtaccagcagagacccggcacagcccctaaactcctgatctatgagacgaaccggcgccccagcgggattcctgacagattttccggaagcaagtctggcacctccgcgacacttgctatcaccgggctgcaaacaggagatgaagccgactactattgtgccacctgggctgccagcctcacatctgctcgggtgttcggcattggcaccaaagtcacggtgctg

SEQ ID NO: 40715 - RNA, 324 nt, synthetic construct
  misc_feature 1..324: note = derived and/or modified sequence opt5 from anti-HIV_119-018318_VR-Chain
  source 1..324: mol_type = other RNA
cagagcgtgctgacccaacccccttccgtctctgccgctccgggccagacagttatcattagctgctccgggtctacgagcaacatcggaaagaatgacgtgtcctggtaccagcagctccccggcaccgcccctaaactgcttatttctgagaacaatagacggcccagcgggacacctgatcgcttctccggaagcaagtctggcacctccgcgacactggctatcaccgggctccaaacaggagacgatgccgactattactgtgaaacctgggatggcagcggcggggtgtttggaacgggcaccaaagtcacactggtg

SEQ ID NO: 40716 - RNA, 333 nt, synthetic construct
  misc_feature 1..333: note = derived and/or modified sequence opt5 from anti-HIV_119-018218_VR-Chain
  source 1..333: mol_type = other RNA
cagagcgtgctgacccaacccccttccgtctctgccgctccgggccagaaggttacaatcagctgctccgggaactctagcaatattggaaacaatttcgtgtcctggtaccagcagctccccggcacggcccctaaactgcttatctatgagaacaatagacggccctctgggattcctgaccgctttagcggatccaagagcggcacctctgcgacactggctatctccgggctccaaaccggagatgaagccgactactggtgtgccgtgtggggcgtcagacggggcgctggggccgtgttcggagctggcacaaaagttaccgtgctg

SEQ ID NO: 40717 - RNA, 324 nt, synthetic construct
  misc_feature 1..324: note = derived and/or modified sequence opt5 from anti-HIV_119-017876_VR-Chain
  source 1..324: mol_type = other RNA
cagagcgtgctgacccaacccccttccgtctctgccgctccgggccagaaggttacaatcagctgctccgggtctacgagcaaaattggacagaactccgtgtcttggtaccagcaactccccggcaccgcccctaagctgcttatctatgagaatgacagacggcccagcgggacacctgatcgcttctccgcgagcaaatctggaacctccgctacactggccattaccggcctccagacaggggacgaagccgattactattgtgagacctgggacgatagcggaggcgtgtttggcacggggaccaaggtcacagtgctg

SEQ ID NO: 40718 - RNA, 324 nt, synthetic construct
  misc_feature 1..324: note = derived and/or modified sequence opt5 from anti-HIV_119-017740_VR-Chain
  source 1..324: mol_type = other RNA
cagagcgtgctgacccaacccccttccgtctctgccgctccgggccagaaggttacaatcagctgctccgggtctaacagcaatattggaaacaaagacgtgtcctggtacagacaggtgcccgccacggcgcctaagctccccatctatgagaataaaaacgaaccttctggcgtccccgatcggttcagcgggtccaagagcggaacctctgctacactggccattaccggccttcagacaggggacgaggccgattactattgtgctacctgggacggacgcgtgtccgttatcggcacaggcaccaaagtgacggtcgtg

SEQ ID NO: 40719 - RNA, 321 nt, synthetic construct
  misc_feature 1..321: note = derived and/or modified sequence opt5 from anti-HIV_119-017128_VR-Chain
  source 1..321: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagacccagcgggattcctgaccggttctccggagcgaaaagcggcacctctgctacactggccatcaccgggctccaaacaggagatgaagccgactatttttgttccacctggagcggctctctgaatttcggcacagggacccgcgtgacggtcctt

SEQ ID NO: 40720 - RNA, 324 nt, synthetic construct
  misc_feature 1..324: note = derived and/or modified sequence opt5 from anti-HIV_119-017044_VR-Chain
  source 1..324: mol_type = other RNA
cagagcgtgctgacccaacccccttccgtctctgccgctccgggccagaaggttacaatcagctgctccgggtctaacagcaatattggaaacaattacgtgtcctggtatcaccatctccccggcacggcccctagactgcttatctacgacaacaataaacggccctctgggattcctgatcgcttcagcggatccaagagcggcacctctgcgacactggctatcaccgggctccagacaggagacgaggccgattattactgtgccacctgggacggcagagtgtccgtcattggcacagggacccaggtgacggttctg

SEQ ID NO: 40721 - RNA, 321 nt, synthetic construct
  misc_feature 1..321: note = derived and/or modified sequence opt5 from anti-HIV_119-016644_VR-Chain
  source 1..321: mol_type = other RNA
cagagcgtgctgacccaacccccttccgtctctgccgctccgggccagaaggttacaatcagctgctccgggggaacgtctaacattggcaataactacgtgagctggtatcagcagctccccgggaccgcccctaaactgcttatctacgagaataacaagagaccctccggcattcctgcgcggttctctgctgccaaaagcggaacatccgccaccctggctatcacagggctccaaaccgaagacgaggccgattattactgtgctacatggagcggatctctgaatattggcaccggcacgaaggtgaccgtcctt

SEQ ID NO: 40722 - RNA, 333 nt, synthetic construct
  misc_feature 1..333: note = derived and/or modified sequence opt5 from anti-HIV_119-015878_VR-Chain
  source 1..333: mol_type = other RNA
cagagcgccctgacccaacccccttccgcttctggcagcccggggcagtccgtgacaatctcttgcagcggatcctctagcaacattggcaataacttcgtctcctggtaccagcagagacccgggacggcccctaagctcctgatctatgagaccaataaacggcccagcggcattcctgaccgcttttctggatccaagagcgggacatctgcgacccttgctatcacaggactgcaaaccggcgatgaagccgactactattgtgccacatgggctcccagactcaactccgcccgggttttcggcaatgggaccatggtgacggtgctg

SEQ ID NO: 40723 - RNA, 321 nt, synthetic construct
  misc_feature 1..321: note = derived and/or modified sequence opt5 from anti-HIV_119-015538_VR-Chain
  source 1..321: mol_type = other RNA
cagagcgtgctgacccaacccccttccgtctctgccacaccgggccagaaggttacgatcagctgctccgggtctagctccaacattggaaataactacgtgtcttggtatagacggctccccggcaccgctcctaaacacctgatctacgagacaaataaccgccccagcggggtgcctgccagactttccgcggctaagagcggaacctctgccacactggccattaccggcctccagacagaagacgaggctgattattactgtgccacctggtccgggagcctgaatatcggaacgggcaccaaagtcacagtgctt

SEQ ID NO: 40724 - RNA, 321 nt, synthetic construct
  misc_feature 1..321: note = derived and/or modified sequence opt5 from anti-HIV_119-015455_VR-Chain
  source 1..321: mol_type = other RNA
cagagcgtgctgacccaacccccttccgtctctgccacaccgggccagaaggttacgatcagctgctccgggtctaacagcaatattggaaacaaagacgtgtcctggtaccagcacttccccggcaccgctcctaagctcctgatctatgagaataacaaaagaccctctgggattcctgatcggtttagcggatccaagagcgccacatctgcgacccttacaatcaccggcctgcagacagaagacgaggctgattactattgtgccacctggtccgggagcctcaatattggaacgggcaccaaagtgacagtcctg

SEQ ID NO: 40725 - RNA, 321 nt, synthetic construct
  misc_feature 1..321: note = derived and/or modified sequence opt5 from anti-HIV_119-014425_VR-Chain
  source 1..321: mol_type = other RNA
cagagcgtgctgacccaacccccttccgtctctgccgctccgggccagaaggttacaatcagctgctccgggggaacgtctaacattggcaataactacgtgagctggtatcagcacctccccgggaccgcccctaaactgcttatctacgagaataacaagagaccctccggcattcctgaccggttctctggagcgaaaagcgggacatccgctaccctggccatcacaggactccagaccggcgatgaaggcgactattactgtgccacatggagcgggtctctgaatattggaaccggcacgaaggtgaccgtcctt

SEQ ID NO: 40726 - RNA, 324 nt, synthetic construct
  misc_feature 1..324: note = derived and/or modified sequence opt5 from anti-HIV_119-013582_VR-Chain
  source 1..324: mol_type = other RNA
cagagcatggtgacccaatccccctctgtcagcgccgctcctggccagaaggttacaatctcctgctctgggacgagctccaacattggacagaattacgtgtcttggtatcagcaactgccgggcaccgcccccaaactcctgatcagcgagaacaatagacggccttccgggacacccgaccgcttcagcggatctaagtccggcaccagcgcgacacttgctattaccgggctgcagacaggagatgaagccgactactattgtgagacctgggatggctctggcggggtgtttggaacgggcaccaaagtcacagtgctc

SEQ ID NO: 40727 - RNA, 333 nt, synthetic construct
  misc_feature 1..333: note = derived and/or modified sequence opt5 from anti-HIV_119-013364_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgacaataacaagagacccagcgggattcctgatcggttctccggaagcaaatctggcacctccgcgacactggctatcaccgggctccacacaggagacgaggccgattattactgtaccgtgtggggcgtccgcaagggcgtgggggccgtttttggaacaggcaccaaagtgacggtcctg

SEQ ID NO: 40728 - RNA, 333 nt, synthetic construct
  misc_feature 1..333: note = derived and/or modified sequence opt5 from anti-HIV_119-012886_VR-Chain
  source 1..333: mol_type = other RNA
cagagcatcctgacccaacccccttccgtgtctgccgctccgggccagaaggtcacaattagctgctccgggtctagctccacgatcggaaccaactacgtttcttggtatcagcagttccccggcacagcccctaaactcctggtgtttgagacccacagacggcccagcgggattcctgaccgcttctccggaagcaagtctggcacatccgcgacccttgctatcacagggctgcaaaccggagatgaagccgactactattgtgccgtgtggggcgtcagacggggcgtgggggctgtttttggagccggcacgaaagtgaccgtcctc

SEQ ID NO: 40729 - RNA, 333 nt, synthetic construct
  misc_feature 1..333: note = derived and/or modified sequence opt5 from anti-HIV_119-012249_VR-Chain
  source 1..333: mol_type = other RNA
cagagcgtgctgacccaacccccttccgtctctggcgccccggggcagaaggttacaatcagctgctccggatctagctccaacattggcagaaattacgtgtcttggtatcagcagctccccgggacggctcctaaactgcttatctacgagaacaataagcggcccagcggcattcctgaccgcttctccggaagcaaatctgggacctccgccacactggtgatcaccggactccaaacaggcgatgaagcggacttttattgtggcacctgggatgggagcctgtctggaggcggggtcattggaacaggcaccagagtgacggttctt

SEQ ID NO: 40730 - RNA, 324 nt, synthetic construct
  misc_feature 1..324: note = derived and/or modified sequence opt5 from anti-HIV_119-012161_VR-Chain
  source 1..324: mol_type = other RNA
cagagcttcctgacccaacccccttccgtgtctgccgctccgggccagaaggtcacaatcagctgctccgggtctaacagcaatattggcaaaaactacgtttcctggtatcagtacctccccggaacggtgcctaagctgcttatctatgagaatgacaaaagaccctctgggattcctggacggtttagcgcctccaagagcggcacctctgcgacactggctatcaccgggctccagacaggagatgaagccgactactattgtggcacctgggatggctccgggggagtgttcggcacagggaccaaagtcacggtgctg

SEQ ID NO: 40731 - RNA, 324 nt, synthetic construct
  misc_feature 1..324: note = derived and/or modified sequence opt5 from anti-HIV_119-012110_VR-Chain
  source 1..324: mol_type = other RNA
cagagcgtgctgacccaacccccttccgtctctgccgctccgggccagacagttacgatcagctgctccgggtctaccagcaacattggaaagaatgacgtgtcctggtaccagcagctccccggcacagcccctaaactgcttatctctgagaacaatagacggcccagcgggacccctgatcgcttctccggaagcaagtctggcacatccgcgaccctggctattagcgggctccaaacaggagacgaagccgattattactgtggcacctgggacggctctgggggagtgtttggcacggggaccaaagtcacagtgctg

SEQ ID NO: 40732 - RNA, 333 nt, synthetic construct
  misc_feature 1..333: note = derived and/or modified sequence opt5 from anti-HIV_119-012100_VR-Chain
  source 1..333: mol_type = other RNA
caggccgtgctgacccaaccccctagcgtctccgctgccccgggccagaaggttgcgatctcttgcagcgggtcctctagcaacattggaaataactacgtgtcctggtatcagcagctccccggcacagtgcctaaactgcttatctacgacacggataagagaccctctgggattcctgaccggttcagcggatccaaaagcggcacctctgctacactggggatcacccgcctccaaacaggagatgaggccgactattactgtgccacctgggctcccagacttaattccgcccgggtctttggcaacggcacaatggtgaccgttctg

SEQ ID NO: 40733 - RNA, 324 nt, synthetic construct
  misc_feature 1..324: note = derived and/or modified sequence opt5 from anti-HIV_119-011651_VR-Chain
  source 1..324: mol_type = other RNA
cagagcgtgctgacccaacccccttccgtctctgccgctccgggccagaaggttacaatcagctgctccgggaactctagcaatattggaaacaattacgtgtcctggtatcagcagctccccggcacggcccctaaactgcttatctacgagaacaataagagaccctctgggattcctgaccggttcagcggatccaaaagcggcacctctgcgacactggctatcaccgggctccaaacaggagatgaagccgactattactgtgccacctgggatggccgcgtgtccgtctttggcacagggaccaaggtggctgttctg

SEQ ID NO: 40734 - RNA, 333 nt, synthetic construct
  misc_feature 1..333: note = derived and/or modified sequence opt5 from anti-HIV_119-011479_VR-Chain
  source 1..333: mol_type = other RNA
cagagcgtgctgacccaacccccttccgtctctgccacaccgggccagaaggttacgatcagctgctccgggtctaacagcaatattggaaacaaatacgtgtcctggtatcagcacttccccggcaccgctcctaagctcctgatctacgagaataacagacggccctctgggattcctgaccgctttagcggatccaaaagcggcacatctgccacccttgcgatcacagggctgcagaccggagatgaagctgactattactgtacaatttggggcgtgagaaagggcgtcggggccgtgttcggaaccggcacgaaagttaccgtgctc

SEQ ID NO: 40735 - RNA, 333 nt, synthetic construct
  misc_feature 1..333: note = derived and/or modified sequence opt5 from anti-HIV_119-011232_VR-Chain
  source 1..333: mol_type = other RNA
cagagcgtgctgacccaacccccttccgtctctgccgctccgggccagaacgttaatatcagctgctccgggggatctagcaacattggctccaattacgtgtcttggtatcagcagttccccgggacagcccctaagctcctgatctacgacgatgacaaaagacccagcggcattcctcaccggttttccgcgagcaagtctggaacgtccgctacccttgccatcagcgggctgcaaacaggagatgaggccgactattgttgcgctgtgtggggcgtccgcagaggcgccggggctgtgttcggagccggcaccaaagttacagtgctc

SEQ ID NO: 40736 - RNA, 333 nt, synthetic construct
  misc_feature 1..333: note = derived and/or modified sequence opt5 from anti-HIV_119-011175_VR-Chain
  source 1..333: mol_type = other RNA
cagagcgtgctgacccaacccccttccgtctctgccgctccgggccagaaggttacaatcagctgctccgggtctaacagctacattggaaataaatatgtgtcctggtaccagcagttccccggcacggcccctaagctcctgatctatgagaacaatagacggccctctgggattcctgaccgctttagcggatccaaaagcggcacctctgcgacacttgctatctccgggctgcaaaccggagatgaagccgactactgttgcgccgtgtggggcgtcagacggggcgctggggccgtgttcggacccggcacaaaggttaccgtgctc

SEQ ID NO: 40737 - RNA, 321 nt, synthetic construct
  misc_feature 1..321: note = derived and/or modified sequence opt5 from anti-HIV_119-008396_VR-Chain
  source 1..321: mol_type = other RNA
cagagcgtgctgacccaacccccttccgtctctgccgctccgggccagaaggttacaatcagctgctccgggtctagctccaacattggaaataactacgtgtcttggtatcaacaggtgcccggcacggcccctaaactcctggtctacgagaataccagacggcccagcggggtgcctgaccgcttctccggagctaagagcggcacatctgcgacccttgccatcacagggctgcagaccggagatgaaggcgactattactgtgccacatggtccggcagcctcaacattgggaccggaacgaaagttaccgtgctg

SEQ ID NO: 40738 - RNA, 324 nt, synthetic construct
  misc_feature 1..324: note = derived and/or modified sequence opt5 from anti-HIV_119-007148_VR-Chain
  source 1..324: mol_type = other RNA
cagagcgtgctgacccaacccccttccgtctctgccgctccgggccagaaggttacaatcagctgctccgggtctacgagcaacattggcaaaaattacgtgtcctggtatcagcacctccccggaaccgcccctaagctgcttctgtacgagaacgacagacggccctctgggacacctgatcgcttcagcggatccaaaagcggcacctctgcgacactcgctatcaccgggctgcatacaggagacgaagccgattattactgtgagacctgggacggctccggcggggtgtttggaacgggcaccaaggtcacagtgctt

SEQ ID NO: 40739 - RNA, 333 nt, synthetic construct
  misc_feature 1..333: note = derived and/or modified sequence opt5 from anti-HIV_119-007029_VR-Chain
  source 1..333: mol_type = other RNA
cagagcgtgctgacccaacccccttccgtctctgccgctccgggccagaaggttacaatcagctgctccgggaactctagcaatattggaaacaatttcgtgtcctggtaccaacaggtgcccggcacggcccctaaactcctgctttatgagacctacagacggccctctgggatcagcgaccgcttttccggaagcaagtctggcacatccgcgaccctggctattacagggctccagaccggagatgaagccgactattactgtacagtctggggcgtgagaaaaggcgttggggccgtgttcggaaccggcacgaaggtcaccgtgctg

SEQ ID NO: 40740 - RNA, 324 nt, synthetic construct
  misc_feature 1..324: note = derived and/or modified sequence opt5 from anti-HIV_119-004707_VR-Chain
  source 1..324: mol_type = other RNA
cagagcgtgctgacccaacccccttccgtctctgccgctccgggccagaaggttacaatcagctgctccgggtctacgagcaacattggcaaaaatgacgtgtcctggtaccagcagctccccggaaccgcccctaagctgcttatctctgagaacaatagacggcccagcgggacacctgatcgcttctccggaagcaaatctggcacctccgcgacactggctattaccgggctccaaacaggagacgaagccgattattactgtgagacctgggacggcagcggcggggtgtttggaacgggcaccaaggtcacagtgctg

SEQ ID NO: 40741 - RNA, 333 nt, synthetic construct
  misc_feature 1..333: note = derived and/or modified sequence opt5 from anti-HIV_119-003910_VR-Chain
  source 1..333: mol_type = other RNA
cagagcgtgctgacccaacccccttccgtctctgccgctccgggccagaaggttgccatcagctgctccgggaacacatctagcattggaaataacttcgtgtcctggtaccaacaggtgcccggcacggcgcctaaactcctggtctatgagacctacagacggccctctgggatccctgaccgctttagcggatccaagagcggcacatctgctacccttgccattacagggctgcagaccggagatgaagccgactattactgtacagtgtggggcgttagaaaaggcgtgggggctgtcttcggaaccggcacgaaggtgaccgttctc

SEQ ID NO: 40742 - RNA, 321 nt, synthetic construct
  misc_feature 1..321: note = derived and/or modified sequence opt5 from anti-HIV_119-002450_VR-Chain
  source 1..321: mol_type = other RNA
cagagcgtgctgacccaacccccttccgtctctggcgccccggggcagagagttacaatcagctgcacgggatcctctagcaacattggcaataactacgtgtcctggtatcaggggctccccggaaccgctcctaagctgcttatctacgagaataacaaacggccctctggcattcctgaccgcttcagcggggccaagtccggaacagcggctaccctggccatcacaggcctccagaccggcgatgaagccgactattactgtgctacatggagcgggtctctgaattttggaaccggcacgaaagtgaccgtcctt

SEQ ID NO: 40743 - RNA, 321 nt, synthetic construct
  misc_feature 1..321: note = derived and/or modified sequence opt5 from anti-HIV_119-001552_VR-Chain
  source 1..321: mol_type = other RNA
cagagcgtgctgacccaacccccttccgtctctgccgctccgggccagaaggttacaatcagctgctccgggtctaacagctacctcggaaataaatatgtgtcctggtaccagcagttccccggcacggcccctaagctgcttatttatgagaacaataaaagaccctctgggatccctgaccggtttagcgcgtccaagagcgctgcctctgccaccctggctattacaggactccaaaccggcgatgaaggggactactattgtgccacatggaccggatccctgaacatcggcacaggcaccaaagtgacggtcctt

SEQ ID NO: 40744 - RNA, 333 nt, synthetic construct
  misc_feature 1..333: note = derived and/or modified sequence opt5 from anti-HIV_059-188169_VR-Chain
  source 1..333: mol_type = other RNA
cagagcgtgctgacccaacccccttccgtctctgccgctccgggccagaaggttacaatcagctgctccgggtctacgagcaacattggagacaattacgtgtcctggtatcaacaggtgcccggcaccgcccctaaactcctgatctacgagaacaatagacggccctctgggacacctgatcgcttcagcggatccaagagcggcacctctgcgacacttgctattaccgggctgcagacaggagacgaagccgattattactgtggcacctgggacacgtccctcagcaccggcggggtctttggaacaggcaccaaagtgacagttctg

SEQ ID NO: 40745 - RNA, 333 nt, synthetic construct
  misc_feature 1..333: note = derived and/or modified sequence opt5 from anti-HIV_059-183739_VR-Chain
  source 1..333: mol_type = other RNA
cagagcgtgctgacccaacccccttccgtctctgccgctccgggccagaaggttacaatcagctgctccgggtctacgagcaacattggcaaaaattacgtgtcctggtatcagcagctccccggaaccgcccctaagctgcttatctacgagaacaatagacggccctctgggacacctgaccgcttcagcggatccaaaagcggcacctctgcgacactggggatttccggactccaaaccggcgatgaagctgactattactgtggcacatgggataccagcctgtctgggggaggcgtgtttgggacgggaaccaaggtcacagtgctt

SEQ ID NO: 40746 - RNA, 333 nt, synthetic construct
  misc_feature 1..333: note = derived and/or modified sequence opt5 from anti-HIV_059-182376_VR-Chain
  source 1..333: mol_type = other RNA
cagagcgtgctgtcccaacccccttctgtcagcgccgctccgggccagaaggttaccatctcctgctctgggagctcctctaacattggaaattactatgtgagctggtaccagcagttccccggcacagcccctaaactcctgatctataagaacgacaatagaccctccgggattcctgatcggtttagcggatctaaatccggcacgagcgcgacccttgggatctctggactgcaaacaggcgacgaggctgattactattgtggcacctgggggacatccctcagcggaggcggggtgttcggaaccggcacaaaggtcaccgtgctg

SEQ ID NO: 40747 - RNA, 333 nt, synthetic construct
  misc_feature 1..333: note = derived and/or modified sequence opt5 from anti-HIV_059-182199_VR-Chain
  source 1..333: mol_type = other RNA
cagagcgtgctgacccaacccccttccgtctctgccgctccgggccagaacatcacaattagctgctccgggtctagctccaatatcggatctcacagcatttcctggtaccagcatctccccggcacggcccctaagatcgttatttatgacaacgataaaagacccctggggatccctgaccggttcagcggatctaagtccggcaccagcgcgacacttgggatcaccggactgcagacaggcgatgaggctgactactattgtggcacctgggatacatctctctccgggggaggcgtgtttgggcccggaaccaaagtgacggtcctg

SEQ ID NO: 40748 - RNA, 324 nt, synthetic construct
  misc_feature 1..324: note = derived and/or modified sequence opt5 from anti-HIV_059-169202_VR-Chain
  source 1..324: mol_type = other RNA
cacagcgtgctgacccagcccccttccgtctctgccgctccgggccaaaaggttacaatcagctgctccgggtctagctccaaaattggaaacaatttcgtgtcttggtaccagcagctccccggcacggcccctaagctgcttatctatgagaacaataaaagacccagcgggattcctgaccggttttccggaagcaagtctggcacctccgcgacactggctatcaccgggctccagacaggagatgaagccgactactattgtggcacctgggatggccgcgtgagcgtcattgggtctggaacaaaactgaccgtgctt

SEQ ID NO: 40749 - RNA, 324 nt, synthetic construct
  misc_feature 1..324: note = derived and/or modified sequence opt5 from anti-HIV_059-155645_VR-Chain
  source 1..324: mol_type = other RNA
cagagcgccctgacccaacccgcttccgtgtctggcagccctgggcagtccatcacaatttcttgcacgggaaccagctccgacgtcggctacaactatgtttcttggtaccagcagctcccggggacagcccccaagctgcttatctatgagaataacaaaagacctagcggcattcccgatcggttctccggaagcaagtctgggacctccgcgacactggctatcaccggactccaaacaggcgacgaagccgattactattgtggcacctgggacgggcgcctgagcgtgattggaacgggcaccaaagtgacagtcctt

SEQ ID NO: 40750 - RNA, 333 nt, synthetic construct
  misc_feature 1..333: note = derived and/or modified sequence opt5 from anti-HIV_059-151619_VR-Chain
  source 1..333: mol_type = other RNA
cagagcgtgctgacccaacccccttccgtctctgccgctccgggccagaaggttacaatcagctgctccgggtctagctccaacattggaaataacttcgtgtcttggtaccagctcctgcccggcacgcctcccaaacttctgatctttaagaataacgagagacctagcgggattcccgaccggttctccggaagcaaatctggcacctccgccacactcgggatcaccggactgcagacaggcgatgaaggcgactattactgtgggacctgggatacaagcctttctggaggcggggtgtttggaaccggcacgcgcgtcaccgtgctg

SEQ ID NO: 40751 - RNA, 333 nt, synthetic construct
  misc_feature 1..333: note = derived and/or modified sequence opt5 from anti-HIV_059-146503_VR-Chain
  source 1..333: mol_type = other RNA
cagagcgtgctgacccaacccccttccgtctctgccacaccgggccagaaggttacgatcagctgctccgggtctgctagcaacattggaaataactacgtgtcctggtatcagcagttccccggcaccgcccctaaactcctgatctacgacacaaataagagaccctctgggattcctgatcggtttagcggatccaaaagcggcacctctgcgatccttgggattacaggactgcaaatcggcgacgaggctgattattactgtggcacctgggacacatccctcagcgggggaggcgtgttcgggaccggaacgaaggtcaccgtgctg

SEQ ID NO: 40752 - RNA, 324 nt, synthetic construct
  misc_feature 1..324: note = derived and/or modified sequence opt5 from anti-HIV_059-136098_VR-Chain
  source 1..324: mol_type = other RNA
cagagcgtgctgacccaacccccttccgtctctgccgctccgggccagagagttacaatcagctgctccgggtctagctccaacattggaaataactacgtgtcttggtatcagcagctccccggcacggcccctaagctgcttatctacgagaataaccggcgccccagcgggattcctgacagattctccggaagcaaatctggcacctccgcgacactggctatcaccgggctccaaacaggagatgaaggcgactattactgtgcccggtgggatggccgcctgagcgtgattgggtctggaaccaaggtcacagtgctt

SEQ ID NO: 40753 - RNA, 333 nt, synthetic construct
  misc_feature 1..333: note = derived and/or modified sequence opt5 from anti-HIV_059-105516_VR-Chain
  source 1..333: mol_type = other RNA
cagagcgccctgacccaacccccttccgtgtctgctgccccgggccagaaggtcacaatcagctgctccgggtctagctccaacattggaaataactacgtttcttggtatcagcagctccccggcacggcgcctaaactgcttatctacgacaataacaagagacccagcgggattcctgatcggttctccggaagcaaatctggcacctccgctacactggccatcgccgggctccaaaccggagacgaggctaattattactgtggcacatgggatggcagcctgcgcaccgggggagtgtttggcacagggaccaaggtgacggtcctt

SEQ ID NO: 40754 - RNA, 333 nt, synthetic construct
  misc_feature 1..333: note = derived and/or modified sequence opt5 from anti-HIV_059-095709_VR-Chain
  source 1..333: mol_type = other RNA
cagagcgtgctgacccaacccccttccgtctctgccgctccgggccagaaggttacaatcagctgctccgggagatctagcaacattggaaataacttcgtgtcctggtaccagctcctgcccggcacggcccctaaacttctgatctataagaataacgagcggccctctgggattcctgaccgctttagcgcgtccaaaagcggaacctctgctacactcggcatcaccgggctgcagacaggagatgaagccgactactattgtggcacctgggatacatcccttagcggcgggggagtgttcggcaccgggacgaaggtcaccgtgctg

SEQ ID NO: 40755 - RNA, 333 nt, synthetic construct
  misc_feature 1..333: note = derived and/or modified sequence opt5 from anti-HIV_059-069468_VR-Chain
  source 1..333: mol_type = other RNA
cagagcgtgctgacccaacccccttccgtctctggcgccccgagacagagcgttatcatttcctgcacagggtctagctccaacatcggaggcttcgacgtgcactggtaccagcagctccccgggacggctcctaagctgcttatttatgagaataaccggcgcccctctggaacccctgatagatttagcggctccaaaagcgggacatctgccaccctggcgatcacaggactccaaaccggcgacgaagctgattactattgtggcacatgggacgggtccctgagcaccggaggcgtgattgggacgggaaccaaggtcacagtgctt

SEQ ID NO: 40756 - RNA, 333 nt, synthetic construct
  misc_feature 1..333: note = derived and/or modified sequence opt5 from anti-HIV_059-060026_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggtgcctaaactgcttatctacaagaatgacaaaagacccagcgggattcctgatcggttctccggaagcaagtctgccacctccgcgacactgggcatcaccgggctccaaacaggagacgaggctgattattactgtggcatttgggacaccagcctgtctgccggcggggtctttggaacaggcacccgcgtgacggttctt

SEQ ID NO: 40757 - RNA, 333 nt, synthetic construct
  misc_feature 1..333: note = derived and/or modified sequence opt5 from anti-HIV_059-053668_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagaagctccgggattcccgaccggttcagcggatctaaatccggcaccagcgcgacactggctatcaccgggctccaaacaggagatgaagccgactattactgtggcacccgcgattcttccctgagcggcgggggagtgattggcacagggaccaaggtcacggtgctt

SEQ ID NO: 40758 - RNA, 333 nt, synthetic construct
  misc_feature 1..333: note = derived and/or modified sequence opt5 from anti-HIV_059-052864_VR-Chain
  source 1..333: mol_type = other RNA
cagagcgtgctgacccaacccccttccctctctgccgctccgggccagagagtcacaatcagctgctccgggtctagctccaacattggaaataactacgtttcttggtatcagcagctgcccggcacggcccctaaacttctgatctacgagagcaataagcggccctccgggacccctgaccgcttcagcggatctaagtccggcacaagcgcgaccctcgctattacagggctgcaaaccggagatgaagccgactattactgtggcacatgggatgcctctctttccagcggcggggtgatgggaaccggcacgaaagtgaccgtcctg

SEQ ID NO: 40759 - RNA, 333 nt, synthetic construct
  misc_feature 1..333: note = derived and/or modified sequence opt5 from anti-HIV_059-050968_VR-Chain
  source 1..333: mol_type = other RNA
cagagcgtgctgacccaagccccctccgtctctgctgcccctggcgagaaggttacaatcagctgctccgggacgtctagcaacattggatactattacgtgtcctggtatcagcagttcccgggcaccgcgcccaaagtggtcatctacgaaaataacagacggccttctgggacacccgaccgctttagcggatccaagagcggcacctctgctacactcgccattaccgggctgcagacaggagatgaggccgactattactgtggcacctggggcgggtcccttagcacgggaggcgtgatcgggaccggaacaaaagttaccgtgctg

SEQ ID NO: 40760 - RNA, 333 nt, synthetic construct
  misc_feature 1..333: note = derived and/or modified sequence opt5 from anti-HIV_059-046422_VR-Chain
  source 1..333: mol_type = other RNA
cagagcgtgctgacccaacccccttccgtctctgccgctccgggccagaaggttacaatcagctgctccgggtctagctccacgattggaaacaattacatctcttggtatcagctcctgcccggcacccctcccaactaccttattttcaaaatcagcgagagaccttccggggtgcccgaccggtttagcggatctaagtccggcacaagcgccaccctgcacattacagggctccagaccggagatgaaggcgactattactgtggcacatgggatacctctctgtccgggggaggcgtgttcgggacgggaaccaaagtcacagtgctt

SEQ ID NO: 40761 - RNA, 333 nt, synthetic construct
  misc_feature 1..333: note = derived and/or modified sequence opt5 from anti-HIV_059-045120_VR-Chain
  source 1..333: mol_type = other RNA
cagagcgtgctgacccaacccccttccgtctctgccgctccgggccagaaggttgccatcagctgctccgggtctagctccacaattggaaacaattacgtgtcttggtatcagctcctgcccggcacgcctcccaaacttctgatcttcaagagccacgagagaccttccgggattcccgaccggtttagcggatctaaatccggcaccagcgcgacactcgggatcaccggactgcagacaggcgatgaaggcgactactattgtgggacctgggattcttcccttagcgtgggaggcgtcttcgggacaggaaccaaggtgacggttctg

SEQ ID NO: 40762 - RNA, 333 nt, synthetic construct
  misc_feature 1..333: note = derived and/or modified sequence opt5 from anti-HIV_059-039932_VR-Chain
  source 1..333: mol_type = other RNA
cagagcgtgctgacccaacccccttccgtctctgccgctccgggccagaaggttacaatcagctgctccgggtctagctccattatcggcaaaaactacgtgtcttggtatcagcacctccccggaacggcccctaagctgcttatttacgagaataacaaaagacccagcgggatccctgaccggttctccggaagcaagtctggcacctccgcgacactggctattgccgggctccagaccggagatgaagccaattattactgtggcacatggggcgggagcctgtctaccggaggcgtgtttgggacaggaaccaaagtcacggtgctt

SEQ ID NO: 40763 - RNA, 333 nt, synthetic construct
  misc_feature 1..333: note = derived and/or modified sequence opt5 from anti-HIV_059-038595_VR-Chain
  source 1..333: mol_type = other RNA
cagagcgtgctgacccaacccccttccgtctctgccgctccgggccagaaggttacaatcagctgctccgggagatctagcaacattggaaataacttcgtgtcctggtaccagcagctccccggcacggcccctaaactgcttatctatgagaataacaagcggccctctgggattcctgaccgctttagcggatccaaaagcggcacctctgcgacactggggatcaccggactccaaacaggcgatgaagctgactactattgtggcacctgggatacatccctgagcgccgggggagtgttcggctctgggaccaaggtcattgtgctt

SEQ ID NO: 40764 - RNA, 333 nt, synthetic construct
  misc_feature 1..333: note = derived and/or modified sequence opt5 from anti-HIV_059-035082_VR-Chain
  source 1..333: mol_type = other RNA
cagagcgtgctgacccaacccccttccgtctctgccgctccgggccagaaggttacaatcagctgctccgggtctacgagcaacattggaaaatccttcgtgtcttggtaccagcagctccccggcaccgcccctaagctgcttatctatgacaataacagacggcccagcgggacacctgatcgcttttccggaagcaaatctggcacctccgcgacactggctattaccgggctccaaacaggagacgaggccgattactattgtggcacctggggcgggagcctgtctacgggaggcgtgatcgggaccggaacaaaggtcaccgtgctt

SEQ ID NO: 40765 - RNA, 333 nt, synthetic construct
  misc_feature 1..333: note = derived and/or modified sequence opt5 from anti-HIV_059-029204_VR-Chain
  source 1..333: mol_type = other RNA
cagagcgtgctgacccaacccccttccgtctctgccgctccgggccagaaggttacaatcagctgctccgggtctacgagcaacattggaaaaatcctcgtgtcctggtaccagcagctgcccggcaccgcccctaagccctctatttatgacaataacagacggcctagcgggacacccgatcgcttctccggaagcaaatctggcacctccgcgacacttgctatcaccgggctgcaaacaggagacgaggccgattactattgtggcacctgggacggcagcctctctaccgggggagtgattggcacggggacaaaggtcaccgtgcct

SEQ ID NO: 40766 - RNA, 324 nt, synthetic construct
  misc_feature 1..324: note = derived and/or modified sequence opt5 from anti-HIV_059-025235_VR-Chain
  source 1..324: mol_type = other RNA
cagagcgtgctgacccaacccccttccgtctctggcgccccggggcagaagatcacaattagctgctccggatctacgagcaacatcggcaaatcctacgtttcttggtatcagcagctccccgggaccgctcctaagctgcttatttacgagaataacagacggcccagcggaacacctgaccgcttctccggcagcaaatctgggacctccgccacactggcgatcaccggactccaaacaggcgatgaagctgactattactgtggcacctgggatgggagcggaggcgtgattgggacgggaaccaaggtgacagtcctg

SEQ ID NO: 40767 - RNA, 333 nt, synthetic construct
  misc_feature 1..333: note = derived and/or modified sequence opt5 from anti-HIV_059-015192_VR-Chain
  source 1..333: mol_type = other RNA
cagagcgtgctgacccaacccccttccgtctctgccgctccgggccagaaggttacaatcagctgctccgggtctagctccacgattggagacaaatacgtgtcttggtatcagctcctgcccggcaccgcccctaaacttctgatctacaagaacaataagagacccagcgggattcctgatcggttctccggaagcaaatctggcacatccgcgaccctcgggatcacaggactgcagaccggcgacgaggctgattattactgtggcacatgggacaccagcctttctgtcgggggagtgtttggcacggggaccaaggtgacagttctg

SEQ ID NO: 40768 - RNA, 333 nt, synthetic construct
  misc_feature 1..333: note = derived and/or modified sequence opt5 from anti-HIV_059-007060_VR-Chain
  source 1..333: mol_type = other RNA
cagagcgtgctgacccaacccccttccgtctctgccgctccgggccagaaggttacaatcagctgctccgggtctagctccaacattggaaataaatacgtgtcttggtatcagcagctccccggcacggcccctaagctgcttatctacgagaacaaaaagagacccagcgggattcctgaccggttctccggaagcaaatctggcacctccgcgacactggggatcaccggactccaaacaggcgatgaagctgactatttttgtggcacctgggatacaagcctgtctgggggaggcgtgttcgggtccggaaccaaggtcacggtgctt

SEQ ID NO: 40769 - RNA, 324 nt, synthetic construct
  misc_feature 1..324: note = derived and/or modified sequence opt5 from anti-HIV_059-006953_VR-Chain
  source 1..324: mol_type = other RNA
cagagcgtgctgacccaacccccttccgtctctgccgctccgggccagaaggttacaatcagctgctccgggtctagctccaacattggagtgtcttggtaccaacaggtgcccggcacggcccctaaactcctgatctatgacaatgataagagacccaccgggattcctgaccggttcagcggatccaaaagcggcacatctgcgatccttgctattaccgggctgcagacaggagatgagggcgactactattgtggcacctgggaaacatccctcagcgggggaggcgtctttgggaccggaacgaaggtgaccgttctg

SEQ ID NO: 40770 - RNA, 333 nt, synthetic construct
  misc_feature 1..333: note = derived and/or modified sequence opt5 from anti-HIV_059-005953_VR-Chain
  source 1..333: mol_type = other RNA
cacagcgtgctgacccagcccccttccgtctctgccgctccgggccaaaaggttacaatcagctgctccgggacgtctagcaacattggcaaaaattacgtgtcctggtatcagcagctccccggaaccgcccctaagctgcttatctacgagaacaatagacggccctctgggacacctgaccgcttcagcggatccaaaagcggcacctctgcgacactggctattaccgggctccagacaggagatgaagccgactattactgtggcacctgggatacgtccctgagcaccggcggggtgtttggaacaggcaccaaggtcacagtgctt

SEQ ID NO: 40771 - RNA, 324 nt, synthetic construct
  misc_feature 1..324: note = derived and/or modified sequence opt5 from anti-HIV_059-003725_VR-Chain
  source 1..324: mol_type = other RNA
cagagcgtgctgacccaacccccttccgtctctgccgctccgggccagaagctcacaatcagctgctccgggtctacgagcaaaattggaaacaattacgtttcctggtatcagcaccttcccggcaccgcccctaagctgctggtgtacgagaacaataaaagaccctctgggatccctgaccggttcagcggatccaagagcggcacatctgcgaccctcgctattacagggctgcagaccggagatgaagccgactattactgtggcacatgggatggccgcctttccgtgatcgggaccggaacgaaagtcaccgtgctg

SEQ ID NO: 40772 - RNA, 333 nt, synthetic construct
  misc_feature 1..333: note = derived and/or modified sequence opt5 from anti-HIV_059-002618_VR-Chain
  source 1..333: mol_type = other RNA
cagctggtgctcacccaaccccctagcgtctccgccgctccgggccagaaggttacaatctcttgcagcgggtcctctagcaacattggaaataacttcgtgtcctggtaccagcagctgcccggcacggcccctaaacttctgatctatgagaataacaagagaccctctgggattcctgaccggtttagcggatccaaaagcggcacctctgcgacactcgggatcaccggactgcaaacaggcgatgaagctgactactattgtggcacctgggatacacgcctttccgccgggggagtgttcggcaccgggacgaaggtcaccgtgctg

SEQ ID NO: 40773 - RNA, 324 nt, synthetic construct
  misc_feature 1..324: note = derived and/or modified sequence opt5 from anti-HIV_059-001522_VR-Chain
  source 1..324: mol_type = other RNA
cagagcgtgctgacccaacccccttccgtctctgccgctccgggccagaaggttacaatcagctgctccgggtctaacagcaatattggaaacaattacgtgtcctggtatcagcagctccccggcacggcccctaaactgcttatctacgagaacaataagagaccctctgggattcctgaccggttcagcggatccaaaagcggcacctctgcgacactggctatcaccgggctccaaacaggagatgaagccgactattactgtggcacctgggatggccgcctgtccgtgattggggccggaacaaaggtcatcgtggtt

SEQ ID NO: 40774 - RNA, 333 nt, synthetic construct
  misc_feature 1..333: note = derived and/or modified sequence opt5 from anti-HIV_059-000731_VR-Chain
  source 1..333: mol_type = other RNA
cagagcgtgctgacccaacccccttccgtctctgccgctccgggccagaaggttacaatcagctgctccgggtctacgagcaacattggaaataaatacgtgtcctggtatcaacaggtgcccggcaccgcccctaagctcctgatctacgagaacaatagacggccctctgggattcctgaccgcttcagcggatccaaaagcggcacatctgcgacccttgctatcacagggctgcagaccggagatgaagccgactattactgtggcacatgggatgcctccctcagaaccggcggggtcattggaacgggcaccaaggtgacagttctg

SEQ ID NO: 40775 - RNA, 333 nt, synthetic construct
  misc_feature 1..333: note = derived and/or modified sequence opt5 from anti-HIV_059-000634_VR-Chain
  source 1..333: mol_type = other RNA
cagagcgtgctgacccaacccccttccgtctctgccgctccgggccagaaggttacaatcagctgctccgggtctagctccacgattggaaacaattacgtgtcttggtatcaggtggtccccggcaccgcccctaaactcctgatctacaagattaacgagagacccagcgggatccctgaccggttctccggaagcaaatctggcacatccgcgacccttgggattacaggactgcagaccggcgatgaagctgactattactgtggcacatgggataccagcctctctgggggaggcgtgtttgggcccggaacgaaggttaccgtgctg

SEQ ID NO: 40776 - RNA, 333 nt, synthetic construct
  misc_feature 1..333: note = derived and/or modified sequence opt5 from anti-HIV_048-250757_VR-Chain
  source 1..333: mol_type = other RNA
cagagcgtgctgacccaacccccttccgtctctggcgccccggggcagagagttacaatcagctgcacgggaaccacatccaacattggctctaattacgtggcttggtatcagcagctccccgggaccgcccctaagctgcttatctacgacaacgataaacggcccagcggcattcctgaccgcttctccggatctaagagcgggacatccgcgaccctgggaatcacaggcctccaaaccggcgatgaggctgactattactgtgggacgtgggataccagcctgtctgccggaggcgtgtttgggacaggaaccaaagtcacagtgctt

SEQ ID NO: 40777 - RNA, 333 nt, synthetic construct
  misc_feature 1..333: note = derived and/or modified sequence opt5 from anti-HIV_048-250716_VR-Chain
  source 1..333: mol_type = other RNA
cagagcgtgctgacccaacccccttccgtctctgccgctccgggccagaaggttacaatcagctgctccgggtctagctccaacattggaaataaatacgtgtcttggtatcagcagctccccggcacggcccctaagctgcttatctacgagaacagcaaaagaccctccgggattcctgaccggttcagcggatctaagtccggcaccagcgcgacactggggatcaccggactccaaacaggcggccaggctgattattactgtgggacctgggacacatctctgtccgccggaggcgtgtttgggagcggaaccaaagtcacggtgctt

SEQ ID NO: 40778 - RNA, 333 nt, synthetic construct
  misc_feature 1..333: note = derived and/or modified sequence opt5 from anti-HIV_048-250463_VR-Chain
  source 1..333: mol_type = other RNA
cagagcgtgctgacccaacccccttccgtctctgccgctccgggccagaaggttacaatcagctgctccgggtctagaagcaacaatggaaacaattacgtgtcctggtatcagcagctccccggcacggcccctaagctgcttatttacgagaacaataagcggccctctgggatccctgaccgcttcagcggatccaaaagcggcacctctgcgacactggctattaccgggctccaaacaggagatgaagccgactattactgtggcacctgggattccagcctgtctggcgggggagtgatcggcacagggaccaaacttacggtcctg

SEQ ID NO: 40779 - RNA, 333 nt, synthetic construct
  misc_feature 1..333: note = derived and/or modified sequence opt5 from anti-HIV_048-248153_VR-Chain
  source 1..333: mol_type = other RNA
cagagcgccctgacccaacccgcttccgtgtctgccagcttcggccagtccatcacaatttcttgcacgggggcggctagcgacgtcggatacaactatgtttcctggtaccagcagctccctggcaccacaccgaagctgcttatctatagaaataaccaacggccctctgggattcctgatcgctttagcggatccaaaagcggcacctctgccacactggggatcaccggactccagacaggcgacgaggccgattactattgtggcacctgggacacgtccctgagcgctgggggagtgttcggcaccgggacaaaggtgaccgtcctt

SEQ ID NO: 40780 - RNA, 333 nt, synthetic construct
  misc_feature 1..333: note = derived and/or modified sequence opt5 from anti-HIV_048-247532_VR-Chain
  source 1..333: mol_type = other RNA
cagagcgtgctgacccaacccccttccgtctctgccgctccgggccagcaggttacaatcagctgctccgggacgacctctaacattggaacaaattacgtgagctggtatcagcaaatgccccctgccgcgcccaagctcctgatctacgacaacaaaaagagaccttccgatattcccgaccggttctctggcagcaaatccgggaccagcgctacacttggaatcaccggcctgcagacaggggatgaggccgactattactgtggaacctgggatacgtctctctccgccggcggcgtgtttgggaccggaacaaaggtcaccgtgctg

SEQ ID NO: 40781 - RNA, 333 nt, synthetic construct
  misc_feature 1..333: note = derived and/or modified sequence opt5 from anti-HIV_048-245846_VR-Chain
  source 1..333: mol_type = other RNA
cagagcgtgctgacccaacccccttccgtctctgccacaccgggccagagagttacgatcagctgcaccgggtcctctagcaacattggaggctacgacgtgtcctggtatcaggtgctccccgggacagctcctaagctgcttatctacgattctgacaaacggcccagcggcattcctgatcgcttctccggaagccagtctgggacctccgccacactgggaatcaccggcctccaaacaggcgacgaggcggattattactgtgggacctgggacacgagcctgtctggaggcggggtctttggaaccggcacaaaggtgaccgttctt

SEQ ID NO: 40782 - RNA, 333 nt, synthetic construct
  misc_feature 1..333: note = derived and/or modified sequence opt5 from anti-HIV_048-244016_VR-Chain
  source 1..333: mol_type = other RNA
cagagcgtgctgacccaacccccttccgtctctggcgccccggggcagagagttacaatcagctgcacgggatcctctagcaacattggcgggtacgacgtgcactggtatcagcagctccccggaaccgctcctaagctgcttatctacaaaaatgataagcggccctccggcattcctgaccgcttctctgggagcaaatccggaacaagcgccatcctgggcattaccggcctccaaacaggggatgaggcggactattactgtggagcttgggatacctctctgtccgccggcggggtgtttggaacaggcaccaaggtcacggtgctt

SEQ ID NO: 40783 - RNA, 333 nt, synthetic construct
  misc_feature 1..333: note = derived and/or modified sequence opt5 from anti-HIV_048-243682_VR-Chain
  source 1..333: mol_type = other RNA
cagagcctgctcacccaacccccttccgtgtctgccgctccgggccagaaggtcacaatcagctgcacggggtcctctagcaacattggaggctacgacgttcactggtatcagcagctgcccgggaccgcccctaaacttctgatctacgagaataacaagagaccctccggcattcctgatcggttctctggaagcaaatccgggacaagcgcgaccctcggaatcacaggcctgcaaaccggcgacgaagctgattattactgtgggacatgggactcttcccttagcgccggaggcgtgtttgggaccggaacgaaggtgaccgtcctg

SEQ ID NO: 40784 - RNA, 333 nt, synthetic construct
  misc_feature 1..333: note = derived and/or modified sequence opt5 from anti-HIV_048-243588_VR-Chain
  source 1..333: mol_type = other RNA
cagagcctgctcacccaacccccttccgtgtctgccccgcccggccagatggtcagcatctcctgctctgggagctcccacaacattggagacaattacgtttcttggtatcagcatctgcctggcacagctcccaaacttctgatctacgataacaatagcagaccttccgggattcccgaccggttcagcggatctaagtccggcacgagcgccaccctcgggatcacaggactgcagaccggcgatgaggcggactattactgtggcacatgggatacctctctttccgggggaggcgtgtttgggacaggaaccaaggtgacggtcctg

SEQ ID NO: 40785 - RNA, 333 nt, synthetic construct
  misc_feature 1..333: note = derived and/or modified sequence opt5 from anti-HIV_048-241775_VR-Chain
  source 1..333: mol_type = other RNA
cagagcgtgctggcccaacccccttccgtctctggcgctccggggcagagagttaccatcagctgcacaggatcctctagcaacattggcgagtacgacgtgcactggtatcagcagctccccgggacggcccctaagctgcttatctacgaaaataacaaacggccctccggcattcctgatcgcttctctggaagcaagtccgggaccagcgcgacactgggaatcaccggcctccaaacaggcgacgaggctgattattactgtgggacctgggactcttccctgagcgccggaggcgtgtttgggacaggaaccaaagtcacggtgctt

SEQ ID NO: 40786 - RNA, 333 nt, synthetic construct
  misc_feature 1..333: note = derived and/or modified sequence opt5 from anti-HIV_048-237996_VR-Chain
  source 1..333: mol_type = other RNA
cagagcgtgctgacccaacccccttccgtctctggcgccccggggcagagagttacaatcagctgcacgggatcctctagcaacattggcgggtacgacgtgcactggtatcggcagctccccggaaccgctcctaagctgcttatctacgatacagtgaaacgcccctccggcattcctgacagattctctgggagcaagtccggaaccagcgccacactgggcatcaccggcctccagacaggggatgaggcggactattactgtggaacctgggatacgtctctgtccgctggcggggtctttggaaccggcacaaaagtgaccgttctt

SEQ ID NO: 40787 - RNA, 330 nt, synthetic construct
  misc_feature 1..330: note = derived and/or modified sequence opt5 from anti-HIV_048-237730_VR-Chain
  source 1..330: mol_type = other RNA
agcgtgctgacccagcccccttccgtctctggcgccccggggcagagagttacaatcagctgcacgggaaccaactccaatttcggctctaactacgctcactggtatcaacaggtgcccgggacagcccctaagctcctgatttacagcaataacgcgcggccctccggaatccctgaccgcttttctggcagcaaatccgggaccagcgctacacttggaattaccggcctgcagacaggcgatgaggccgactattactgtgggacctgggatacgtctctctccgccggaggcgtgttcgggaccggaacaaaggtcaccgtgctg

SEQ ID NO: 40788 - RNA, 333 nt, synthetic construct
  misc_feature 1..333: note = derived and/or modified sequence opt5 from anti-HIV_048-237253_VR-Chain
  source 1..333: mol_type = other RNA
cagagcgtgctgacccaacccccttccgtctctgccgctccgggccagaaggttacagtgagctgctccgggtctagctccaacatcggatctaatgacgtgagctggtaccagcagttccccggcgccgcgcctaaactcctgatttataagaacaatgagagaccctccgggatccctgatcggtttagcggatctaaatccggcacgagcgctacccttgggattacaggactgcaaaccggcgacgaagccgattactattgtggcacatgggacacctctctctccgccgggggagtcttcggcacagggaccaaggtgacggttctg

SEQ ID NO: 40789 - RNA, 333 nt, synthetic construct
  misc_feature 1..333: note = derived and/or modified sequence opt5 from anti-HIV_048-234100_VR-Chain
  source 1..333: mol_type = other RNA
cagagcatgctgacccagcccccttccgtgtctgccgctccgggcgagaaggtcacaatcagctgctccgggtctagctccaacattggaaaaacgttcgtttcttggtaccaacaggtgcccggcaccgcccctaagctcctgatctataaaaatgacaacagacccagcgggattcctgatcggttttccggaagcaagtctggcacatccgcgacccttgggatcagcggactgcagacaggcgacgaagctgattactattgtggcacctgggacacatctctctccgggggaggcgtgttcgggaccggaacgaaagtcaccgtgctg

SEQ ID NO: 40790 - RNA, 333 nt, synthetic construct
  misc_feature 1..333: note = derived and/or modified sequence opt5 from anti-HIV_048-230882_VR-Chain
  source 1..333: mol_type = other RNA
cagagcgtgctgacccaacccccttccgtctctgccgctccgggccagaaggttacaatcagctgctccgggaactctagcaatattggatccaacttcgtgtcttggtaccagcagctccccggcacggcccctaaactgcttatctatgagaataacaagagacccagcgggattcctgaccggttttccggaagcaaatctggcacctccgcgacactggggatcaccggactccaaacaggcgatgaagctgactactattgtggcacctgggatacaagcctgtctcccgggggagtgttcggcaccgggacgaaggtcaccgtgctt

SEQ ID NO: 40791 - RNA, 333 nt, synthetic construct
  misc_feature 1..333: note = derived and/or modified sequence opt5 from anti-HIV_048-229473_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagttccccggcacggcccctaaactcctgatctacgagaataacaagagacccagcgggattcctgaccggttttccggaagcaaatctggcaccacagcgacccttgctatcacacgcctgcaaaccggggatgaagccgactattactgtggaacatggggcggctccctcagcgccgggggagtgttcggcaccgggacgaaggtcaccgtgctg

SEQ ID NO: 40792 - RNA, 333 nt, synthetic construct
  misc_feature 1..333: note = derived and/or modified sequence opt5 from anti-HIV_048-228238_VR-Chain
  source 1..333: mol_type = other RNA
cagagcgtgctgacccaacccccttccgtctctgccgctccgggccagaaggttacaatcagctgctccgggtctagctccaacattggaatcaattacgtgtcttggtatcagcagctccccggcacggcccctaaactgcttatttacgacaacaccaagagaccccaagggatccctgatcggttcagcggatccaaaagcggcacatctgcgaccctggctattacagggctccagaccggagacgaggccgattattactgtggcacatgggacggctccctgagcaccgggggagtgatcggcacggggaccaaggtcacagtgctt

SEQ ID NO: 40793 - RNA, 333 nt, synthetic construct
  misc_feature 1..333: note = derived and/or modified sequence opt5 from anti-HIV_048-228027_VR-Chain
  source 1..333: mol_type = other RNA
cagagcctgctcacccaatccccctctgccagcggccctccggggcagagagtgacaatctcctgctctggaagcaactccaatattggctctaacacggtcaattggtaccaccatctgcccggggctgcccctaaacttctgatctatgagaacagcaagcggccctccggcattcctgaccgcttcagcggatctaagtccgggaccagcgcgacactcggaatcaccggcctgcagacaggcgatgaagctgactactattgtgggacctgggatacatctctttccgccggaggcgtttttgggagcggaaccaaagtgacggtgctg

SEQ ID NO: 40794 - RNA, 333 nt, synthetic construct
  misc_feature 1..333: note = derived and/or modified sequence opt5 from anti-HIV_048-227795_VR-Chain
  source 1..333: mol_type = other RNA
cagagcgtgctgacccaacccccttccgtctctgccgctccgggccagaaggttacaatcagctgctccgggtctagctccaacattgagtctagaagcgtgcactggtaccagcagaaacccggacaagcccctgtgctcgtcatctattacgactccgatcggcccagcggcattcctgaccgcttctctgggtccaagagcggaacggcggctaccctgggcatcacagggcttcagaccggagatgaagccgactattactgtggcacatgggatacctctctgtccgccggcggggtgtttggaacaggcaccaaagttacggtgctc

SEQ ID NO: 40795 - RNA, 333 nt, synthetic construct
  misc_feature 1..333: note = derived and/or modified sequence opt5 from anti-HIV_048-227770_VR-Chain
  source 1..333: mol_type = other RNA
cagagcgtgctgacccaacccccttccgtctctggcgccccggggcagagagttacaatcagctgcacgggatcctctagcaacattggcccccgggacgtgcactggtaccagcagctccctgggaccgtgcccaagctgcttatctatgatacatacacccgcccttccggcattcccgacagattctctggaagcaaatccggggctagcgccacactggatatcaccggactccaaacaggcgacgaggcggattattactgtggcatttgggacacctctctgtccgctgggggagtctttggcacggggaccaaggtgacagttctt

SEQ ID NO: 40796 - RNA, 333 nt, synthetic construct
  misc_feature 1..333: note = derived and/or modified sequence opt5 from anti-HIV_048-225298_VR-Chain
  source 1..333: mol_type = other RNA
cagagcgccctgacccaacccagatccgtgtctggcagccctgggcagtccgtcacaatctcttgcacgggaaccagcaacgacgttggctacgattatgtgtcctggtaccagcagctcccggggacagctcccaagctgcttatttatgacatcaataaacggccttctggcattcccgatcgcttcagcggatccaagagcgggacctctgccacactgggaatcaccggcctccaaacaggcgacgaggcggattactattgtgggacctgggacacgtccctgagcgctggaggcgtgtttgggaccggaacaaaagtcaccgtgctt

SEQ ID NO: 40797 - RNA, 327 nt, synthetic construct
  misc_feature 1..327: note = derived and/or modified sequence opt5 from anti-HIV_048-225090_VR-Chain
  source 1..327: mol_type = other RNA
gagctgacccagccccctagcgtgtccggcgccccggggcaaagagtcacaatctcttgcacgggaagctcctctaacattggcgggtacgacgttcactggtatcagcagctccccggaaccgctcctaagctgcttatctacgataataacaaacggcccagcggcattcctgaccgcttctccgggtctaagagcggaacatccgccaccctgggcatcacaggcctccagaccggggatgaagcggactattactgtggaacatgggataccagcctgtctacgggcggggtgtttggaaccggcacaaaagtgaccgtcctt

SEQ ID NO: 40798 - RNA, 333 nt, synthetic construct
  misc_feature 1..333: note = derived and/or modified sequence opt5 from anti-HIV_048-224187_VR-Chain
  source 1..333: mol_type = other RNA
cagagcgtgctgacccaacccccttccgcctctggcacaccggggcagagagtcacgatcagctgctccggatctagcgctaacattggcaccaattacgttttctggtatcagcacctccccgggacaacccctcggctgcttatctttcgcaacaatgagagaccctccggcattcctgaccggttctctggaagcaagtccgggacaagcgccaccctgggaatcacaggcctccagaccggcgatgaagcggactactattgtgggacgtgggatacctctctgtccgctggaggcgtgtttgggacaggaaccaaagtgacagtcctt

SEQ ID NO: 40799 - RNA, 333 nt, synthetic construct
  misc_feature 1..333: note = derived and/or modified sequence opt5 from anti-HIV_048-223055_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagttccccggcacggcccctaaagtgctcatctacgggaatagcaagagaccctccggcattcctgaccggtttagcggatctaaatccgggaccagcgcgacactgggaatcaccggccttcaaacaggcgatgaggctgactattactgtgggacctgggatacatctctgtccgccggaggcgtcttcgggagcggaaccaaggtgacggttctc

SEQ ID NO: 40800 - RNA, 333 nt, synthetic construct
  misc_feature 1..333: note = derived and/or modified sequence opt5 from anti-HIV_048-222711_VR-Chain
  source 1..333: mol_type = other RNA
cagcccgtgctgacccaacctccgagcgtctccggcgcccccgggcagagagttacaatctcttgcacgggaagctcctctaacattggcgggtacgacgtgcactggtatcaacaggtgcctggaaccgctcccaagctcctgatcttcgagaataaccggcgccctagcggcattcccgatagattttccgggtctaaaagcggaacatccgccacccttgcgatcacaggcctgcagaccggcgacgaagctgattactattgtgggacatgggacggaagcctctctaccggcggggtcattggaacgggcaccaaggtgacagttctg

SEQ ID NO: 40801 - RNA, 333 nt, synthetic construct
  misc_feature 1..333: note = derived and/or modified sequence opt5 from anti-HIV_048-221209_VR-Chain
  source 1..333: mol_type = other RNA
cagagcgtgctgacccaacccccttccgtctctggcgccccggggcagagagttacaatcagctgcacgggaaactcctctaatattggcgactacgatgtgcactggtatcaacaggtggctgggaccgcccccaagctcctgatcttcaaaaacaatgagcggcctagcggcattcccgaccgcttttccggatctaagagcgggacatccgcgacccttggaatcacaggcctgcagaccggcgatgaagctgactactattgtgggacatgggataccagcctctctgccggaggcgtcttcgggtccggaacgaaagtgaccgttctg

SEQ ID NO: 40802 - RNA, 333 nt, synthetic construct
  misc_feature 1..333: note = derived and/or modified sequence opt5 from anti-HIV_048-220629_VR-Chain
  source 1..333: mol_type = other RNA
cagagcgccctgacccaacccgcttccgtgtctggcagcctcgggcagtccatcacaatttcttgcacgggaaccagcagagacgtcggctactcctatgtttcttggtaccagcaccttcctgggacagccccgaagctgctgatctatgagaacaataaacggcccagcggcattcctgatcgcttctccggaagcaagtctgggacctccgcgacactcggaatcaccggcctgcagacaggcgacgaagctgattactattgtgggacctgggacagctctctttccgccggaggcgtgtttgggacgggaaccaaagtgacagtcctg

SEQ ID NO: 40803 - RNA, 333 nt, synthetic construct
  misc_feature 1..333: note = derived and/or modified sequence opt5 from anti-HIV_048-219430_VR-Chain
  source 1..333: mol_type = other RNA
cagagcgtgctgacccaacccccttccgtctctgccgctccgggccagatggttacaatcagctgctccgggtctacgagcaacattggaatcaattacgtgtcctggtatcagcacgtgcccggcaccgcccctaagctcctgatttacgacaacaataaaagaccctctgggatccctgatcggttcagcggatccaagagcggcacatctgcgacccttgggattacaggactgcataccggcgacgaggctgattattactgtggcacatgggacacctccctcagcgccgggggagtctttggcacggggaccaaagtgacagttctg

SEQ ID NO: 40804 - RNA, 333 nt, synthetic construct
  misc_feature 1..333: note = derived and/or modified sequence opt5 from anti-HIV_048-216250_VR-Chain
  source 1..333: mol_type = other RNA
cagagcgtgctgacccaacccccttccgtctctgccgctccgggccagaaggttacaatcagctgcacggggaccacatccgacttcggatacaactgtgtgtcttggtatcagcagcaccccggcagagcccctaaagtgattatcagcggggtcaataagcggccctccggcattcctgatcgcttttctggaagcaaatccgggaccagcgcgacactcggaatcaccggcctgcaaacaggcgacgaggctgattactattgcgggacctgggactcttcccttagcgccggaggcgtgttcgggacgggaaccaaggttacagtgctg

SEQ ID NO: 40805 - RNA, 321 nt, synthetic construct
  misc_feature 1..321: note = derived and/or modified sequence opt5 from anti-HIV_048-216133_VR-Chain
  source 1..321: mol_type = other RNA
acccagccccctagcctgtccgccacaccgggccaaagagtgtctatcagctgctccgggggaggctctaacattgggaataacgacgtcttctggtttcagcagttccccggagctggccctcggctcctgatctacgataatcacaagcgccattatgggacgcccgacagatttagcggatccaaatctggcaccagcgccacacttgcgattaccggcctgcagacaggggatgaggctgcctactattgtggaacctgggacggctccctcagcacagggggagttatcggcaccgggacgaaggtgaccgtgctg

SEQ ID NO: 40806 - RNA, 333 nt, synthetic construct
  misc_feature 1..333: note = derived and/or modified sequence opt5 from anti-HIV_048-214886_VR-Chain
  source 1..333: mol_type = other RNA
cagagcgccctgacccaacccagatccgtgtctggcagccctgggcagtccgtcacaatctcttgcacgggaaccagctccgacgttggctacaactatgtgtcttggtaccagcaccatccggggacagctcccaagctcctgatttataaaaataacaatcggcctagcggaatccccgatcgcttctccggcagcaagtctgggacctccgccacacttggaattaccggcctgcagacaggcgacgaggcggattactattgtgggacctgggacacgagcctctctgctggaggcgtgtttgggaccggaacaaaagtcaccgtgctg

SEQ ID NO: 40807 - RNA, 333 nt, synthetic construct
  misc_feature 1..333: note = derived and/or modified sequence opt5 from anti-HIV_048-214709_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaatgacagacggcccagcgggattcctgatcgcttctccggaagcaagtctggcacctccgcgacactggggatcaccggactccaaacaggcgacgaagctgattattactgtggcacctgggacacaagcctgtctgccgggggagtgtttggcaccgggacgaaagtcaccgtgctt

SEQ ID NO: 40808 - RNA, 333 nt, synthetic construct
  misc_feature 1..333: note = derived and/or modified sequence opt5 from anti-HIV_048-214001_VR-Chain
  source 1..333: mol_type = other RNA
cagagcgtgctgacccaacccccttccgtctctggcgccccggggcagacagttacgatcagctgctccggatctaacagcaatattggcaaccacgacgtgcattggtaccagcacgtgcccgggaccgctcctaagctcctgatctatgataataacaaaagaccctccggcattcctgaccggttctctggaagcaagtccgggacaagcgccacccttggaatcacaggcctgcagaccggcgatgaggcggaatactattgtgctacatgggacgcctctctctccgggggaggcgtctttcgcaccgggacgaaagtgaccgttctg

SEQ ID NO: 40809 - RNA, 333 nt, synthetic construct
  misc_feature 1..333: note = derived and/or modified sequence opt5 from anti-HIV_048-213230_VR-Chain
  source 1..333: mol_type = other RNA
cagagcgtgctgacccaacccccttccatgtctgccgctccgggccagaaggtcacaatcagctgctccgggtctagcaacaatattggcaaaaacgttgtgtcctggtaccagcagctccccggaacggcccctaaggtgctgatctatgagaataacaaaagactttctgggattcccgaccggttcagcggatccaagagcggcacctctgcgacactggtcatcaccgggctccaaacaggagatgaagctgactactattgtggcacctgggattccagcctgtctgccggcggggtgtttggaacaggcaccaaagttacggtgctt

SEQ ID NO: 40810 - RNA, 333 nt, synthetic construct
  misc_feature 1..333: note = derived and/or modified sequence opt5 from anti-HIV_048-212574_VR-Chain
  source 1..333: mol_type = other RNA
cagagcgtgctgacccaacccccttccgtctctgccgctccgggccagagagttacagtgagctgctccgggtctacgagcaacatcgagtccaattacgtgtcttggtatcagcaggtccccggaaccgcccctaagctcctgatttacgaaaacaataaacggcccagcggcatccctgaccgcttctccgggagcaagtctggaacatccgcgacccttgctattacaggcctgcaaaccggggatgaggccgcctattactgtggaacatgggacggcagcctctctaccggcggggtgatcggaacgggcaccaaagttacagtgctg

SEQ ID NO: 40811 - RNA, 333 nt, synthetic construct
  misc_feature 1..333: note = derived and/or modified sequence opt5 from anti-HIV_048-212207_VR-Chain
  source 1..333: mol_type = other RNA
cagagcgtgctgacccaacccccttccctctctgccgctccgggccagaaggtcacaatcagctgctccgggggatctagcaacattggcaataactacgtttcctggtatcagcaccttcccgggacggcccctaaactgctgatctacgacaattataagagaccctctggcattcctgatcggttcagcggatccaaaagcgggacctctgcgacactcgacatcaccggactgcagacaggcgatgaggctgactactattgtggcacctgggatacatcccttagcgccgggggagtgtttggcaccgggacgaaggtgaccgtcctg

SEQ ID NO: 40812 - RNA, 333 nt, synthetic construct
  misc_feature 1..333: note = derived and/or modified sequence opt5 from anti-HIV_048-209146_VR-Chain
  source 1..333: mol_type = other RNA
cagagcgtgctgacccaacccccttccgtctctggcgccccggggcagaagatcacagttagctgcacgggaaccacatccaacattggcccccacgacgtgcattggtaccagctcgtgcctgggagaccccctaaactgcttatcttccacaataacattcggccctctggaatccctgatcgctttagcggctccaagtctgggatgagcgctaccctgggaattacaggcctccagaccggcgacgaggccgattattactgtgggacatgggactccagcctgtctgcgggaggcgtcttcgggaccggaacgaaagtgaccgttctt

SEQ ID NO: 40813 - RNA, 333 nt, synthetic construct
  misc_feature 1..333: note = derived and/or modified sequence opt5 from anti-HIV_048-208206_VR-Chain
  source 1..333: mol_type = other RNA
cagagcgtgctgacccaacccccttccgtctctgccgctccgggccagaaggttacaatcagctgctccgggtctagctccaacattggatctaattacgtgagctggtatcagcagttccccggcacggcccctagactcctgatctacgagaacgacaaacggccctccgcgattcctgatcgctttagcgggtctaagtccggaaccagcgctacacttggcatcaccgggctgcacacaggagacgaagccgattattactgtggcacctgggacggctctctctccacagggggagtgattggcaccgggacgaaagtcaccgtgctg

SEQ ID NO: 40814 - RNA, 333 nt, synthetic construct
  misc_feature 1..333: note = derived and/or modified sequence opt5 from anti-HIV_048-208194_VR-Chain
  source 1..333: mol_type = other RNA
cagagcgccctgacccaacccccttccgcttctggcagcccggggcagtccgtgacaatctcttgcacgggaaccagctccgacattggctacaagtatgtctcttggtaccagctcctgcccgggacacctcccaaacttctgatcttcaagaacaatgagagacctagcggcattcccgatcggttttccggaagcaaatctgggacctccgccacactcggaatcaccggcctgcagacaggcgacgaagcggattattactgtggggcttgggacaccagcctttctgccggaggcgttttcgggacgggaaccaaggtgacagtgctg

SEQ ID NO: 40815 - RNA, 333 nt, synthetic construct
  misc_feature 1..333: note = derived and/or modified sequence opt5 from anti-HIV_048-207744_VR-Chain
  source 1..333: mol_type = other RNA
cagagcgccctgacccaacccgcttccgtgtctgccagcttcggccagtccatcacaatttcttgcacgggggcggctagcaccatcggaaacaatctcgtctcctggtacagactgcttcctggcacagccccgaagctgctcatttataaaaacgacaatcggccctctgggatccctgatcgctttagcggatccaagagcggcacctctgccacactggggatttccggacttcagaccggcgacgaggctgattactattgtggcacatgggacaccagcctgtctgggggaggcgttttcgggacgggaaccaaagtgacagtgctc

SEQ ID NO: 40816 - RNA, 333 nt, synthetic construct
  misc_feature 1..333: note = derived and/or modified sequence opt5 from anti-HIV_048-206501_VR-Chain
  source 1..333: mol_type = other RNA
cagagcgtgctgacccaacccccttccgtctctggcgccccggggcagagagttacaatcagctgctccggatctagctccaacattggcaataacgctgtgaattggtaccagcagctccccgggaaggcccctaaactgcttatctatgagaacaataagcggccctctggcattcctgaccgcttcagcggatccaaaagcgggacgtctgcgaccctgggaatcacaggcctccaaaccggcgatgaagctgactactattgtgggacatgggattccagcctgtctgccggaggcgtgtttgggaccggaacaaaggtcaccgtgctt

SEQ ID NO: 40817 - RNA, 333 nt, synthetic construct
  misc_feature 1..333: note = derived and/or modified sequence opt5 from anti-HIV_048-204221_VR-Chain
  source 1..333: mol_type = other RNA
cagagcgtgctgacccaacccccttccgcctctggcacaccggggcagagagtcacgatcagctgcttcggatcctctagcaacattgcttcctctgccgttaattggtaccagcagctccccggcaccgcgcctaagctgcttatctataaaaacgacaagcggcccagcgggattcctgatcgcttttccggaagcaaatctggcacatccgctaccctggggatcacaggactccaaaccggcgacgaggccgattactattgtggcacatgggacaccagcctgtctgccgggggagtgttcggcacggggaccaaggtgacagtcctt

SEQ ID NO: 40818 - RNA, 333 nt, synthetic construct
  misc_feature 1..333: note = derived and/or modified sequence opt5 from anti-HIV_048-204015_VR-Chain
  source 1..333: mol_type = other RNA
cagagcgtgctgacccaacccccttccgcctctggcacaccggggcagagagtcacgatcagctgctccggatctagctccaacattggctctaagtacgtttattggtaccagcagctccccgggaccgctcctaaactgcttatctataagaatgacaaccggcccagcggcattcctgatcgcttctccggaagcaaatctgggacatccgccaccctgggaatcagcggcctccaaacaggcgacgaggcggattactattgtgggacctgggacacatctctgtccggaggcggggtgtttggaaccggcacgaaggtgaccgtcctt

SEQ ID NO: 40819 - RNA, 333 nt, synthetic construct
  misc_feature 1..333: note = derived and/or modified sequence opt5 from anti-HIV_048-201240_VR-Chain
  source 1..333: mol_type = other RNA
cagagcgtgctgacccaacccccttccgtctctgccgctccgggccagaaggttacaatcagctgctccgggtctagctccaacattggaaataactacgtggcctggtatcagcagctccccggcacggcgcctaaactgcttatcaaggaaaattctcaaagacccagcgggattcctgaccggttctccggaagcaaatctggcacctccgctacactggccatcaccgggctccagacaggagatgaggccgactactattgtggcacctgggatacaagcctgtctaccggcggggtgtttggaacgggcaccaaggtcacagtgctt

SEQ ID NO: 40820 - RNA, 333 nt, synthetic construct
  misc_feature 1..333: note = derived and/or modified sequence opt5 from anti-HIV_048-200455_VR-Chain
  source 1..333: mol_type = other RNA
cagagcgccctgacccaacccgcttccgtgtctggcagccctgggcagtccatcacaatttcttgcacgggaaccagctccgacgtcggctacaactatgtttcttggtaccaggtgctcccggggacagcccccaagctgcttatctataaaaataccgagagacctagcggcattcccgatcggttctccggaagcaagtctgggacatccgcgaccctggacatcacaggactccagaccggcgatgaagctgactactattgtggcacgtgggataccagcctgtctgccgggggagtgtttggcacagggaccaaagtcacagtgctt

SEQ ID NO: 40821 - RNA, 333 nt, synthetic construct
  misc_feature 1..333: note = derived and/or modified sequence opt5 from anti-HIV_048-200319_VR-Chain
  source 1..333: mol_type = other RNA
cagagcgtggtcacccaacccccttccgcctctggcacaccggggcagagagttacgatcagctgctccggatctagctccaacattggctctaagtacgtgtattggtaccaccagcatcccgggaccgctcctaaactgctcatctatgacaataacaatcggcccagcggcattcctgatcgcttctccggaagcaagtctgggacatccgccaccctgggaatcacaggccttcagaccggcgacgaggcggattactattgtgggacatgggacaccagcctgtctagaggaggcgtgtttgggacgggaaccaaagtcacagtgctc

SEQ ID NO: 40822 - RNA, 333 nt, synthetic construct
  misc_feature 1..333: note = derived and/or modified sequence opt5 from anti-HIV_048-197896_VR-Chain
  source 1..333: mol_type = other RNA
cagagcgtgctgacccaacccccttccgtctctgccgctccgggccagaaggttacaatcagctgctccggggcctcttacaacattggcaaaaatagcgtgtcctggtatcagcagctccccggaacgcctcccaagctgcttatcttcaaaaacaatgagagaccttctgggattcccgaccggtttagcggatccaagagcggcacctctgcgacactggggatcaccggactccaaacaggcgatgaagctgactactattgtgccacctgggatacatccctgagcgccggcggggtgttcggaaccggcacgaaagtcaccgtgctt

SEQ ID NO: 40823 - RNA, 333 nt, synthetic construct
  misc_feature 1..333: note = derived and/or modified sequence opt5 from anti-HIV_048-193813_VR-Chain
  source 1..333: mol_type = other RNA
cagagcgtgctgacccaatccccctctgtcagcgccgctcctggccagaaggttacaatctcctgctctgggagcaactccaatgtgggaaactactatgtgtcttggtaccagcacctcccgggcacggcccccaaagtcctgatttatgaggggaataagagacctagcggagtgcccgaccggttctccggcagcaaatctgggacctccgcgagccttgctatcacaggactgcagaccggcgatgaagccgactactattgtggcacatgggatacctctctctccgccgggggagtttttggcagcgggacaaaggtgaccgtcctg

SEQ ID NO: 40824 - RNA, 333 nt, synthetic construct
  misc_feature 1..333: note = derived and/or modified sequence opt5 from anti-HIV_048-192098_VR-Chain
  source 1..333: mol_type = other RNA
cagagcgtgctgacccaacccccttccgcctctggcacaccggggcagagagtcacgatcagctgctccggatctaccagcaacattggctccaattacgtttattggtaccagcagctccccgggacaacccctaagctgcttatctatgagaacaataaacggccctctggaattacagaccgcttctttggcagcaagtccgggcctagcgctaccctggatatcacaggactccaaaccggcgacgaagccgattactattgtggcacgtgggacgcgtctctgtccgctgggggagtgttcggcaccgggacaaaagtgaccgtcctt

SEQ ID NO: 40825 - RNA, 333 nt, synthetic construct
  misc_feature 1..333: note = derived and/or modified sequence opt5 from anti-HIV_048-191786_VR-Chain
  source 1..333: mol_type = other RNA
cagagcgtgctgacccaacccccttccgtctctgccgctccgggccagaacgttaatatcagctgctccgggtctagctccaacattgagaataacttcgtgtcttggtaccagaagctccccggaacagcccctaaactgcttatctatgacaataacaagagacccagcggcattcgggatcgcttttccgggagcaaatctggaacgtccgcgaccctgggcatcacagggctccagaccggagacgaagctgattactattgtggcacatgggacaccagcctgtctgccggcggggtgttcggatccggcacaaaggtcaccgtgctt

SEQ ID NO: 40826 - RNA, 333 nt, synthetic construct
  misc_feature 1..333: note = derived and/or modified sequence opt5 from anti-HIV_048-188746_VR-Chain
  source 1..333: mol_type = other RNA
cagagcgtgctgacccaacccccttccgcctctggcacaccggggcagaaggtcacgatcagctgctccggatctaacagcaatattggctccaacttcgtttcttggtaccagctcctgcccgggaccacacctaaacttctgatctatagaaataaccagcggcccagcggagtgcctgaccgcttttccggcagcaagtctgggacctccgctacactcggaattaccggcctgcaaacaggcgatgaggccgactactattgtgggacctgggatagctctctttccgcgggaggcgtgttcgggacgggaaccaaagtcacagtgctg

SEQ ID NO: 40827 - RNA, 333 nt, synthetic construct
  misc_feature 1..333: note = derived and/or modified sequence opt5 from anti-HIV_048-185937_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagacccagcgggattccttatcccatctccggaagcaaatctggcacctccgcgacactggggattaccggactccaaacaggcgacgaagctgattactattgtggcacctgggacagctctctgtccgccgggggagtgttcggcacagggaccaaggtcacggtgctt

SEQ ID NO: 40828 - RNA, 333 nt, synthetic construct
  misc_feature 1..333: note = derived and/or modified sequence opt5 from anti-HIV_048-184849_VR-Chain
  source 1..333: mol_type = other RNA
cagagcgtgctgacccaagccccctccgcttctggcacacctgggcagacggtcaccatcagctgctccggatctagctccaacattggcacaaagtacgtttattggtaccagcagctcccggggaccgcccccaaactgcttatctataagaataacgagagaccttctggcattcccgaccggttcagcggatccaaaagcgggacatctgcgaccctgggaatcacaggcctccaaaccggcgatgaagctgactactattgtgggacgtgggatacctccctgagccctggaggcgtgtttgggacaggaaccaaggtgacagtcctt

SEQ ID NO: 40829 - RNA, 333 nt, synthetic construct
  misc_feature 1..333: note = derived and/or modified sequence opt5 from anti-HIV_048-183089_VR-Chain
  source 1..333: mol_type = other RNA
cagagcgtgctgacccaacccccttccgcctctggcacaccggggcagagagtcacgatcagctgctccggatctagctccaacattggctctagctacgtttattggtaccagctcctgcccgggacccctcccaaacttctgatcttcaagaataacgagcggccttccggcattcccgaccgctttagcggatctaagtccgggacaagcgctaccctcggaatcacaggcctgcagaccggcgatgaagccgactattactgtgggacatgggatacctctctttccgcgggaggcgtgttcgggacgggaaccaaagtgacagtcctg

SEQ ID NO: 40830 - RNA, 333 nt, synthetic construct
  misc_feature 1..333: note = derived and/or modified sequence opt5 from anti-HIV_048-181509_VR-Chain
  source 1..333: mol_type = other RNA
cagagcgtgctgacccaacccccttccgtctctggcgccccggggcagagagttacaatcagctgcacgggatcctctagcaacattggcgggtacgacgtgcactggtatcatcagctccccggagctgcccctaagctgcttatctacaaaaatgataaccggccctccggcattcctgaccgcttctctgggagcaagtccggaaccagcgcgacactgggcatctctggcctccagaccggggatgaggctgactattactgtggaacatgggatacctccctgagcggcgggggagtgtttggcacagggaccaaagtcacggtgctt

SEQ ID NO: 40831 - RNA, 333 nt, synthetic construct
  misc_feature 1..333: note = derived and/or modified sequence opt5 from anti-HIV_048-180990_VR-Chain
  source 1..333: mol_type = other RNA
cagagcgtgctgacccaacccccttccgtctctgccgctccgggccagagagttacaatcagctgctccgggtctacgagcaacattggaaataactacgtgtcctggtatcagcacttccccggcaaggtgcctaaagtcgtgatctctgagaccacaaagcggcccagcgggattcctgaccgcttttccggaagcaaatctggcacctccgccacactcgggatcaccggactgcagacaggcgatgaagcggactactattgtggcacctgggatagctctctttccgctgggggagttttcggcacggggaccaaggtgacagtcctg

SEQ ID NO: 40832 - RNA, 333 nt, synthetic construct
  misc_feature 1..333: note = derived and/or modified sequence opt5 from anti-HIV_048-177532_VR-Chain
  source 1..333: mol_type = other RNA
cagagcgccctgacccaacccccttccgcttctggcagcctcgggcagtccgtgacaatctcttgcacgggaaccagctccgacgtcggcaacaatttcgtttcttggtaccagaagaaaccggggaaggcccccaaactgattgtgtatgaggtgaacaagagacctagcggaatccccgatcggttttccggcagcaaatctgggacatccgcgacccttggaattacaggcctgcagaccggcgacgaagctgattactattgtgggacatgggacaccagcctctctacgggaggcgtcttcgggaccggaacaaaggtgaccgttctg

SEQ ID NO: 40833 - RNA, 324 nt, synthetic construct
  misc_feature 1..324: note = derived and/or modified sequence opt5 from anti-HIV_048-177426_VR-Chain
  source 1..324: mol_type = other RNA
ctgacccagccccacagcgtgtccgagtctcctggcaagacagtcacgatcagctgcaccgggacatcctctgacgttggatacaactatgtgagctggtaccaacatcacccgggcaaagcgcccaagctcctgatttatgaagtgaccaaaagaccttccgggatccccgatcggttctctggaagcaagtccggcacaagcgctacccttgggattacaggactgcagaccggcgacgaggccgattactattgtggcacgtgggactcttccctcagcgccgggggagtctttggcaccgggacaaaagtgaccgttctg

SEQ ID NO: 40834 - RNA, 333 nt, synthetic construct
  misc_feature 1..333: note = derived and/or modified sequence opt5 from anti-HIV_048-177389_VR-Chain
  source 1..333: mol_type = other RNA
cagagcgtgctgacccaacccccttccatgtctgccgctccgggcgagagagtcacaatcagctgctccgggtctagctccaacattggaaatcaccatgtttcttggtaccagcagcggcccggcacggcccctaagctcctgatctatgaaaacaatgagcgccccagcgggattcctgacagattctccggaagcaaatctggcacctccgcgacacttgggatcaccggactgcagacaggcgatgaagctgactactattgtggcacctgggatacaagcctctctgccgggggagtgtttggctccgggaccaaggtgacggtcctg

SEQ ID NO: 40835 - RNA, 333 nt, synthetic construct
  misc_feature 1..333: note = derived and/or modified sequence opt5 from anti-HIV_048-174266_VR-Chain
  source 1..333: mol_type = other RNA
cagagcgtgctgacccaacccccttccgtctctggcgccccggggcagagagttacaatcagctgctccggatctagctccaacattggctctcactacgtgagctggtatcaacaggtgcccgggacggctcctcggctcgtcatctacgacaccattaagcgccattccggaatccccgatagattcagcggctctaaatccgggacaagcgccaccctgggaattacaggccttcagaccggcgacgaggcggattattactgtgggacatgggacacctctctgtccgctggaggcgtgtttgggacgggaaccaaggttacagtgctc

SEQ ID NO: 40836 - RNA, 333 nt, synthetic construct
  misc_feature 1..333: note = derived and/or modified sequence opt5 from anti-HIV_048-172847_VR-Chain
  source 1..333: mol_type = other RNA
cagagcgtgctgacccaacccccttccgtctctgccgctccgggccagagagttacagtgagctgctccgggtctacgagcaacatcgagtccaattacgtgtcttggtatcagcaggtccccggaaccgcccctaagctcctgatttacgaaaacaataaacggcccagcggcatccctgaccgcttctccgggagcaagtctggaacatccgcgacccttggcattacagggctgcaaaccggagatgaggctgactattactgtggcacatgggataccagcctctctgccggcggggtgtttggaacgggcaccaaagttacagtgctg

SEQ ID NO: 40837 - RNA, 333 nt, synthetic construct
  misc_feature 1..333: note = derived and/or modified sequence opt5 from anti-HIV_048-172845_VR-Chain
  source 1..333: mol_type = other RNA
cagagcgccctgacccaacccccttccgcttctggcagcccggggcagtccgtgacaatctcttgcacgggaaccagctccgacgtcggctacaactatgtttcttggtaccagcagctccccgggacagcccctaagctgcttatttatagaaataaccaacggcccagcggagtgcctgatcgcttctccggcagcaaatctgggacctccgcgacactgggaatcaccggcctccagacaggcgacgaggctgattactattgtgccacctgggacacgagcctgtctgccgggggagtgtttggcaccgggacaaaggtcaccgtgctt

SEQ ID NO: 40838 - RNA, 333 nt, synthetic construct
  misc_feature 1..333: note = derived and/or modified sequence opt5 from anti-HIV_048-172363_VR-Chain
  source 1..333: mol_type = other RNA
cagagcgtgctgacccaacccccttccgtctctgccgctccgggccagaaggttacaatcagctgctccgggtctggaagcaacattggcaatacgtacgtgtcctggtatcagcagctccccgggaccgcccctaagctgcttatcttcgaggacaacaagagaccctctggcattcctgatcggtttagcggatccaaaagcgggacatctgcgaccctggctatcacaggactccaaaccggcgacgaagccgattactattgtggcacatgggactccagcctgtctgggggaggcgtgattgggaccggaacgaaacttaccgtcctg

SEQ ID NO: 40839 - RNA, 333 nt, synthetic construct
  misc_feature 1..333: note = derived and/or modified sequence opt5 from anti-HIV_048-171609_VR-Chain
  source 1..333: mol_type = other RNA
cagagcgtgctgacccaacccccttccgtctctgccgctccgggccaggaggttacaatcagctgctccgcctctagctcctctattgggaacgacttcgtgagctggtaccagcagctccccggaacggcgcctaagctgcttatctatggcaattccaacagacccagcgggattcctgatcggttttctggatccaaaagcggcacctctgctacactggggatcaccggactccaaacaggcgacgaagccgattactattgtggcacctgggacacatccctgagcaccgggggagtgttcggcacggggaccaaggtcacagtgctt

SEQ ID NO: 40840 - RNA, 333 nt, synthetic construct
  misc_feature 1..333: note = derived and/or modified sequence opt5 from anti-HIV_048-170705_VR-Chain
  source 1..333: mol_type = other RNA
cagagcgtgctgacccaacccccttccgtctctgccgctccgggccagatggttacaatcagctgctccgggtctacgagcaacattggaatcaattacgtgtcctggtatcagcacgtgcccggcaccgcccctaagctcctgatttacgagaacgtcgaaagacggtctgggatccccgaccgcttcagcgcgtccaaaagcgctacatctgccacccttggaattacaggcctgcagaccggggatgaggccgactattactgtggaacatgggatacctccctcagcgctggcggcgtgtttgggtctggaacgaaggttaccgtgctg

SEQ ID NO: 40841 - RNA, 333 nt, synthetic construct
  misc_feature 1..333: note = derived and/or modified sequence opt5 from anti-HIV_048-168381_VR-Chain
  source 1..333: mol_type = other RNA
cagagcgccctgacccaacccgcttccgtgtctggcagccctgggcagtccatcacaatttcttgcacgggaaccagctccaacatcggctctaattacgtcagctggtatcagcagctcccggggacagcccccaagctgcttatttacgagaacaatcaaagaccttccggaatccccgaccggttcagcggctctaaatccgggaccagcgcgacactgggaattaccggcctccagacaggcgatgaagctgactattactgtgggacctgggatacgtctctgtccgccggaggcgtttttgggagcggaaccaaggtgacagtgctt

SEQ ID NO: 40842 - RNA, 333 nt, synthetic construct
  misc_feature 1..333: note = derived and/or modified sequence opt5 from anti-HIV_048-166619_VR-Chain
  source 1..333: mol_type = other RNA
cagagcgtgctgacccaacccccttccgtctctggcgccccggggcagagagttacaatcagctgcacgggatcctctagcaacattggcgggtaccacacccattggtatcagcagctccccggaacagctcctaagctgcttatctacgaaaattccaaacggccctctggcattcctgaccgcttcagcgggtccaagagcggaacctctgccacactgggcatcaccggcctccaaacaggggatgaggcggactattactgtggaacctgggatacgtccctgagcgctggcggggtgtttggatctggcaccaaagtgacagtcctt

SEQ ID NO: 40843 - RNA, 333 nt, synthetic construct
  misc_feature 1..333: note = derived and/or modified sequence opt5 from anti-HIV_048-162036_VR-Chain
  source 1..333: mol_type = other RNA
cagagcgtgctggcccaacccccttccgtctctggcgctccggggcagaccgttacaatcagctgcacgggatcctctagcaacattggcgggtacgacgtgcactggtatcagcagctccccggaaccgcccctaagctgcttatctacaaagatgacaagagaccctccggcattcctgatcggttctctgggagcaaatccggaacaagcgcgaccctgggcatcacaggcctccaaaccggggacgaggctgattattactgtggaacatgggacacctctctgaatcgcggcggggtgtttggaacgggcaccaaggtcacagtgctt

SEQ ID NO: 40844 - RNA, 333 nt, synthetic construct
  misc_feature 1..333: note = derived and/or modified sequence opt5 from anti-HIV_048-160042_VR-Chain
  source 1..333: mol_type = other RNA
cagagcgtgctgacccaacccccttccgtctctgccgctccgggccagaaggttacaatcagctgctccgggtctagctccaacattggaatcaattacatttcttggtatcagcagctccccggcacggcccctaaaatcctgatttacgacaacgataagagaccccttgggatccctgaccggttcagcggatccaaaagcggcacctctgcgacactggggatcaccggactccaaacaggcgatgaggctgactattactgtggcacctgggatgcctccctgagcgccgggggagtgtttggcacagggaccaaggtgacggtcctt

SEQ ID NO: 40845 - RNA, 333 nt, synthetic construct
  misc_feature 1..333: note = derived and/or modified sequence opt5 from anti-HIV_048-159676_VR-Chain
  source 1..333: mol_type = other RNA
cagagcgtgctgacccaacccccttccgtctctgccagcccgggccagaaggttacaatctcctgctctgggagctcctctgacattggaagcaactacgtgtcctggtatgtgcagctccccggcacggctcctaaactgcttatctacaagaataacgagagacccagcgggattcctgatcggttctctggatccaaaagcggcacctctgccacactggggatcaccggactccagacaggcgacgaagcggattattactgtggcacctgggacacatccctgagcgctgggggagtctttggcaccgggacgaaggtgaccgttctt

SEQ ID NO: 40846 - RNA, 333 nt, synthetic construct
  misc_feature 1..333: note = derived and/or modified sequence opt5 from anti-HIV_048-159500_VR-Chain
  source 1..333: mol_type = other RNA
cagagcgtgctgacccaacccccttccgtctctgccgctccgggccagaacgttacaatcagctgctccgggtcttggagcaatattggagccaactacgtgtcctggtatcagcagctccccggcacggcgcctaagctgcttatctacgagaataacaaaagaccctctgggattcctgaccggttcagcggatccaagagcggcacctctgctacactggggtttaccggactccaaacaggcgatgaagccgactattactgtggcacctgggatacatccctgagcgccgggggagtgttcggcaccgggacgaaagtcaccgtgctt

SEQ ID NO: 40847 - RNA, 333 nt, synthetic construct
  misc_feature 1..333: note = derived and/or modified sequence opt5 from anti-HIV_048-159421_VR-Chain
  source 1..333: mol_type = other RNA
cagagcctgctcacccaagccccctccgtgtctgctgcccctggccagacagtcacgatcagctgctccgggtctaacgcggacattggaaagaatttcgttagctggtaccagcagtccccgggcgctgcccccaaactgcttatctatgagaacgatagacggccttctgggattcccgaccgctttagcggatccaagagcggcacctctgccacactggggatcaccggactccaaacaggcgatgaagctgagtactattgtgccacctgggacgcttccctgagcggcgggggagtgttcggcacagggaccaaagtgacggtcctt

SEQ ID NO: 40848 - RNA, 333 nt, synthetic construct
  misc_feature 1..333: note = derived and/or modified sequence opt5 from anti-HIV_048-159333_VR-Chain
  source 1..333: mol_type = other RNA
cagagcgtgctgacccaacccccttccgcctctggcacaccggggcagagagtcacgatcagctgctccggatctaacagcaatattggctccgactctgtttactggtatcagcagctccccgggcggagccctaagctgcttatctaccgcaacaatgagagaccctccggcattcctgatcggttcagcggatctaaatccgggaccagcgctacactgggaatcaccggcctccaaacaggcgacgaagccgattattactgtgggacctgggacacatctctgtccgcgggaggcgtgtttgggaccggaacgaaggtgaccgtcctt

SEQ ID NO: 40849 - RNA, 333 nt, synthetic construct
  misc_feature 1..333: note = derived and/or modified sequence opt5 from anti-HIV_048-158932_VR-Chain
  source 1..333: mol_type = other RNA
cagagcgtgctgacccaacccgcctccgtctctggcagccctgggcagtccatcacaatttcttgcagcggatcctctagcaacatcggcgacattttcgtttcctggtaccaacaggtgccgggggctgcccccaagctcctgatctatgataatgacaaaagacctagcggcattcccgatcggttttctggatccaagagcgggacgtctgcgacccttgacatcacaggactgcagaccggcgatgaggctgactactattgtggcacatgggatacctccctcagcgccgggggagtgttcggcacagggaccaaagtcacggtgctg

SEQ ID NO: 40850 - RNA, 333 nt, synthetic construct
  misc_feature 1..333: note = derived and/or modified sequence opt5 from anti-HIV_048-155811_VR-Chain
  source 1..333: mol_type = other RNA
cagagcgccctgacccaacccgcttccgtgtctggcagccctgggcagtccatcacaatttcttgcacgggaaccagctccgacgtcggctacgattatgtttcttggtaccagctcctgccggggacaccccctaaacttctgatcttcaagaacaatgagagacccagcggcattcctgaccggttttccggaagcaagtctgggacctccgccacactcggaatcaccggcctgcagacaggcgatgaagcggactattactgtgctacctgggatacgagcctttctgccgggggagtgttcggcaccgggacaaaagtgaccgtcctg

SEQ ID NO: 40851 - RNA, 333 nt, synthetic construct
  misc_feature 1..333: note = derived and/or modified sequence opt5 from anti-HIV_048-155464_VR-Chain
  source 1..333: mol_type = other RNA
cagagcgccctgacccaacccgcttccgtgtctggcagccctgggcagtccatcacaatttcttgcacgggagccaccggcgacagcgggcacacatacgtctcctggtatcagcagctcccgggaaccgcgcccaagctgcttatctactctaacaatgagagacctagcggcgttcccgatcggttctccgggagcaaatctggaacatccgctaccctgggcattacaggcctccaaaccggggacgaagccgattattactgtggaacgtgggacaccagcctgtctgccggcggggtgtttggatccggcacaaaggtgaccgtcctt

SEQ ID NO: 40852 - RNA, 333 nt, synthetic construct
  misc_feature 1..333: note = derived and/or modified sequence opt5 from anti-HIV_048-155392_VR-Chain
  source 1..333: mol_type = other RNA
cagagcgtgctgacccaacccccttccgtctctgccgctccgggccagatggttacaatcagctgctccgggtctagctccaacattggagacaattacgtgtcttggtatcagcagctccccggcagagggcctaagctgcttgtgtacgatacgtataaacggtacctggagacccccgaccgcttcagcggatccaagagcggcacatctgccaccctcgggatcacaggactgcaaaccggcgatgaagcggactattactgtggcacatgggatacctcccttagcgctgggggagtctttggcacggggaccaaagtgacagttctg

SEQ ID NO: 40853 - RNA, 333 nt, synthetic construct
  misc_feature 1..333: note = derived and/or modified sequence opt5 from anti-HIV_048-155389_VR-Chain
  source 1..333: mol_type = other RNA
cagagcgtgctgacccaacccccttccgtctctgccgctccgggccagaaggttacaatcagctgctccgggatttctagcaacatcggaaataaccccgtgtcctggtaccagcagttccctggcacggcccccaaactcctgatttataagaatgacaaaagaccttctgggatccccgatcggtttagcggatccaagagcggcacctctgcgacacttgggattaccggactgcaaacaggcgacgaggctgattactattgtggcacctgggacacatccctcagcaccgggggagtgttcggcacggggaccaaagtcacagtgctg

SEQ ID NO: 40854 - RNA, 333 nt, synthetic construct
  misc_feature 1..333: note = derived and/or modified sequence opt5 from anti-HIV_048-154449_VR-Chain
  source 1..333: mol_type = other RNA
cagagcgtgctgaagcaacccccttccgtctctggcgccccggggctcagagttaccatcagctgcacaggaggctcctctaacattgggggattcgacgtgcactggtaccagcattttcccggcacggctcctaaactgcttatctatgataatgaccagcggcccagcgggattcctgatcgcttctccggatctaagagcggcacctccgccacactgggcatcaccgggctccagacaggagacgaggcggattactattgtggcacctgggacagctctctgtccgctgggggagtgtttggcacagggaccaaagtcacggtgctt

SEQ ID NO: 40855 - RNA, 333 nt, synthetic construct
  misc_feature 1..333: note = derived and/or modified sequence opt5 from anti-HIV_048-153379_VR-Chain
  source 1..333: mol_type = other RNA
cagagcgtgctgacccaacccccttccgtctctgccacaccgggccagaaggttacgatcagctgctccgggtctagaagcaacattggatcccactacgtgtcttggtatcagcagttccccgagagcgctcctaaactcctgatctacaagaatgacaaccggccctccggcattcctgatcgctttagcgggtctaaatccggaaccagcgccacacttggcatctctgggctgcaaaccggagacgaagcggattattactgtggcacatgggacacctccctcagcggcgggggagtgttcggcacagggaccaaggtcacggtgctg

SEQ ID NO: 40856 - RNA, 333 nt, synthetic construct
  misc_feature 1..333: note = derived and/or modified sequence opt5 from anti-HIV_048-153171_VR-Chain
  source 1..333: mol_type = other RNA
cagagcgtgctgacccaacccccttccgtctctgccgctccgggccagaaggttacaatcagctgctccgggtctacgagcaacattgaggacatctacgtgtcctggtatcagcacctccccggaaccgcccctaaactgcttatttacgataataacaagagaccctctggcatccctgaccggttcagcgggtccaaaagcggaacatctgcgaccctggctattacaggcctccagaccggggatgaagccgactattactgtggaacatgggatacctccctgagcgccggcggcgtgtttgggacgggaaccaaggtcacagtgctt

SEQ ID NO: 40857 - RNA, 333 nt, synthetic construct
  misc_feature 1..333: note = derived and/or modified sequence opt5 from anti-HIV_048-152324_VR-Chain
  source 1..333: mol_type = other RNA
cagagcatggtgacccaatccccctctgtcagcgccgctcctggccagaaggttacaatctcctgctctgggacgagctccaacattggacagaattacgtgtcttggtatcagcaactgccgggcaccgcccccaaactcctgatctacgagaacagcaagagaccttccgggattcccgaccggttcagcggatctaaatccggcacaagcgcgacccttgggatcacaggactgcagaccggcgatgaagctgactattactgtggcacatgggatacctctctctccgccgggggagtgtttggcagcgggacgaaggtcaccgtgctg

SEQ ID NO: 40858 - RNA, 333 nt, synthetic construct
  misc_feature 1..333: note = derived and/or modified sequence opt5 from anti-HIV_048-146102_VR-Chain
  source 1..333: mol_type = other RNA
cagagcgtgctgacccaacccccttccgtctctgccgctccgggccagaaggttacaatcagctgctccgggtctagctccacgattggaaacaattacatctcttggtatcagctcctgcccggcacccctcccaaacttctgatttacaagaacaatgagagacctagcgggatccccgaccggttctccggaagcaaatctggcacatccgccaccctcgggattacaggactgcagaccggcgatgaagcggactattactgtggcacatgggataccagcctttctgctgggggagtgtttggcacggggaccaaggtgacagtcctg

SEQ ID NO: 40859 - RNA, 333 nt, synthetic construct
  misc_feature 1..333: note = derived and/or modified sequence opt5 from anti-HIV_048-145984_VR-Chain
  source 1..333: mol_type = other RNA
cagagcgtgctgacccaacccctctccgtctctggcgcccctgggcagagagttacaatcagctgcacgggatcctctagcaacattggctccaatttcgtgtcttggtaccaggtgctgccggggaccacacccaaacttctgatctttaagaacaatgagcggcctagcggcattcccgaccgcttctccggaagcaagtctgggacctccgctacactcggaatcaccggcctgcagacaggcgatgaagccgactattactgtggggcgtgggataccagcctttctgctggaggcgtctttgggacgggaaccaaagtgacagttctg

SEQ ID NO: 40860 - RNA, 333 nt, synthetic construct
  misc_feature 1..333: note = derived and/or modified sequence opt5 from anti-HIV_048-145371_VR-Chain
  source 1..333: mol_type = other RNA
cagagcgtgctgacccaacccccttccgtctctgccgctagcggccagaaggtttccatcccgtgctctgggggaacaagcaacattggcgacaattacgtgtcctggttccagcagtttcccgggtctgcccctaaaatcctcatttatgatagcgacaagagaccctcccggatcagcgatcgcttctctgcgtccaaaagcggaacgtctgctaccctggacattacaagacttcaaaccggcgatgaggccgactactattgtgggacatgggatacctccctgagcgccggaggcgtgtttggcacagggaccaaggtcacggtgctc

SEQ ID NO: 40861 - RNA, 333 nt, synthetic construct
  misc_feature 1..333: note = derived and/or modified sequence opt5 from anti-HIV_048-144907_VR-Chain
  source 1..333: mol_type = other RNA
cagagcgccctgacccaacccgcttccgtgtctggcagccctgggcagtccatcacaatttcttgcacgggaaccagacgggacgtcggcttcaactacgttagctggtatcagcagcacccggggacagcccccaagctcctgatctacgagaataacaaacgcccttccggcattcccgatagattttctggaagcaagtccgggaccagcgcgacacttggaatcaccggcctgcaaacaggcgacgaagctgattattactgtgggacctgggactcttccctcagcgccggaggcgtgttcgggacgggaaccaaagtgacagtcctg

SEQ ID NO: 40862 - RNA, 333 nt, synthetic construct
  misc_feature 1..333: note = derived and/or modified sequence opt5 from anti-HIV_048-142298_VR-Chain
  source 1..333: mol_type = other RNA
cagagcgtgctgacccaacccccttccgcctctggcacaccggggcagagagtcacgatcagctgctccggatctagctccaccattggcaacaattacatctcttggtatcagctcctgcccgggacacctcccaaacttctgattttcaagaacaatgagcggcctagcggaatccccgaccgcttttccgctagcaagtctggcacctccgccacactcgggattaccggactgcagacaggcgatgaagcggactactattgtggcacctgggatacgagcctttctgctgggggagttttcggcaccgggacaaaagtgaccgtgctg

SEQ ID NO: 40863 - RNA, 333 nt, synthetic construct
  misc_feature 1..333: note = derived and/or modified sequence opt5 from anti-HIV_048-142277_VR-Chain
  source 1..333: mol_type = other RNA
cagagcgtgctgacccaacccccttccgtctctggcgccccggggcagagaatcacaattagctgcacgggatcctctagcaacatcggcgcttacgacgttcagtggtatcagcacctccccgggaccgcccctaagctgcttatttacaaaaatacagagcggccctccggaatccctgatcgcttctctggcagcaagtccgggaccagcgcgacactggacattaccggactccaaacaggcgatgaagctgactattactgtggcacctgggatacgtctctgtccgccgggggagtgtttggcaccgggacaaaagtgaccgtcctt

SEQ ID NO: 40864 - RNA, 333 nt, synthetic construct
  misc_feature 1..333: note = derived and/or modified sequence opt5 from anti-HIV_048-141934_VR-Chain
  source 1..333: mol_type = other RNA
cagagcgtgctgacccaacccccttccgtctctggcgccccggggcagagagttacaatcagctgcacgggaaactcctctaatattggcgcttacgacgtgcactggtatcagcagctccccgggaccgcccctaagctgatgatctacgaggtgagcaaacggccctccggcattcctgatcgcttctctggaagcaagtccgggacaagcgcgacccttggaatcacaggcctgcaaaccggcgacgaagctgattattactgtgggacatgggacacctctctctccgccggaggcgtctttgggagcggaacgaaagtgaccgttctg

SEQ ID NO: 40865 - RNA, 333 nt, synthetic construct
  misc_feature 1..333: note = derived and/or modified sequence opt5 from anti-HIV_048-141207_VR-Chain
  source 1..333: mol_type = other RNA
cagagcgtgctgacccaacccccttccgtctctgccgctccgggccagaaggttacaatcgcctgcagcgggtcctctagcaacattggaaataactacgtgtcctggtatcagcagctccccggcacggcgcctaaactgcttatctacgctaataacagacggccctctgggattcctgaccgcttcagcgcctccaagagcggaacctctgccacactgggcatcaccgggctccaaacaggagatgaggctgactattactgtggcacctgggatacatccctgagcgccggcggggtgtttggaaccggcacgaaagtcaccgtgctt

SEQ ID NO: 40866 - RNA, 333 nt, synthetic construct
  misc_feature 1..333: note = derived and/or modified sequence opt5 from anti-HIV_048-140796_VR-Chain
  source 1..333: mol_type = other RNA
cagagcgtgctgacccaacccccttccgtctctgccacaccgggccagaaggttacgatcagctgctccgggaccagatctaacattggaaataactacgtgagctggtatcggcagttccccggcacagctcctaaactcctgatctacgaggacaataagcgcccctccgggattcctgccagattttctggaagcaaatccggcaccagcgcgacacttgggatcaccggactgcagacaggcgatgaagctgactattactgtggcacctgggatacgtctctctccgccgggggagtgttcggcaccgggacaaaggtcaccgtgctg

SEQ ID NO: 40867 - RNA, 333 nt, synthetic construct
  misc_feature 1..333: note = derived and/or modified sequence opt5 from anti-HIV_048-139893_VR-Chain
  source 1..333: mol_type = other RNA
cagagcgtgctgacccaacccccttccgtctctgccacaccgggccagaaggttacgttcagctgctccgggtctagctccaccatcggcaaaaactacgtgtcttggtatcaggtgctccccggaacagctcctaagctgcttatttacaaaaataacaagagacccagcgggatccctgaccggttttccggaagcaaatctggcacctccgccacactggggattaccggactccagacaggcgatgaggcggactattactgtggcacctgggatagctctctgtccgctgggggagtcttcggcacggggaccaaggtgacagttctt

SEQ ID NO: 40868 - RNA, 333 nt, synthetic construct
  misc_feature 1..333: note = derived and/or modified sequence opt5 from anti-HIV_048-138820_VR-Chain
  source 1..333: mol_type = other RNA
cagagcgtgctgacccaacccccttccgtctctggcgccccggggcagaaggttacaatcagctgctccggatctggcagcaacattgggaatacgtacgtgtcctggtatcagcacctccccggaaccgctcctaaactgcttatctacgagaacaataagagaccctctggcattcctgaccggttcagcgggtccaaaagcgccacatctgcgaccctgggaatcacaggcctccagaccggcgatgaagctgactattactgtgggacatgggatacctccctgagcgccggaggcgtgtttgggacgggaaccaaggtcacagtgctt

SEQ ID NO: 40869 - RNA, 333 nt, synthetic construct
  misc_feature 1..333: note = derived and/or modified sequence opt5 from anti-HIV_048-135858_VR-Chain
  source 1..333: mol_type = other RNA
cagagcgtgctgacccaacccccttccgcctctggcacaccggggcagagagtcacgatcagctgctccggatctagctccaacattggctctagctacgtttattggtaccagcagttccccgggcggtcccctcgcctcctgatctatagaaataacgagcggcccagcggcattcctgaccgcttttctggatccaagagcgggacctctgctacacttggaatcaccggcctgcaaacaggcgatgaagccgactactattgtgggacctgggatacatccctcagcgcgggaggcgtgttcgggaccggaacgaaagtgaccgtcctg

SEQ ID NO: 40870 - RNA, 333 nt, synthetic construct
  misc_feature 1..333: note = derived and/or modified sequence opt5 from anti-HIV_048-134968_VR-Chain
  source 1..333: mol_type = other RNA
cagagcgtgctgacccaacccccttccgtctctgccgctccgggccagaaggttacaatcttctgcagcgggtcctctagcaacattggcaaaaattacgtgtcctggtatcagcagctccccggaacggcccctaagctgcttatctacgagaactctaaaagacccagcgggattcctgaccggttttccggaagcaagtctggcacctccgcgacactggggatcaccggactccaaacaggcgatgaagctgactattactgtggcacctgggatacaagcctgtctgccgggggagtgttcggctccgggaccaaagtcacggtgctt

SEQ ID NO: 40871 - RNA, 333 nt, synthetic construct
  misc_feature 1..333: note = derived and/or modified sequence opt5 from anti-HIV_048-134312_VR-Chain
  source 1..333: mol_type = other RNA
cagagcgtgctgacccaacccccttccgcctctggcacaccggggcagagagtcacgatcagctgctccggatctagctccaacattggcaataactacgtttcttggtatcggctcctgcccgggaccgctcctaaacttctgatctacaagaatgacaaccgccccagcggcattcctgatagattctccggaagcaagtctgggacatccgccaccctcggaatcagcggcctgcagacaggcgacgaggcggattattactgtgggacctgggacacatctctttccggaggcggggtgtttggaaccggcacgaaagtgaccgtcctg

SEQ ID NO: 40872 - RNA, 330 nt, synthetic construct
  misc_feature 1..330: note = derived and/or modified sequence opt5 from anti-HIV_048-132253_VR-Chain
  source 1..330: mol_type = other RNA
agcgccctgacccagcccgcttccgtgtctggcagccctgggcaatccatcgccatttcttgcacaggaacgagctccgacgtcggctacgatctcgtttcttggtatcagcagcacccggggaccgcgcccaagctgcttatctacgacaacaataaaagacctagcggcattcccgatcggttctccggaagcaagtctgggacatccgctaccctgggaatcacaggcctccagaccggcgacgaggccgattattactgtgggacatgggacaccagcctgtctgccggaggcgtgtttgggtccggaacgaaagtgaccgtcctt

SEQ ID NO: 40873 - RNA, 333 nt, synthetic construct
  misc_feature 1..333: note = derived and/or modified sequence opt5 from anti-HIV_048-130710_VR-Chain
  source 1..333: mol_type = other RNA
cagagcgtgctgacccaacccccttccgtcgccggcgctccggggcagagagttacaatctcttgcacgggaaacaccagcaatattggcgggtacgacgtgcactggtatcagcagctccccggaacacctcccaagctgcttatcttcaaaaacaatgagcggccttccggcattcccgatcgcttttctgggagcaagtccggaacctctgccacactgggcatcaccggcctccaaacaggggacgaagcggattactattgtggaacctgggacacgagcctgtccgctggcggggtgttcggaaccggcacaaaagtcaccgtgctt

SEQ ID NO: 40874 - RNA, 333 nt, synthetic construct
  misc_feature 1..333: note = derived and/or modified sequence opt5 from anti-HIV_048-128564_VR-Chain
  source 1..333: mol_type = other RNA
cagagcgtgctgacccaacccccttccgcctctggcacaccggggcagagagtcacgatcagctgctccggatctagctccaacattggctctaataccgttaactggtaccagcagctccccgggacagctcctaagctgcttatctataaaaataccgagcggcccagcggcattcctgaccgcttctccggaagcaagtctgggacatccgccaccctggatatcacaggactccaaaccggcgacgaagcggattactattgtggcacgtgggacaccagcctgtctgctgggggagtgtttggcacagggaccaaagtgacagtcctt

SEQ ID NO: 40875 - RNA, 333 nt, synthetic construct
  misc_feature 1..333: note = derived and/or modified sequence opt5 from anti-HIV_048-126702_VR-Chain
  source 1..333: mol_type = other RNA
cagagcgtgctgacccaacccccttccgcctctgctgccccgggccagagagtcacaatcagctgctccgggtctaacagcaatattggaaacaattacgtttcctggtatcagcagctccccggcacggcgcctaagctgcttatctacgacaactctaaacggcccagcgggattcctgatcgcttctccgctagcaagtctggaacctccgccacactgggcatcaccgggctccaaacaggagacgaggccgattattactgtggcacctgggacacaagcctgtctgctggcggggtgtttggaaccggcacgaaagtgaccgtcctt

SEQ ID NO: 40876 - RNA, 333 nt, synthetic construct
  misc_feature 1..333: note = derived and/or modified sequence opt5 from anti-HIV_048-124521_VR-Chain
  source 1..333: mol_type = other RNA
cagagcgtgctgacccaacccccttccgtctctggcgccccggggcagagagttacaatcagctgcacgggatcctctagcaccttcggcgggtacgacgtgtattggtaccagcagattcccggaacagctcctaagctcctgatctatgagaacaataaacggccctccggcattcctgatcgcttttctgggagcaagtccggaaccagcgccacacttgcgatcaccggcctgcaaacaggcgacgaagctgattactattgtgggacctgggacggatctctctccacgggcggggtgattggaaccggcacaaaagtcaccgtgctg

SEQ ID NO: 40877 - RNA, 333 nt, synthetic construct
  misc_feature 1..333: note = derived and/or modified sequence opt5 from anti-HIV_048-122740_VR-Chain
  source 1..333: mol_type = other RNA
cagagcgtgctgacccaacccccttccatgtctgccgctccgggccagagcgtcacaatctcctgctctgggagcacgttcaatattgagaagcaccaggttacctggctcagacatctgcccggaacagcccctacctccgtgatcattatgaactctcagcggcccagcggcacacctgaccgcttttccgggagcaaatctggaacctccgcgacacttgctatcaccggcctgcaaacgggggatgaagccgactactattgtggaacctgggatggcagcctctctacaggcggggtgattggaaccggcacaaaggtcaccgtgctg

SEQ ID NO: 40878 - RNA, 327 nt, synthetic construct
  misc_feature 1..327: note = derived and/or modified sequence opt5 from anti-HIV_048-119536_VR-Chain
  source 1..327: mol_type = other RNA
gagctgacccagagcccctccgtgtctgccgctcctggcgaaaaggtcacaatcagctgctccgggacgaactctaatattggatactattacgttagctggtatcaacagttcccgggcaccgcccccaaagtggtgatctacgagaacacaaagagaccttccgggattcccgaccggttttctggaagcaaatccggcaccagcgcgacactcgggatcaccggactgcagacaggcgatgaagctgactattactgtggcacctgggatacgtctctttccgccgggggagtcttcggcagcgggaccaaggtgacagttctg

SEQ ID NO: 40879 - RNA, 333 nt, synthetic construct
  misc_feature 1..333: note = derived and/or modified sequence opt5 from anti-HIV_048-116929_VR-Chain
  source 1..333: mol_type = other RNA
cagagcgtgctgacccaacccccttccgtctctggcgccccggggcagagagttacaatcagctgcacgggatcctctagcaacattggcgactacgatgtgcactggtatcagcagctccccgggaccgctcctaagctgcttatctaccggaataaccaacgcccctccggagtgcctgacagattctctggcagcaaatccgggacaagcgccaccctgggaattacaggcctccagaccggcgatgaggcggactattactgtgggacatgggatgcttctctgtccgccggaggcgtctttgggaccggaacgaaggtgaccgttctt

SEQ ID NO: 40880 - RNA, 333 nt, synthetic construct
  misc_feature 1..333: note = derived and/or modified sequence opt5 from anti-HIV_048-116577_VR-Chain
  source 1..333: mol_type = other RNA
cagagcgtgctgacccaacccccttccgcctctggcacaccggggcagagagtcacgatcagctgctccggatctagctccaacattggctctaattacgttagctggtatcaggtgctccccgggaccgctcctaagctgcttatctacaaaaacaataagcggccctccggcattcctgaccgcttcagcggatctaaatccgggacaagcgccaccctgggaatcacaggcctccagaccggcgatgaggcggactattactgtgctacatgggatacctctctgtccgccgggggagtgtttggcacggggaccaaggtcacagtgctt

SEQ ID NO: 40881 - RNA, 333 nt, synthetic construct
  misc_feature 1..333: note = derived and/or modified sequence opt5 from anti-HIV_048-116046_VR-Chain
  source 1..333: mol_type = other RNA
cagagcgtgctgacccaacccccttccgtctctggcgccccggggcagagagttacaatcagctgcacgggatcctctagcaacattggcgggtacgacgtgcactggtatcagcagttccccggaaccgctcctaagctcctgatctacgataatgacaaacggccctccggcattcctgatcgcttttctgggagcaagtccggaacaagcgccacccttggcatcacaggcctgcaaaccggggacgaggcgaactattactgtggagcttgggatacatctctctccgccggcggggtgttcggaaccggcacgaaagtcaccgtgctg

SEQ ID NO: 40882 - RNA, 333 nt, synthetic construct
  misc_feature 1..333: note = derived and/or modified sequence opt5 from anti-HIV_048-115875_VR-Chain
  source 1..333: mol_type = other RNA
cagagcgtgctgacccaacccccttccgtctctgccgctccgggccagagagttacagtgagctgctccgggtctagctccaacatcggaaataacttcgtgtcttggtaccagcacctccccggcacggcccctaagctgcttatttatgacaatagcaaccggccctccgggatccctgatcgctttagcggatctaaatccggcaccagcgcgacactggggattaccggactccatacaggcgacgaggctgattactattgtggcacctgggacacatctctgtccgccgggggagtcttcggcagcgggaccaaggtgacggttctt

SEQ ID NO: 40883 - RNA, 333 nt, synthetic construct
  misc_feature 1..333: note = derived and/or modified sequence opt5 from anti-HIV_048-115599_VR-Chain
  source 1..333: mol_type = other RNA
cagagcgtgctgacccaacccccttccgtctctgccgctccgggccagatggttacaatcagctgctccgggtctagctccaacattggatctcacagcgtgtcctggtaccagcatttccccggcacggcccctaagctcgtgatcgaggaaaatgaccagagacccagcgggattcctgatcggttttctggatccaaaagcggcacctctgcgacactggggatcaccggacttcaaacaggcgacgagggcgattattactgtgggacctgggacacatccctgagcggaggcggggtcttcggaaccggcacgaaggtgaccgttctc

SEQ ID NO: 40884 - RNA, 333 nt, synthetic construct
  misc_feature 1..333: note = derived and/or modified sequence opt5 from anti-HIV_048-113988_VR-Chain
  source 1..333: mol_type = other RNA
cagagcgtgctgacccaacccccttccgtctctgccgctccgggccagatggttacaatcagctgctccgggtctagccacaacattggagagaattacgtgtcctggtatcagcatctccccggcacggcccctaagctgcttatcttcaaaaacaatgaaagaccctctgggattcctgaccggtttagcggatccaagagcggcacctctgcgacactggggatcaccggactccagacaggcgatgaggctgactactattgtggcacctgggatacatccctgagcgccgggggagtgttcggcaccgggacgaaagtcaccgtgctt

SEQ ID NO: 40885 - RNA, 333 nt, synthetic construct
  misc_feature 1..333: note = derived and/or modified sequence opt5 from anti-HIV_048-112989_VR-Chain
  source 1..333: mol_type = other RNA
cagagcgtgctgacccaacccccttccgcctctggcacaccggggcagagagtcacgctcagctgctccggaggctctagcaacatcgggaatgacaacgtttactggtatcagcagcggcccggaaccacacctaagctgcttatttacaatgataaccgcagaccctccggcacccctgaccggttctctgggagcaaatccggaacaagcgctaccctggccatcacaggcctccaaaccggcgatgaggcggactattactgtgggacgtgggatggatctctgtccaccggcggggtgattggaacaggcaccaaggtgacagtcctt

SEQ ID NO: 40886 - RNA, 333 nt, synthetic construct
  misc_feature 1..333: note = derived and/or modified sequence opt5 from anti-HIV_048-112435_VR-Chain
  source 1..333: mol_type = other RNA
cagagcgtgctgacccaacccccttccgtctctgccgctccgggccagaaggttagcatctcctgctctgggagctcctctaacattggcaaaaattacgtgagctggtatcagcagctccccggaacagcccctaagctgcttatcttcaaaaacaatgagagaccctccgggattcctgaccggtttagcggatctaagtccggcacgagcgcgaccctggggatcacaggactccaaaccggcgatgaagctgactactattgtgccacatgggatacctctctgtccgccggcggggtgttcggaacaggcaccaaagtcacggtgctt

SEQ ID NO: 40887 - RNA, 333 nt, synthetic construct
  misc_feature 1..333: note = derived and/or modified sequence opt5 from anti-HIV_048-111339_VR-Chain
  source 1..333: mol_type = other RNA
cagagcgtgctgacccaacccccttccgtctctgccgctccgggccagaaggttacaatcagctgcacggggtcctctagcaacattggaggctacgccgtgcactggtatcaacaggtgcccgcgaccgctcctaaactcctgatctacgagaataacgaaagaccctccgggattcctgaccggttctctggaagcaagtccggcacaagcgccacccttgggatcacaggactgcagaccggcgatgaggccgactattactgtggcacatgggatacctctctctccgctgggggagtctttggcacggggaccaaagtgacagttctg

SEQ ID NO: 40888 - RNA, 333 nt, synthetic construct
  misc_feature 1..333: note = derived and/or modified sequence opt5 from anti-HIV_048-111055_VR-Chain
  source 1..333: mol_type = other RNA
cagagcgccctgacccaacccgcttccgtgtctggcagccctgggcagtccatcacaatttcttgcacgggaaccagaagcgacgtcggctacaactatgtttcctggtaccagcagcacccggggaaggcccccaaactcctgatctatgagaatacaaagcggccttctggcattcccgatcgcttcagcggatccaaaagcgggacctctgcgacacttggaatcaccggcctgcaaacaggcgacgaagctgattactattgtgggacctgggacacgtccctcagcgccggaggcgtgtttgggtctggaaccaaggtgacagtcctg

SEQ ID NO: 40889 - RNA, 333 nt, synthetic construct
  misc_feature 1..333: note = derived and/or modified sequence opt5 from anti-HIV_048-111027_VR-Chain
  source 1..333: mol_type = other RNA
cagagcgtgctgacccaacccccttccgtctctgccgctccgggccagaaggttacaatcagctgctccgggtctaacagcaatctcggaaacaattacgtgtcctggtatcagcaccttcccggcacggcccctagactgctgatttacgaggacaaaaagcggccctctgggatccctgatcgcttcagcggatccaaaagcggcgcgtctgctaccctcgacattacagggctgcagaccggagatgaagccgactattactgtggcatctgggatacatcccttagcgccggcggggtgtttggaaccggcacaaaggtcaccgtgctg

SEQ ID NO: 40890 - RNA, 333 nt, synthetic construct
  misc_feature 1..333: note = derived and/or modified sequence opt5 from anti-HIV_048-109721_VR-Chain
  source 1..333: mol_type = other RNA
cagagcgtgctgacccaacccccttccgtctctgccgctccgggccagaaggttacaatcagctgctccgggtctagctccgacattggatctaacttcgtgagctggtaccagcacctccccggcacggcccctagactgcttatctatgagaataaccggcgcccctccgggattcctgatagatttagcggatctaaatccggcaccagcgcgacactggctatcaccgggctccagacaggagacgaagccgattactattgtggcacctgggacacatctctgaatcggggcggggtgttcggaaccggcacgaaggtcaccgtgctt

SEQ ID NO: 40891 - RNA, 333 nt, synthetic construct
  misc_feature 1..333: note = derived and/or modified sequence opt5 from anti-HIV_048-109666_VR-Chain
  source 1..333: mol_type = other RNA
cagagcgtgctgacccaacccccttccatgtctgccgctccgggcgagagagtcacaatcagctgctccgggtctagctccaacattggaaatcaccatgtttcttggtaccagcagcggcccggcacggcccctaagctcctgatctatgaaaacaatgagcgccccagcgggattcctgacagattctccggaagcaaatctggctccagcgcgacccttgctatcacagggctgcagaccggagatgaagccgactactattgtggcacatgggatggccggctcaacattgggggagtgatcggcaccgggacaaaggtgaccgtcctg

SEQ ID NO: 40892 - RNA, 333 nt, synthetic construct
  misc_feature 1..333: note = derived and/or modified sequence opt5 from anti-HIV_048-109196_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaccaataagagacccagcgggattcctgaccggttctccggaagcaaatctggcacatccgcgaccctggctatcacagggctccaaaccggagatgaagccgactattactgtggcacatgggataccagcctgtctggcgggggagtgtttggcacggggaccaaggtcacagtgctt

SEQ ID NO: 40893 - RNA, 333 nt, synthetic construct
  misc_feature 1..333: note = derived and/or modified sequence opt5 from anti-HIV_048-109051_VR-Chain
  source 1..333: mol_type = other RNA
cagagcgtgctgacccaacccccttccgtctctgccgctccgggccagaaggttacaatcagctgctccgggaacaattctaacatggtgaataactacattagctggtatcagctcctgcccggaacgcctcccaaacttctgatcttcaagaataacgagagaccttccggcattcccgaccggttttctgggagcaaatccggaaccagcgccacactcggcatcaccgggctgcagacaggagatgaagcggactactattgtggcacctgggatacatctctttccgctggcggggtgttcggaaccggcacgaaggtcaccgtgctg

SEQ ID NO: 40894 - RNA, 333 nt, synthetic construct
  misc_feature 1..333: note = derived and/or modified sequence opt5 from anti-HIV_048-108570_VR-Chain
  source 1..333: mol_type = other RNA
cagagcgccctgacccaacccccttccgtgtctgctgccccgggccagaaggtcacaatcagctgctccgggaaatctagcaacattggaacgaatttcgtttcctggtaccagcagtttcccgaggcggctcctaagctcctgatctatgacaacaataaaagaccctctggcattcctgatcggttcagcgggtccaagagcggaacctctgccacacttggcatcaccgggctgcaaacaggagacgaagccgattactattgtggcacctgggacggctccctcagcacagggggagtgattggcaccgggacgaaagtgaccgtcctg

SEQ ID NO: 40895 - RNA, 327 nt, synthetic construct
  misc_feature 1..327: note = derived and/or modified sequence opt5 from anti-HIV_048-108033_VR-Chain
  source 1..327: mol_type = other RNA
gagctgacccagagcccctccgtgtctgccgctcctggccaaagagtcacaatcagctgctccgggaactctagcaatattggaaacaattacgtttcctggtatcagctcctgccgggcacggcccccaaacttctgatctacaagaacgacaagcggccttctgggattcccgatcgcttcagcggatccaaaagcggcacctctgcgacactcgggatcaccggactgcagacaggcgacgaagctgattattactgtggcacctgggacacatcccttagcaccgggggagtgtttggcacggggaccaaggtgacagtcctg

SEQ ID NO: 40896 - RNA, 333 nt, synthetic construct
  misc_feature 1..333: note = derived and/or modified sequence opt5 from anti-HIV_048-107279_VR-Chain
  source 1..333: mol_type = other RNA
cagagcgtgctgacccaacccccttccgtctctgccgctccgggccagaaggttatcattagctgctccgggtctagctccaacatcggcaaaaattacgtgtcttggtatcagcacctccccggaacagcccctaagctgcttatttacgagaacaataaaagacccagcgggatccctgaccggttctccggaagcaagtctggcacgtccgcgaccctggggattacaggactccagaccggcgatgaagctgactattactgtggcacatgggatgccagcctgtctgccgggggagtgcttggcaccgggacaaaagtcaccgtgctg

SEQ ID NO: 40897 - RNA, 333 nt, synthetic construct
  misc_feature 1..333: note = derived and/or modified sequence opt5 from anti-HIV_048-106271_VR-Chain
  source 1..333: mol_type = other RNA
cagagcgtgctgacccaacccccttccgtctctgccgctccgggccagaaggttacaatcagctgctccgggtctagaagcaacattggatccaattacatctcttggtatcagcagctccccggcacggcccctaaactgcttatttacaagaacgacaaacggcccagcgggatccctgatcgcttctccggaagcaagtctggcacctccgcgattctggggatcacaggactccaaaccggcgacgaggctgattattactgtggcgcctgggacacaagcctgtctgccgggggagtgtttggcaccgggacaaaagtgaccgtcctt

SEQ ID NO: 40898 - RNA, 333 nt, synthetic construct
  misc_feature 1..333: note = derived and/or modified sequence opt5 from anti-HIV_048-106054_VR-Chain
  source 1..333: mol_type = other RNA
cagagcgtgctgacccaacccccttccgtctctgccgctccgggccagcaggttacaatcagctgctccgggtctacgagcaacattggaaataactacgtgtcctggtatcagcaagtgcccggcaccgcccctaagctcctgatctacgacaataacaatagaccctctgggattcctgatcggttcagcggatccaaaagcggcacatctgcgacccttgggatctccggactgcagacaggcgacgaggctgattattactgtggcacctgggacacaagcctctctgggggaggcgtctttgggaccggaacgaaggtgaccgttctg

SEQ ID NO: 40899 - RNA, 333 nt, synthetic construct
  misc_feature 1..333: note = derived and/or modified sequence opt5 from anti-HIV_048-104848_VR-Chain
  source 1..333: mol_type = other RNA
cagagcgccctgacccaacccgcttccgtgtctggcagccctgggcagtccatcacaatttcttgcacgggaaccagctccgacgtcggctacaactatgtttcttggtaccagcagctcccggggacagcccccaagctgcttatcttcgataatgacgatagacctagcgagattcccgaccggttttccggaagcaaatctggcacctccgcgacactggggatcaccggactccaacctggcgatgaagctgactattactgtggcacatgggatagctctctgtccgccgggggagtgttcggcaccgggacgaaggtgaccgtcctt

SEQ ID NO: 40900 - RNA, 333 nt, synthetic construct
  misc_feature 1..333: note = derived and/or modified sequence opt5 from anti-HIV_048-104638_VR-Chain
  source 1..333: mol_type = other RNA
cagagcgtgctgacccagcccccttccgcctctggcacaccggggcacagagtcacgatcagctgctccggaaactctagcaatattggcgggaaccatgtttactggtatcaacaggtgcccggaaccacacctaagctcctgatctaccggaataacgagcgcccctccggcattcctgacagattctctgggagcaaatccggaaccagcgctacacttggcatcaccggcctgcagacaggggatgaagccgactattactgtggaacctgggatacgtctctctccgcgggcggggtgtttggaaccggcacaaaggtcaccgtgctg

SEQ ID NO: 40901 - RNA, 333 nt, synthetic construct
  misc_feature 1..333: note = derived and/or modified sequence opt5 from anti-HIV_048-104567_VR-Chain
  source 1..333: mol_type = other RNA
cagagcgtgctgacccaacccccttccgcctctggcacaccggggcagagagtcacgatcagctgctccggatctaacagcaatattggcaccaacttcgttaattggtaccagcacgtgcccgggcgggctcctaagctcctgatctataaaaacacagagcgcccctccggcattcctgacagattttctggaagcaagtccgggaccagcgccacacttgatatcaccggactgcagacaggcgacgaagcggattactattgtggcacctgggacacgtctctctccgctgggggagtgttcggcaccgggacaaaagtcaccgtgctg

SEQ ID NO: 40902 - RNA, 333 nt, synthetic construct
  misc_feature 1..333: note = derived and/or modified sequence opt5 from anti-HIV_048-102804_VR-Chain
  source 1..333: mol_type = other RNA
cagagcgtgctgacccaacccccttccgtctctacagccccgggccagaaggttacgatcagctgctccgggtctagctccaacattggatactcttatgtgagctggttccagcacctccccggcaccgctcctaaactgcttatctacggaaattccaacagacccagcggggtgcctgaccggttttctggctccaagagcgggacatctgcctccctggcgattaccggactccagacaggcgatgaggctgactattactgtggcacctgggatagctctctgtccgccgggggagtcttcggcacagggaccaaagtgacggttctt

SEQ ID NO: 40903 - RNA, 333 nt, synthetic construct
  misc_feature 1..333: note = derived and/or modified sequence opt5 from anti-HIV_048-101676_VR-Chain
  source 1..333: mol_type = other RNA
cagagcgtgctgacccaacccccttccgtctctggcgccccggggcagagcgttacaatctcctgcacgggaacctctagcaacattggcgacttcgatgtgcactggtaccagcagctccccgggacagctcctaagctgcttctgtatgagaataacaaaagaccctccggaatccctgaccggttttctggcagcaagtccgggaccagcgccacactcgcgattaccggactgcaaacaggcgatgaagctgactactattgtggcacctgggatgggtctctttccacgggaggcgtgatcgggaccggaacaaaagtcaccgtgctg

SEQ ID NO: 40904 - RNA, 333 nt, synthetic construct
  misc_feature 1..333: note = derived and/or modified sequence opt5 from anti-HIV_048-097603_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgacaccgtgaagagacccagcgggattcctgatcggttctccggaagcaaatctggcacatccgcgaccctggggatcacaggactccaaaccggcgacgaggctgattattactgtggcacatgggacagctctctgtccgggggaggcgtctttgggaccggaacgaaggtgaccgttctt

SEQ ID NO: 40905 - RNA, 333 nt, synthetic construct
  misc_feature 1..333: note = derived and/or modified sequence opt5 from anti-HIV_048-097107_VR-Chain
  source 1..333: mol_type = other RNA
cagagcgtgctgacccaacccccttccgtctctgccgctccgggccagaaggttacaatcagctgctccgggtctagctccaacattgagaataactacgtgtcttggtatagacaggtgcccggaacggcccctaaactcctgatctacaagaatgacaaccggcccagcggcattcctgatcgcttctccgggagcaaatctggaacctccgcgacacttggcatcaccgggctgcagacaggagacgaagctgattattactgtggcatttgggacaccagcctctctgccggcggggtctttggaacaggcaccaaggtgacggttctg

SEQ ID NO: 40906 - RNA, 333 nt, synthetic construct
  misc_feature 1..333: note = derived and/or modified sequence opt5 from anti-HIV_048-096871_VR-Chain
  source 1..333: mol_type = other RNA
cagcccgtgctgacccaacctccgagcgcctccggcacacccgggcagagagtcacgatctcttgcagcggatcctctagcaacattggctccaattacgtttattggtaccagcagctccctgggaccacacccaagctgcttatctatcggaacaatcaacgcccttctggcattcccgacagattcagcggatccaaaagcgggacctctgctacactgggaatcaccggcctccagacaggcgatgaggccgactactattgtgggacctgggatacgtccctgagcaccggaggcgtgtttgggacaggaaccaaggtgacagtcctt

SEQ ID NO: 40907 - RNA, 333 nt, synthetic construct
  misc_feature 1..333: note = derived and/or modified sequence opt5 from anti-HIV_048-096668_VR-Chain
  source 1..333: mol_type = other RNA
cagagcgtgctgacccaacccccttccgtctctgccgctccgggccagaaggttacaatcagctgctccgggtctggaagcaacattggcaataactacgtgtcctggtatcagcagctccccgggacggcccctaaactgcttatctacaagaataccgagagaccctctggcattcctgaccggttcagcggatccaaaagcgggacatctgcgaccctggatatcacaggactccaaaccggcgacgaagctgattattactgtggcacatgggacacctccctgagcgccgggggagtgtttggcacggggaccaaggtcacagtgctt

SEQ ID NO: 40908 - RNA, 333 nt, synthetic construct
  misc_feature 1..333: note = derived and/or modified sequence opt5 from anti-HIV_048-095236_VR-Chain
  source 1..333: mol_type = other RNA
cagagcgtgctgacccaacccccttccgtctctgccccgcccggccagaaggttacaatcagctgctccgggacgacctctaacattggaagcaattacgtggcttggtatcagcagctccctggcacagcccccaaactggtgatctacgagaactccaagagaccttctgggattcccgaccggttcagcggatccaaaagcggcacctctgcgacacttgggatcaccggactgcaaacaggcgatgaagctgactattactgtggcacctgggatacgtccctcagcgccgggggagtctttggctctgggaccaaggtgacagttctg

SEQ ID NO: 40909 - RNA, 333 nt, synthetic construct
  misc_feature 1..333: note = derived and/or modified sequence opt5 from anti-HIV_048-094155_VR-Chain
  source 1..333: mol_type = other RNA
cagagcgtgctgacccaacccccttccgtctctgccgctccgggccagaaggttacagtgagctgctccgggtctagctccgacatcggagagaactacgtgtcttggtatcagcagttccccgaaacggcccctaaactcctgatttacgataataacaagagacccagcggcatccctgaccggttttccgggagcaaatctggaacctccgcgacacttgctattaccggcctgcaaacaggggatgaggccgactattactgtggaacctgggatagctctctctccgccggcggcgtcttcgggacaggaaccaaggtgacggttctg

SEQ ID NO: 40910 - RNA, 333 nt, synthetic construct
  misc_feature 1..333: note = derived and/or modified sequence opt5 from anti-HIV_048-093219_VR-Chain
  source 1..333: mol_type = other RNA
cagcccctgctcacccaacctccggccgtgagcgctacacccggccagagagtcacgatctcctgcaccgggtctagctccaacattggacggacattcgttaattggtaccagcagctgcctggcaccgcccccaaacttctgatctatgagaactctaagcgccctagcgggattcccgacagattttccggatctaagagcggcacatccgcgaccctcgggatcacaggactgcaaaccggcgatgaagctgactactattgtggcacgtgggataccagcctttctgccgggggagtgttcggctccgggacaaaagtgaccgtcctg

SEQ ID NO: 40911 - RNA, 333 nt, synthetic construct
  misc_feature 1..333: note = derived and/or modified sequence opt5 from anti-HIV_048-092976_VR-Chain
  source 1..333: mol_type = other RNA
cagagcgtgctgacccaacccccttccgtctctgccgctagcggccagaaggttacaatctcctgctctgggagctcctctaacattggaaataactacgtgagctggtatcagcacctcccgggcacggcccccaaactgcttatctacaagaatgacaaaagaccttccgggattcccgatcggttcagcggatctaagtccggcaccagcgcgacactggggatcaccggactccagacaggcgacgaggctgattattactgtggcacctgggacacatctctgtccgccgggggagtgtttggcaccgggacgaaagtcaccgtgctt

SEQ ID NO: 40912 - RNA, 333 nt, synthetic construct
  misc_feature 1..333: note = derived and/or modified sequence opt5 from anti-HIV_048-090866_VR-Chain
  source 1..333: mol_type = other RNA
cagagcgtgctgacccaacccccttccgtctctgccgctccgggccagaaggttacaatcagctgctccgggtctagaagcaacattggatccaattacatctcttggtatcagcagctccccggcacggcccctaaactgcttatttacgacaacaataagcggcccagcgggatccctgatcgcttctccggaagcaaatctggcacctccgcgacactggggattaccggactccaaacaggcgacgaggcttattactattgtggcacctgggatacaagcctgtctgccgggggagtgtttggctccgggaccaaggtgacggtcctt

SEQ ID NO: 40913 - RNA, 333 nt, synthetic construct
  misc_feature 1..333: note = derived and/or modified sequence opt5 from anti-HIV_048-090650_VR-Chain
  source 1..333: mol_type = other RNA
cagagcgccctgacccaacccgcttccgtgtctggcagcctcgggcagtccatcacaatttcttgcagcggatcctctagcacgatcggcaacaattacgtctcctggtatcaggttctgcctggggccgcgccgaaacttctgatttgtaagaacaatgagagacccagcggaatccctgaccggttctctggctccaagagcgggacctctgctacactcggaattaccggcctgcagacaggcgatgaagccgactactattgcgggacctgggatacatcccttagcgccggaggcgtgtttgggaccggaacgaaagtgaccgtcctg

SEQ ID NO: 40914 - RNA, 333 nt, synthetic construct
  misc_feature 1..333: note = derived and/or modified sequence opt5 from anti-HIV_048-089009_VR-Chain
  source 1..333: mol_type = other RNA
cagagcgtgctgacccaacccccttccgtctctgccgctccgggccagaaggttacaatcagctgctccgggggatctagcaacattggcaataactacgtgtcctggtatcagcagctccccgagacggcccctaaactgatcatttacgacaataacaagagaccctctgggatccacgatcggttcagcggatccaaaagcggcacctctgcgacacttgacattaccgctctgcaaacaggggatgaagccgactattactgtggaacctgggatacatccctcagcgccggcggcgtgtttgggaccggaacgaaggtcaccgtgctg

SEQ ID NO: 40915 - RNA, 333 nt, synthetic construct
  misc_feature 1..333: note = derived and/or modified sequence opt5 from anti-HIV_048-088654_VR-Chain
  source 1..333: mol_type = other RNA
cagagcgccctgacccaacccagatccgtgtctgctgcccctggccagaaggtcagcatctcctgctctgggcggagcacaaacctcggatacaattatgtttcctggtaccagcaccttccgggcgcggctcccaaagtgctgatttatgagaacaataagcgcccttctgggatccccgacagattcagcggatccaaaagcggcacgtctgccaccctggggattacaggactccagaccggcgatgaagccgactactattgtggcacatgggatacctccctgagcgctgggggagtgtttggctctgggacaaaggtcaccgtgctt

SEQ ID NO: 40916 - RNA, 333 nt, synthetic construct
  misc_feature 1..333: note = derived and/or modified sequence opt5 from anti-HIV_048-086513_VR-Chain
  source 1..333: mol_type = other RNA
cagagcgccctgacccaacccccttccgtgtctgctgccccgggccagaaggtcacaatcagctgctccgggtctacgagcaacattggaaataactacgtttcctggtatcagcagctccccggcaccgcgcctaaactgcttatctacaagaatgacaacagaccctctgggattcctgatcggttcagctccagcaaatctggaacatccgctaccctgggcatcacagggctccaaaccggagacgaggccgattattactgtggcatttgggacacaagcctgtctgccggcggggtgtttggaaccggcacgaaggtgaccgtcctt

SEQ ID NO: 40917 - RNA, 324 nt, synthetic construct
  misc_feature 1..324: note = derived and/or modified sequence opt5 from anti-HIV_048-086024_VR-Chain
  source 1..324: mol_type = other RNA
ctggcccagccccctagcgtgtccggcaccccggggcaaagagtcacaatctcttgcagcggatcctctagcaacattggctccaatgctgttaactggtaccagcagttccccgggacggcccctaagctcctgatctatgacaccgataaacggccctctggcattcctgaccgctttagcggatccaagagcgggacatctgcgatccttggaattaccggcctgcagacaggcgatgaggctgactactattgtggggcctgggatacctccctcagcgccggaggcgtgttcgggacaggaaccaaagtgacggtcctg

SEQ ID NO: 40918 - RNA, 333 nt, synthetic construct
  misc_feature 1..333: note = derived and/or modified sequence opt5 from anti-HIV_048-085857_VR-Chain
  source 1..333: mol_type = other RNA
cagagcgccctgacccaacccagatccgtgtctggcagcctcgggcagtccgtcacaatctcttgcacgggaaccacaagcgacgttggcttcgattacgtgtcctggtatcaggtgctgcctgggaccgctccgaaacttctgatttacaagaacgacaagcggccctctggaatccctgatcgctttagcggctccaaaagcgggacatctgccaccctcggaattacaggcctgcagaccggcgacgaggcggattattactgtgggacgtgggacacctcccttagcacaggaggcgtcttcgggaccggaacaaaggtgaccgttctg

SEQ ID NO: 40919 - RNA, 333 nt, synthetic construct
  misc_feature 1..333: note = derived and/or modified sequence opt5 from anti-HIV_048-084277_VR-Chain
  source 1..333: mol_type = other RNA
cagagcgtgctgagacaacccccttccctctctggcgccccggggcagcgggtcaccctgagctgcacaggatcctctagcaacatcggcgggtacgacgttcactggtatcagcatgtgcccggaacggctcctaaacttctgatttacgagaataccaagcgcccctccggcatccctgatagattctctgggagcaagtccggaacaagcgccaccctcggcattacaggcctgcagaccggggacgaagcggattattactgtggaacatgggacacctctctttccgctggcggggtgtttggaagcggcacgaaagtcaccgtgctg

SEQ ID NO: 40920 - RNA, 333 nt, synthetic construct
  misc_feature 1..333: note = derived and/or modified sequence opt5 from anti-HIV_048-084245_VR-Chain
  source 1..333: mol_type = other RNA
cagagcaccctgacacaacccccttccgtgtctgccgctccgggccagaaggtcacgatcagctgctccgggtctaacagcaatattggaaaacactacgtttcctggtatcagcagttccccggcgccgtgcctaagctcctgatctacgagaacaaaaagagaccctctgggattcctgaccggtttagcggatccaaaagcgatacctctgcgacacttgacatcaccggcctgcaaacaggggatgaagctgactattactgtggaacctgggatacatccctcagcgccggcggcgtgttcgggtctggaaccaaggtcacggtgctg

SEQ ID NO: 40921 - RNA, 333 nt, synthetic construct
  misc_feature 1..333: note = derived and/or modified sequence opt5 from anti-HIV_048-082487_VR-Chain
  source 1..333: mol_type = other RNA
cagagcctgctcacccaacccccttccgtgtctgccgctccgggccagaaggtcacaatcagctgctccgggtctagctccacgattggaaacaattacgtttcttggtatcaggtgctgcccggcgccgcgcctaaacttctgatctgtaagaacaatgagagacccagcgggattcctgaccggttctccggaagcaaatctggcacctccgctacactcgggatcaccggactgcagacaggcgatgaagccgactactattgcggcacctgggatacaagcctttctgccgggggagtgtttggctccgggaccaaggtcacggtgctg

SEQ ID NO: 40922 - RNA, 333 nt, synthetic construct
  misc_feature 1..333: note = derived and/or modified sequence opt5 from anti-HIV_048-081787_VR-Chain
  source 1..333: mol_type = other RNA
cagagcgtgctgacccaacccccttccgtctctggcgccccggggcagagagttacaatcagctgcacgggatcctctagcaacattggctcctacgacgtgcactggtatcagcagctccccgggaccgctcctaagctgcttatctacgaaaattctaaacggcccagcggcattcctgatcgcttctccggaagcaagtctgggacatccgccaccctgggaatcacaggcctccaaaccggcgacgaggcggattattactgtgggacatgggacaccagcctgtctggaggcggggtgtttggaacgggcaccaaagtcacagtgctt

SEQ ID NO: 40923 - RNA, 333 nt, synthetic construct
  misc_feature 1..333: note = derived and/or modified sequence opt5 from anti-HIV_048-081062_VR-Chain
  source 1..333: mol_type = other RNA
cagagcgtgctgacccaacccccttccgtctctgccgctccgggccagaaggttacaatcagctgctccgggacgtctagcaacattggagccaattacgtgtcctggtatcaacaggtgcccggcaccgcgcctaaactcctgatctacgagaacaataagagaccctctgggacacctgaccggttcagcggatccaaaagcggcacctctgctacacttgggattaccggactgcagacaggcgatgaagccgactattactgtggcacctgggatacgtccctcagcgccgggggagtctttggctctgggaccaaggtgacagttctg

SEQ ID NO: 40924 - RNA, 333 nt, synthetic construct
  misc_feature 1..333: note = derived and/or modified sequence opt5 from anti-HIV_048-079639_VR-Chain
  source 1..333: mol_type = other RNA
cagagcgtgctgacccaacccccttccgtctctgccgctccgggccagaaggttacaatcagctgctccgggtctagctccaacattggcaaaaattacgtgtcttggtatcagcacctccccggaacggcccctaagctgcttatctacgagaacaataaaagacccagcgggattcctgaccggttctccggaagcaagtctggcaccgcggctacactggggatcaccggactccagacaggcgatgaagccggctattactgtgggacctgggacacatccctgagcgccggaggcgtgtttgggaccggaacgaaagtcaccgtgctt

SEQ ID NO: 40925 - RNA, 333 nt, synthetic construct
  misc_feature 1..333: note = derived and/or modified sequence opt5 from anti-HIV_048-079126_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcacctccccggcacgcctcccaaactgcttatcttcaagaataacgagagacctagcgggattcccgaccggttttccggaagcaaatctggcacctccgccacactggggatcaccggactccagacaggcgatgaagcggactactattgtggcacctgggatacaagcctgtctgctgggggagtgttcggcaccgggacgaaggtcaccgtgctt

SEQ ID NO: 40926 - RNA, 333 nt, synthetic construct
  misc_feature 1..333: note = derived and/or modified sequence opt5 from anti-HIV_048-073118_VR-Chain
  source 1..333: mol_type = other RNA
cagagcgtgctgacccaacccccttccgtctctgccgctccgagacacaacgttacaatcagctgctccggcgggtctagcaatattggaaacaatttcgtgtcctggtaccagtatctccccggcacggcccctaagctgcttatctacgacaacaataaacggccctctgggattcctgatcgctttagcggatccaagagcggcacctctgcgacactggggatcaccggactccagacaggcgacgaggctgattattactgtgccacctgggacacatccctgagcgccggcggggtgttcggaaccggcacgaaagtcaccgtgctt

SEQ ID NO: 40927 - RNA, 333 nt, synthetic construct
  misc_feature 1..333: note = derived and/or modified sequence opt5 from anti-HIV_048-070264_VR-Chain
  source 1..333: mol_type = other RNA
cagagcgtgctgacccaatccccctctgtcagcgccgctcctggccagaaggttacaatctcctgctctgggacgagctccaacattggaaatacctacgtgtcttggtatcagcagctcccgggcacagcccccaaactgcttatctacaagaacgacaaaagacctagcgggattcccgatcggttctccggaagcaagtctggcacctccgcgacactggggatcaccggactccaaacaggcgacgaggctgattattactgtggcacctgggacagctctctgtccgccgggggagtgtttggcacggggaccaaagtcacagtgctt

SEQ ID NO: 40928 - RNA, 333 nt, synthetic construct
  misc_feature 1..333: note = derived and/or modified sequence opt5 from anti-HIV_048-069426_VR-Chain
  source 1..333: mol_type = other RNA
cagagcgtgctgacccaacccccttccgtctctgccgctccgggccagaaggttacaatcagctgctccgggtctagctccacgattggaaacaattacgtgtcttggtatcagcagctccccggcaccgcccctaaactgcttatctacaagaacaataaaagacccagcggggtgcctgaccggttctccggaagcaagtctggcacatccgcgacccccgggattacaggactgcaaaccggcgatgaggctgactattactgtggcacatgggataccagcctctctgccgggggagtctttggcacggggaccaaagtgacagttctg

SEQ ID NO: 40929 - RNA, 333 nt, synthetic construct
  misc_feature 1..333: note = derived and/or modified sequence opt5 from anti-HIV_048-068564_VR-Chain
  source 1..333: mol_type = other RNA
cagagcgccctgacccaacccagatccgtgtctggcagccctgggcagtccgtcgctatctcttgcacaggaacgagctccgacgttggctacaactatgtgtcttggtaccaggtgctcccggggaccgcccccaagctgcttatttataaaaataacgagcggcctagcggaatccccgatcgcttctccggcagcaagtctgggacatccgcgaccctgggaattacaggcctccagaccggcgacgaagctgattactattgtgggacatgggacaccagcctgtctgccggaggcgtctttgggacgggaaccaaagtgacagttctt

SEQ ID NO: 40930 - RNA, 333 nt, synthetic construct
  misc_feature 1..333: note = derived and/or modified sequence opt5 from anti-HIV_048-068345_VR-Chain
  source 1..333: mol_type = other RNA
cagagcgtgctgacccaaacaccctccgtctctgccgctcctggccagagagttacgatcagctgctccgggtctaccagcaacattggaaataactacgtgtcctggtatcagcagctcccgggcacagcccccaagctgcttatctacgagaataacaaacggccttctgggattcgcgacagattcagcgcgtccaagagcggaacctctgctacactgggcatcaccgggctccaaacaggagatgaagccgactattactgtggcacctgggatacgtccctgagcgccggcggggtgtttggaaccggcacaaaagtcaccgtgctt

SEQ ID NO: 40931 - RNA, 333 nt, synthetic construct
  misc_feature 1..333: note = derived and/or modified sequence opt5 from anti-HIV_048-067337_VR-Chain
  source 1..333: mol_type = other RNA
cagagcgtgctgacccaacccccttccgtctctgccgctccgggccagaaggttacaatcagctgctccggggcctcttacaacattggcaaaaatagcgtgtcctggtatcagcagctccccggaacggcgcctaagctgcttatctacaaaaacgacaagagaccctctgggattcctgatcggttcagcggatccaaaagcggcgcttctgccaccctggacatcacagggctccaaaccggagatgaggccgactattactgtggcatttgggatacatccctgagcgctggcggggtgtttggaaccggcacaaaggtcaccgtgctt

SEQ ID NO: 40932 - RNA, 333 nt, synthetic construct
  misc_feature 1..333: note = derived and/or modified sequence opt5 from anti-HIV_048-067180_VR-Chain
  source 1..333: mol_type = other RNA
cagagcgtgctgacccaacccccttccgtctctgccgctccgggccagaaggttacaatcagctgctccgggtctagccccaacattggaaataactacgtgtcctggtatcagagactccctggcacggcccccaaactgcttatctacgagaatgaccagcggccttctgggattcccgatcgcatcagcggatccaagagcggcacctctgcgacactggggattaccggactccaaacaggcgacgaagctgattattactgtggcacctgggacacatccctgagcaccgggggagtgttcggcacggggaccaaagtcacagtgctt

SEQ ID NO: 40933 - RNA, 333 nt, synthetic construct
  misc_feature 1..333: note = derived and/or modified sequence opt5 from anti-HIV_048-063017_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcaccatcccggcaaagcccctaagctcatgatctacgaggtgagcaaaagaccctccgggattcctgaccggttcagcggatctaagtccggcacgagcgcgaccctggggatcacaggacttcagaccggcgatgaagctgactattactgtggcacatgggatacctctctgaatcgcgggggagtctttggcacagggaccaaagtgacggttctc

SEQ ID NO: 40934 - RNA, 333 nt, synthetic construct
  misc_feature 1..333: note = derived and/or modified sequence opt5 from anti-HIV_048-061885_VR-Chain
  source 1..333: mol_type = other RNA
cagagcgtgctgacccaacccccttccgtctctgccgctccgggccagaaggttacaatcagctgctccgggtctagctccaacattggatctcactacatcagctggtatcagcagttccccggcgccgcgcctaaactcctgatttacgagaatgacaagagaccctccgggatccctgatcggtttagcgcttctaaatccggaacgagcgccacccttggcattacagggctgcaaaccggagacgaagccgattattactgtggcacatgggacacctctctctccgctggcggggtgttcggaacaggcaccaaggtgacggtcctg

SEQ ID NO: 40935 - RNA, 333 nt, synthetic construct
  misc_feature 1..333: note = derived and/or modified sequence opt5 from anti-HIV_048-061671_VR-Chain
  source 1..333: mol_type = other RNA
cagagcgtgctgacccaacccccttccgcctctggcacaccggggcagagagtcacgatcagctgctccggatctcggagcaacattggctccaattacgtttattggtaccagcagttccccgggaccgctcctaagctcctgatctatgagaacaataaacgcccctctggcattcctgacagatttagcggatccaagagcgggacatctgccacccttggaatcacaggcctgcaaaccggcgatgaagcggactactattgtgctacatgggatacctccctcagcgccgggggagtgttcggcacggggaccaaagtgacagtcctg

SEQ ID NO: 40936 - RNA, 333 nt, synthetic construct
  misc_feature 1..333: note = derived and/or modified sequence opt5 from anti-HIV_048-060700_VR-Chain
  source 1..333: mol_type = other RNA
cagagcgtgctgacccaactcccctccctgtctgccgctcctggccagaaggtcacaatcagctgctccgggtctagctccaacattggaaataactacgtttcttggtatcagcagcttccgggcacggcccccaaactgctcatctacgagaataacaagagacctagcgggattcccgaccggttctccggaagcaaatctggcacctccgcgacactggggatcaccggacttcaaacaggcgatgaagctgagtattactgtgccacctgggacgccagcctgtctggcgggggagtgtttggcacagggaccaaggtgacggtcctc

SEQ ID NO: 40937 - RNA, 333 nt, synthetic construct
  misc_feature 1..333: note = derived and/or modified sequence opt5 from anti-HIV_048-060592_VR-Chain
  source 1..333: mol_type = other RNA
cagagcgtgctgacccaacccccttccgtctctgccgctccgggccagaaggttacaatcagctgctccgggtctagctccaacattggcaaaaattacgtgtcttggtatcagcagttccccggaacggcccctaagctcctgatctacgagaacaataaaagacccagcgggattcctgaccggttttccgcgagcaagtctgctacctccgccacacttgtgatcaccggactgcaaacaggcgatgaagccgtctattactgtgggacctgggacacaagcctctctgctggaggcgtgttcggctccgggaccaaagttacggtgctg

SEQ ID NO: 40938 - RNA, 333 nt, synthetic construct
  misc_feature 1..333: note = derived and/or modified sequence opt5 from anti-HIV_048-060300_VR-Chain
  source 1..333: mol_type = other RNA
cagcccgtgctgacccaacctccgagcgcctccggcacacccgggcagagagtcacgatctcttgcagcggatcctctagcaacattggcaccaatacagttaactggtaccagcagttccctgggaccgctcccaagctcctgatctataaaaataacgagcggccttccggcattcccgaccgcttttctggaagcaagtccgggacaagcgccacccttggaatcacaggcctgcaaaccggcgatgaagcggactactattgtgggacgtgggatacctctctctccggaggcggggtgttcggaacaggcaccaaagtgacagtcctg

SEQ ID NO: 40939 - RNA, 333 nt, synthetic construct
  misc_feature 1..333: note = derived and/or modified sequence opt5 from anti-HIV_048-059141_VR-Chain
  source 1..333: mol_type = other RNA
cagcccgtgctgacccaacctccgagcgcctccggcacacccgggcagagagtctctatcagctgctccggaaacttctctaatattggcagcaagtacgtttattggtaccagcagatccctgggacggctcccaacgtgattatctatcggaccaatctccgcccttccggcattcccgacagattttctgccagcaaatccggaacaagcgcgaccctggggatcacaggacttcaaaccggcgatgaggctgactactattgtggcacatgggatacctctctgtccgccgggggagtgttcggcacggggaccaaggtcacagtgctc

SEQ ID NO: 40940 - RNA, 333 nt, synthetic construct
  misc_feature 1..333: note = derived and/or modified sequence opt5 from anti-HIV_048-057777_VR-Chain
  source 1..333: mol_type = other RNA
cagagcgtgctgacccaacccccttccctctctgccgctccgggccagagagtcacaatcagctgctccgggtctagctccaacattggaaataactacgtttcttggtatcagcagttccccggcacggcccctaccctgcttatctacgagaatgacaagcggcccagcgggattcctgatcgcttttccgcgagcaaatctggaacatccgctaccctgggcatcacagggctccaagccggagacgaagccgattattactgtggcacctgggacacaagcctgtctgctggcggggtgttcggaaccggcacgaaggtgaccgtcctt

SEQ ID NO: 40941 - RNA, 333 nt, synthetic construct
  misc_feature 1..333: note = derived and/or modified sequence opt5 from anti-HIV_048-056928_VR-Chain
  source 1..333: mol_type = other RNA
cagagcgtgctgacccaacccccttccgtctctgccgctccgggccagaaggttacaatcagctgctccgggtctagctccacgattggaaacaattacgtgtcttggtatcagctcctgcccggcaccgcccctaaacttctgatctacgacaacgataatagacccagcgacattcctgatcggttctccgggagcaagtctggaacatccgcgaccctcggcatcacagggctgcagaccggagacgaggctgattattactgtggcgcctgggacacaagcctttctgccggcggggtgtttggaaccggcacgaaagtcaccgtgctg

SEQ ID NO: 40942 - RNA, 333 nt, synthetic construct
  misc_feature 1..333: note = derived and/or modified sequence opt5 from anti-HIV_048-056131_VR-Chain
  source 1..333: mol_type = other RNA
cagttcgtgctgacccaacccgccagcgtctccggctctcctgggcagagcatcacaatttcctgctctggaacgagctccgacgttggctacaactatgtgtcttggtaccagcagctcccggggaccgctcccaagctgcttatctatgagaatacaaaaagacctagcggcattcccgatcggttttccggaagcaagtctgggacctccgccacactgggaatcaccggcctccaaacaggcgacgaagcggattactattgtgggacctgggacacgagcctgtctgctggaggcgtgttcgggtccggaaccaaagtcacagtgctt

SEQ ID NO: 40943 - RNA, 333 nt, synthetic construct
  misc_feature 1..333: note = derived and/or modified sequence opt5 from anti-HIV_048-055864_VR-Chain
  source 1..333: mol_type = other RNA
cagagcgtgctgacccaacccccttccgtctctgttgccccgggccagaaggtgacaatctactgcagcgggtcctctagcaacattggcaaaaattccgtgtcttggtatgtccaggtgcccggaacggctcctaagttcctcatctacgagaacaatcagagacccagcgggatttccgaccggtttagcggatctaaatccggcaccagcgccacactggggatctctggacttcaaaccggcgatgaagcggactattactgtggcacatgggatacctccctgagcgggggaggcgttttcgggacaggaaccaaggtgacggtcctc

SEQ ID NO: 40944 - RNA, 333 nt, synthetic construct
  misc_feature 1..333: note = derived and/or modified sequence opt5 from anti-HIV_048-055094_VR-Chain
  source 1..333: mol_type = other RNA
cagagcgtgctgacccaacccccttccgtctctggcgccccggggcagagagttacaatcagctgctccgcttctagctcctctattggaaacgacttcgtgagctggtaccagcagctccccggcacggcccctaagctgcttatctccgagaataacaaacggcccagcgggattcctgatcgcttttctggatccaagagcggcacctctgcgacactggggatcaccggactccaaacaggcgacgaagctgattattactgtggcacctgggactccagcctgtctgccgggggagtgttcggcacagggaccaaagtcacggtgctt

SEQ ID NO: 40945 - RNA, 333 nt, synthetic construct
  misc_feature 1..333: note = derived and/or modified sequence opt5 from anti-HIV_048-054343_VR-Chain
  source 1..333: mol_type = other RNA
cagagcgtgctgacccaacccccttccgtctctggcgccccggggcagagagttacaatcagctgcacgggatcctctagcaacattggcgggtacgacgtgaattggtatcagcagctccccggaaccgctcctaagctgcttatcttcaaaaacaatgagcggccctccggcattcctgatcgcttttctgggagcaagtccggaacaagcgccaccctgggcatcacaggcctccaaaccggggacgaagcggattactattgtggaacatgggacacctctctgtccgctggcggggtgttcggaacgggcaccaaagtcacagtgctt

SEQ ID NO: 40946 - RNA, 333 nt, synthetic construct
  misc_feature 1..333: note = derived and/or modified sequence opt5 from anti-HIV_048-054193_VR-Chain
  source 1..333: mol_type = other RNA
cagagcgtgctgacccaacccccttccgtctctgccgctccgggccagaaggttacaatcagctgctccgggggatctagcaacattggcaataactacgtgtcctggtatcaccaggtgcccgggacggcccctaaactcctgatcttcgagaataacaagagaccctctggcattcctgaccggtttagcggatccaaaagcgggacctctgcgacacttggaatcaccggcctgcagacaggcgatgaagctgactactattgtgggacctgggatacatccctcagcggaggcggggtcttcggaaccggcacgaaggtgaccgttctg

SEQ ID NO: 40947 - RNA, 333 nt, synthetic construct
  misc_feature 1..333: note = derived and/or modified sequence opt5 from anti-HIV_048-052521_VR-Chain
  source 1..333: mol_type = other RNA
cagagcgtgctgacccaacccccttccgtctctgccgctccgggccagaaggttacaatcagctgctccgggtctagctccaacattggaagacactctgtgagctggtaccagcagctccccggcacggcccctaaactgcttatctatgacaccgataagcggccctccgggattcctgaccgcttcagcggatctaaatccggcacaagcgcgaccctggggatcacaggactccaaaccggcgatgaggctgactactattgtggcacatgggatacctctctgtccgggggaggcgtgtttgggacgggaaccaaggtcacagtgctt

SEQ ID NO: 40948 - RNA, 333 nt, synthetic construct
  misc_feature 1..333: note = derived and/or modified sequence opt5 from anti-HIV_048-049037_VR-Chain
  source 1..333: mol_type = other RNA
cagagcgtgctgacccaacccccttccgtctctgccgctccgggccagaaggttacaatcagctgctccgggtctagcttcaacattggaaataactacgtgtcctggtatcagcacctccccggcacggcccctaaactgcttatctacgcggctgtgaccagaccctctgggattcctgaccggtttagcggatccaagagcggcacatctgccaccctggatatcacagggctccagaccggagacgaggccgattattactgtggcacatgggacacctccctgagcgctggcggggtcttcggaacgggcaccaaagtgacagttctt

SEQ ID NO: 40949 - RNA, 333 nt, synthetic construct
  misc_feature 1..333: note = derived and/or modified sequence opt5 from anti-HIV_048-048720_VR-Chain
  source 1..333: mol_type = other RNA
cagagcgtgctgacccaaccccctgccgtctccgctgccccgggccagagagttgcgatctcttgcagcgggacatcctctaacattggaagcaatctcgtgtcctggtaccagcagctgcccggcaaggctcctcggcttctgatctatgacaactacaaacgcccctctgggattcctgatagattcagcggatccaagagcggcacgtctgccaccctcgggatcacaggactgcaaaccggcgacgaggccgattattactgtggcacatgggacacctcccttagcacagggggagtgtttggcaccgggacgaaagtcaccgtgctg

SEQ ID NO: 40950 - RNA, 333 nt, synthetic construct
  misc_feature 1..333: note = derived and/or modified sequence opt5 from anti-HIV_048-048542_VR-Chain
  source 1..333: mol_type = other RNA
cagagcgtgctgacccaacccccttccgtctctgccgctccgggccagaaggttacaatcagctgctccgggtctagctccaacattggaaataacttcgtgtcttggtaccagcagctccccggcacggcccctaaactgcttatctataataacgacagacggcccagcggggtgcctgatcgcttttccgcgagcaagttcggaaccgctgccacactgggcattaccgggctccaaacaggagacgaggccgattactattgtggcacctgggactcttccctgagcgctggcggggtctttggaacaggcaccaaagtgacggttctt

SEQ ID NO: 40951 - RNA, 333 nt, synthetic construct
  misc_feature 1..333: note = derived and/or modified sequence opt5 from anti-HIV_048-047777_VR-Chain
  source 1..333: mol_type = other RNA
cagagcgtgctgacccaacccccttccgcctctggcacaccggggcagagagtcacgatcagctgctccggatctagcgctaacattggcaccaattacgttttctggtatcagcacctccccgggacagcccctaagctgcttatctacgagaacaataaacggccctccggcattcctgaccgcttttctggaagcaagtccgggaccagcgcgacactgggaatcaccggcctccagacaggcgatgaagctgactattactgtgggacctgggattcttccctgagcgccggaggcgtgttcgggacgggaaccaaagtgacagtcctt

SEQ ID NO: 40952 - RNA, 333 nt, synthetic construct
  misc_feature 1..333: note = derived and/or modified sequence opt5 from anti-HIV_048-046841_VR-Chain
  source 1..333: mol_type = other RNA
cagagcgtgctgacccaacccccttccgtctctgccgctctcggccagaaggttacaatcacgtgcagcggggacaacggaaatattggctaccactatgtgtcctggtaccaacaggtggggagagccgcgccgaaactgcttatctatgctaacaataagcggccctctggcattcctgatcgcttcagcggatccaaatctgggaccagcgccacactgggaatcaccggcctccagacaggcgacgaggccgattactattgtgggacctgggacacatccctgagcgctggaggcgtctttgggtctggaaccaaggtgacggttctt

SEQ ID NO: 40953 - RNA, 333 nt, synthetic construct
  misc_feature 1..333: note = derived and/or modified sequence opt5 from anti-HIV_048-046202_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcacctccccggcacggcccctaaactgcttatctacgacacctataagagacatagcggggtgcccgatcggttctccaatagcaaatctggaacatccgcgaccctggctattacaggcctccagaccggggacgagggagattactattgtggcgcctgggacacaagcctgtctgccggcggggtctttggaaccggcacgaaggtgaccgttctt

SEQ ID NO: 40954 - RNA, 333 nt, synthetic construct
  misc_feature 1..333: note = derived and/or modified sequence opt5 from anti-HIV_048-046059_VR-Chain
  source 1..333: mol_type = other RNA
cagagcgtgctgacccaacccccttccgtctctgccgctccgggccagaacgttacaatcagctgctccgggacgtctagcaatattgagaacaattacgtgtcctggtatcagaccctccccggaacagcccctaagctgcttatctacgacaacaataaaagaccctctggcattcctgatcggttcagcgggtccaagagcggaacctctgcgacactgggcatcaccgggctccagacaggagacgaagctgattattactgtggcacctgggactccagcctgtctgccggcggggtgtttggaacgggcaccaaagtcacagtgctt

SEQ ID NO: 40955 - RNA, 333 nt, synthetic construct
  misc_feature 1..333: note = derived and/or modified sequence opt5 from anti-HIV_048-043568_VR-Chain
  source 1..333: mol_type = other RNA
cagagcgtgctgacccaacccccttccgtctctgccgctccgggccagaaggttacaatcagctgctccgggtctgacagcaacattggatccaattacgtgtcttggtatcagcagctccccggcgccgcgcctaaactgcttatctacaagaacaataacagacccagcgggattcctgatcggttctccggaagcaaatctggcacgtccgctaccctggggatcagcggactccaaacaggcgacgaggccgattattactgtggcacctgggacacatctctgtccgggggaggcgtgtttgggaccggaacaaaggtcaccgtgctt

SEQ ID NO: 40956 - RNA, 333 nt, synthetic construct
  misc_feature 1..333: note = derived and/or modified sequence opt5 from anti-HIV_048-042713_VR-Chain
  source 1..333: mol_type = other RNA
cagagcgtgctgacccaacccccttccgtctctgccgctccgggccagaaggttacaatcagctgctccgggtctagctccaacattggaagacactacgtgtcttggtatcagcagctccccggcacggcccctaaactgcttatctacgacaataacagccggccctccgggattcctgatcgcttcagcggatctaagtccggcaccagcgcgacactggggatcaccggactccaaacaggcgacgaggctgattattactgtggcacctgggacacatctctgaatagagggggagtgtttggcaccgggacgaaagtcaccgtgctt

SEQ ID NO: 40957 - RNA, 333 nt, synthetic construct
  misc_feature 1..333: note = derived and/or modified sequence opt5 from anti-HIV_048-042440_VR-Chain
  source 1..333: mol_type = other RNA
cagagcgtgctgacccaacccccttccgcctctggcacaccggggcagagagtcacgatcagctgctccggatctagctccaacattggcaccaatacagttaactggtaccagcagctccccgggaccgctcctaagctgcttatctatgaaaattctaaacggcccagcggcattcctgaccgcttctccggaagcaagtctgggacatccgccaccctgggaatcacaggcctccaaaccggcgatgaggcggactactattgtgggacgtgggataccagcctgtctgctggaggcgtgtttgggtccggaacaaaagtgaccgtcctt

SEQ ID NO: 40958 - RNA, 333 nt, synthetic construct
  misc_feature 1..333: note = derived and/or modified sequence opt5 from anti-HIV_048-040511_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcacctccccggcacggcccctaaactgcttatctacgagaataacaagagaagctccgggattcccgaacggttcagcggatctcagtccggcaccagcgcgacactggggatcaccggactccaaacaggcgacgaggctgattattactgtggcacctgggacacatctctgtccaccgggggagtgtttggcacggggaccaaagtcacagtgctt

SEQ ID NO: 40959 - RNA, 333 nt, synthetic construct
  misc_feature 1..333: note = derived and/or modified sequence opt5 from anti-HIV_048-039195_VR-Chain
  source 1..333: mol_type = other RNA
cagagcgtgctgacccaacccccttccgtctctgccgctccgggccagagagttacaatcagctgctccgggtctacgagcaacattggaaatcactacgtgtcctggtatcagcagctccccggcaccgcccctaagctgcttatctacgacaacgggaatcggccctctggcattcctgatcgcttcagcggatccaaaagcgggacatctgcgaccctggacatcacaggactccaaaccggcgatgaggctgactattactgtggcacatgggatacctccctgaacagagggggagtgtttggcacggggaccaaggtcacagtgctt

SEQ ID NO: 40960 - RNA, 333 nt, synthetic construct
  misc_feature 1..333: note = derived and/or modified sequence opt5 from anti-HIV_048-036935_VR-Chain
  source 1..333: mol_type = other RNA
cagagcgtgctgacccaacccccttccatgtctgccgctccgggcgagagagtcacaatcagctgcacggggtcctctagcaacattggaggctacgacgttcactggtatcagcagctccccgggatcgcccctaagattctgatctaccgcaattccattcggccctctggaatccctgatagattcagcggctccaaaagcgggacctctgcgacacttggaatcaccggcctgcagacaggcgacgaagctgattattactgtgggacctgggacacatccctcagcaccggaggcgtgtttgggacgggaaccaaggtgacagtcctg

SEQ ID NO: 40961 - RNA, 333 nt, synthetic construct
  misc_feature 1..333: note = derived and/or modified sequence opt5 from anti-HIV_048-034478_VR-Chain
  source 1..333: mol_type = other RNA
cagagcgtgctgacccaacccccttccgtctctgccgctccgggccagaaggttacaatcagctgcacggggtccggatctaacattggcaataacgacgtgagctggtaccagcagctccccgggaccgcccctagactgcttatctatggagataataaacggccctccggcattcctgaccgcttctctgggagcaagtccggaacaagcgcgaccctgggcatcacaggcctccaaaccggggatgaggctgactactattgtggaacatgggatacctctctgtccgccggcggggtgtttggaacgggcaccaaagtcacagtgctt

SEQ ID NO: 40962 - RNA, 333 nt, synthetic construct
  misc_feature 1..333: note = derived and/or modified sequence opt5 from anti-HIV_048-031641_VR-Chain
  source 1..333: mol_type = other RNA
cagagcgtgctgacccaacccccttccgtctctgccgctccgggccagaaggttacaatcagctgctccgggaacaattctaacattggaaataactacgtgagctggtatcagcagctccccggcacggcccctaaactgcttatctacgaaaattccaagagaccctctgggattcctgaccggttcagcggatccaaaagcggcacctctgcgacactggggatcaccggactccaaacaggcgatgaggctgactattactgtggcacctgggatacatccctgagcgccgggggagtgtttggctctgggaccaaggtcacggtgctt

SEQ ID NO: 40963 - RNA, 333 nt, synthetic construct
  misc_feature 1..333: note = derived and/or modified sequence opt5 from anti-HIV_048-029760_VR-Chain
  source 1..333: mol_type = other RNA
cagagcgccctgacccaacccgcttccgtgtctggcagctccgggcagtctatcacaattagctgcacgggaaccaactccgacgtcggctacgattatgtttgttggtaccagcagctccctgggacagccccgaagctgcttatctatgagaataacaaaagaccctctggcattcctgaccggttcagcggatccaagagcgggacctctgcgacactgggaatcaccggcctccaaacaggcgatgaagctgactactattgcgggacctgggatacgtccctgagcgccggaggcgtgtttgggaccggaacaaaagtgaccgtcctt

SEQ ID NO: 40964 - RNA, 333 nt, synthetic construct
  misc_feature 1..333: note = derived and/or modified sequence opt5 from anti-HIV_048-027970_VR-Chain
  source 1..333: mol_type = other RNA
cagagcgtgctgacccaacccccttccgtctctgccccgcccggccagaaggttacaatcagctgctccgggacgacctctaacattggaagcaattacgtggcttggtatcagcagttccctggcacagcccccaaactcctgatctacgagaacaataagagaccttccgggattcccgaccggttttctggaagcaaatccggcaccagcgcgacacttgggatcaccggactgcaaacaggcgatgaagctgactattactgtgccacctgggatacgtctctctccgccggcggggtgttcggaaccggcacaaaggtcaccgtgctg

SEQ ID NO: 40965 - RNA, 333 nt, synthetic construct
  misc_feature 1..333: note = derived and/or modified sequence opt5 from anti-HIV_048-027337_VR-Chain
  source 1..333: mol_type = other RNA
cagagcgtgctgacccaacccccttccgtctctgccgctccgggccagaaggttacaatcagctgctccgggtcttacagcaacattggaaataactatctctcctggtaccagcagctgcccggcacggcccctaaacttctgatctataagaataacaaaagaccctctggggtgcctgaccggttcagcggatccaagagcggcgcgtctgctaccctcgatattacagggctgcaaaccggagacgaggccgattactattgtggcatctgggacacatcccttagcgccggcggggtgtttggaaccggcacaaaagtcaccgtgctg

SEQ ID NO: 40966 - RNA, 333 nt, synthetic construct
  misc_feature 1..333: note = derived and/or modified sequence opt5 from anti-HIV_048-027217_VR-Chain
  source 1..333: mol_type = other RNA
cagagcgtgctgacccaacccccttccgtctctgccgctccgggccagaaggttacaatcagctgctccgggtctagctccattatcggaaacaattacgtgtcttggtatcagcagctccccggcacggcccctaaactgcttatttacgagaacaataagagacccagcgggatccctgaccggttctccggaagcaaatctggcacctccgcgacactggctattgccgggctccaaaccggagatgaagccgactattactgtgctacatgggataccagcctgtctgccggcggcgtgtttgggacaggaaccaaggtcacggtgctt

SEQ ID NO: 40967 - RNA, 333 nt, synthetic construct
  misc_feature 1..333: note = derived and/or modified sequence opt5 from anti-HIV_048-026760_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcacctccccggcacggcccctaaactgcttatctacgacaccgtgaagagacatagcggggtccccgatcggttctccggaagcaaatctggcacatccgcgaccctggggattagcggactccagacaggcgacgaggctgattattactgtggcacctgggacacatctctgtccgccgggggagtgtttggcagcgggaccaaggttacggtgctt

SEQ ID NO: 40968 - RNA, 333 nt, synthetic construct
  misc_feature 1..333: note = derived and/or modified sequence opt5 from anti-HIV_048-024800_VR-Chain
  source 1..333: mol_type = other RNA
cagagcgtgctgacccaacccccttccgtctctgccgctccgggccagaaggttacaatcagctgctccgggtcttacagcaacattggaaataactatgtgtcctggtaccaggtgctccccggcacggcccctaaactgcttatctataagaataacgagagaccctctgggattcctgaccggttcagcggatccaaaagcggcacctctgcgacactggggatcaccggactccagacaggcgatgaagctgactactattgtggcacctgggatacatccctgagcgccgggggagtctttggcaccgggacgaaggtgaccgttctt

SEQ ID NO: 40969 - RNA, 333 nt, synthetic construct
  misc_feature 1..333: note = derived and/or modified sequence opt5 from anti-HIV_048-024313_VR-Chain
  source 1..333: mol_type = other RNA
cagagcgtgctgacccaacccccttccgtctctgccgctccgggccagaaggttacaatcagctgctccgggtctagctccacgattggaaactctcacgtgagctggtaccagatcctccccggcaccgcccctaaactgcttatttataaggacgataaaagaccctccgggatccctgaccggttcagcggatctaagtccggcacaagcgcgaccctggggattacaggactccagaccggcgatgaggctgactactattgtggcacatgggatacctctctgaatcgcgggggagtgtttggcacggggaccaaagtcacagtgctt

SEQ ID NO: 40970 - RNA, 333 nt, synthetic construct
  misc_feature 1..333: note = derived and/or modified sequence opt5 from anti-HIV_048-021748_VR-Chain
  source 1..333: mol_type = other RNA
cagagcgtgctgacccaacccccttccgtctctgccgctccgggccagagagttacaatcagctgctccgggtctacgagcaacattggaaataactacgtgtcctggtatcagcagctccccggcaccgcccctaagctgcttatctacgagaataacaaacggccctctgggattcctgaccgcttcagcggatccaagagcggcacatctgcgaccctggggatctccggactccaaacaggcgatgaagctgactattactgtggcacctgggatagctctctgtccgggggaggcgtgtttgggacaggaaccaaagtcacggtgctt

SEQ ID NO: 40971 - RNA, 333 nt, synthetic construct
  misc_feature 1..333: note = derived and/or modified sequence opt5 from anti-HIV_048-020991_VR-Chain
  source 1..333: mol_type = other RNA
cagagcgtgctgacccaacccccttccgcctctggcacaccggggcagaaggtcacgatcagctgctccggatctagctccaccattggcaacaattacgtttcttggtatcaggtgctccccgggacagctcctaaactgcttatctacaagaacgacaaaagacccagcggcattcctgatcggttctccggaagcaagtctgggacctccgccacactgggaatcaccggcctccagacaggcgacgaggcggattattactgtgggacctgggacacgagcctgtctaccggaggcgtgtttgggacaggaaccaaagtcacagtgctt

SEQ ID NO: 40972 - RNA, 333 nt, synthetic construct
  misc_feature 1..333: note = derived and/or modified sequence opt5 from anti-HIV_048-020340_VR-Chain
  source 1..333: mol_type = other RNA
cagagcgtgctgacccaacccccttccgtctctgccgctccgggccagagagttacaatcagctgctccgggtctagctccaacgtgggaaataactacgtgtcttggtatcagcagctccccggcacggcccctaagctgcttatttacgagaataacaaacggcccagcgggatccctgaccgcttctccggaagcaagtctggcacctccgcgacactggggattaccggactccaaacaggcgatgaagctgactattactgtggcacctgggatgccagcctgtctgccgggggagtctttggcacagggaccaaagtgacggttctt

SEQ ID NO: 40973 - RNA, 333 nt, synthetic construct
  misc_feature 1..333: note = derived and/or modified sequence opt5 from anti-HIV_048-019993_VR-Chain
  source 1..333: mol_type = other RNA
cagagcgtgctgacccaacccccttccgtctctggcgccccggggcagagagttacaatcagctgcacgggatcctctagctccattggcgggttcgacgtgcactggtaccagcggctccccggaaccgctcctcgcctgcttatctatgagaacaataagagaccctctggcattcctgatcggtttagcgggtccaaaagcggaacatctgccaccctgggcatcacaggcctccagaccggggacgaagcggattactattgtggaacatgggactccagcctgtctgctggcggggtgttcggaaccggcacgaaggtcaccgtgctt

SEQ ID NO: 40974 - RNA, 333 nt, synthetic construct
  misc_feature 1..333: note = derived and/or modified sequence opt5 from anti-HIV_048-019947_VR-Chain
  source 1..333: mol_type = other RNA
cagagcgtgctgacccaacccccttccgtctctgccgctccgggccagagagttacaatcagctgctccgggtctagctccaacattggatctaagtacgtgagctggtatcagcagctccccggcacggcccctaaactgcttatctacgaaaattccaagcggcccagcgggattcctgaccgcttctctggatccaaaagcggcacctctgcgacactggggatcaccggactccaaacaggcgatgaggctgactattactgtggcacctgggatacatccctgagcaccgggggagtgtttggcacggggaccaaggtcacagtgctt

SEQ ID NO: 40975 - RNA, 333 nt, synthetic construct
  misc_feature 1..333: note = derived and/or modified sequence opt5 from anti-HIV_048-017871_VR-Chain
  source 1..333: mol_type = other RNA
cagagcgtgctgacccaacccccttccgtctctgccgctccgggccagaaggttacaatcagctgctccgggtctagctccaacattggaaatagatacgtgtcttggtatcagcagctccccggcacggcccctaaactgcttatctacaagaacaataaacggcccagcgggattcctgaccgcttctccggaagcaagtctggcacctccgcgacactggggatcaccggactccaaacaggcgatgaggctgactattactgtggcacctgggatgggagcctgtctacaggaggcgtgattgggaccggaacgaaagtcaccgtgctt

SEQ ID NO: 40976 - RNA, 333 nt, synthetic construct
  misc_feature 1..333: note = derived and/or modified sequence opt5 from anti-HIV_048-015931_VR-Chain
  source 1..333: mol_type = other RNA
cagagcgtgctgacccaacccccttccgtctctgccgctccgggccagaaggttacaatcagctgctccgggggatctagcaacattggctccacgtacgtgtcttggtatcaacaggtgcccgggaccgcccctaaactcctgatctacgagaataacaagagacccagcggcattcctgaccggttctccggaagcaaatctgggacatccgcgacccttgatatcacaggactgcagaccggcgacgaagctgattattactgtggcacatgggacaccagcctctctgggggaggcgtctttgggacgggaaccaaggtgacagttctg

SEQ ID NO: 40977 - RNA, 333 nt, synthetic construct
  misc_feature 1..333: note = derived and/or modified sequence opt5 from anti-HIV_048-015920_VR-Chain
  source 1..333: mol_type = other RNA
cagagcctgctcacccaacccccttccgtgtctgccgctccgggccagaaggtcacaatcagctgctccgggtctagctccacgattggaaacaattacgtttcttggtatcaggtgctgcccggcaccgcccctaaacttctgatctacaagaacaatgagagacccagcgggattcctgaccggttctccggaagcaaatctggcacatccgcgaccctcgggatcacaggactgcagaccggcgatgaagctgagtattactgtgccacatgggacgccagcctttctggcgggggagtgtttggcaccgggacgaaggtcaccgtgctg

SEQ ID NO: 40978 - RNA, 333 nt, synthetic construct
  misc_feature 1..333: note = derived and/or modified sequence opt5 from anti-HIV_048-013898_VR-Chain
  source 1..333: mol_type = other RNA
cagagcgtgctgacccaacccccttccgtctctgccgctccgggccagaaggttacaatcagctgctccgggtctagctccaacattggaaaacactctgtgagctggtaccagcagctccccggcacggcccctgagctgcttatctatgacaataacaatagaccctccgggattcctgatcggttcagcggatctaagtccggcaccagcgcgacactggggatcaccggactccaaacaggcgacgaagctgattactattgtggcacctgggacacatctctgtccgccgggggagtgtttggcaccgggacgaaagtcaccgtgctt

SEQ ID NO: 40979 - RNA, 333 nt, synthetic construct
  misc_feature 1..333: note = derived and/or modified sequence opt5 from anti-HIV_048-013429_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaccctgcttatctacgagaatgacaaaagacccagcgggattcctgatcggttctccggaagcaagtctggcacatccgcgaccctggggatcacaggactccaaaccggcgacgaagctgattattactgtggcacatgggacagctctctgtccgccgggggagtgtttggcaccgggacgaaagtcaccgtgctt

SEQ ID NO: 40980 - RNA, 333 nt, synthetic construct
  misc_feature 1..333: note = derived and/or modified sequence opt5 from anti-HIV_048-012358_VR-Chain
  source 1..333: mol_type = other RNA
cagagcgtgctgacccaacccccttccgtctctgccgctccgggccagaaggttacaatcagctgctccgggtctaacagcgccattggaaataactacgtgtcctggtatcaggtgctccccggcacggcgcctaaactgcttatctacaagaataacgagagaccctctgggattcctgaccggttcagcggatccaaaagcggcacctctgctacactggatatcaccgggctccagacaggagacgaagccgattattactgtggcacctgggacacatccctgagcgccggcggggtctttggaaccggcacgaaggtgaccgttctt

SEQ ID NO: 40981 - RNA, 333 nt, synthetic construct
  misc_feature 1..333: note = derived and/or modified sequence opt5 from anti-HIV_048-011158_VR-Chain
  source 1..333: mol_type = other RNA
cagagcgtgctgacccaacccccttccgtctctgccgctccgggccagaaggttacaatcagctgctccgggatttctagcaacatcggaaataacgacgtgtcctggtaccagcagctccccggcacggcccctaaactgcttatttatgataatgacaagagaccctctgggatccctgatcggttcagcggatccaaaagcggcacctctgcgacactggggattaccggactccaaacaggcgacgaggctgattactattgtggcacctgggactccagcctgtctgccgggggagtgtttggcacagggaccaaggtcacggtgctt

SEQ ID NO: 40982 - RNA, 333 nt, synthetic construct
  misc_feature 1..333: note = derived and/or modified sequence opt5 from anti-HIV_048-010720_VR-Chain
  source 1..333: mol_type = other RNA
cagagcgtgctgacccaacccccttccgtctctgccgctccgggccagaaggttacaatcagctgctccgggtctagctccaacattggatctcactacgtgagctggtatcaacaggtgcccggcacggcccctagactcgtcatctacgaaaattccaaacggcccagcgggattcctgaccgcttctctggatccaagagcggcacctctgcgacactggggatcaccggacttcagacaggcgatgaggctgactattactgtggcacctgggatacatccctgagcgccgggggagtgtttggctctgggaccaaagttacggtgctc

SEQ ID NO: 40983 - RNA, 333 nt, synthetic construct
  misc_feature 1..333: note = derived and/or modified sequence opt5 from anti-HIV_048-009445_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggtgcctaaactgcttatctacgacacctatacaagacccagcgggacccctgatcggttctccggaagcaagtctggcacatccgccaccctggcgattacagggctccaaaccggagacgaggctgattactattgtggcacgtgggacggcagcctgtctaccgggggagtcatcggcacagggaccaaagtgacagttctt

SEQ ID NO: 40984 - RNA, 324 nt, synthetic construct
  misc_feature 1..324: note = derived and/or modified sequence opt5 from anti-HIV_048-006126_VR-Chain
  source 1..324: mol_type = other RNA
cagagcgtgctgacccaacccccttccgtctctggcgccccggggcagaaggttacaatcagctgctccggaatttctagcaacttcggcatctcctggtaccaacaggtgcccgggacggctcctaaactcctgatttatgagaatgacaagagaccctctggaatccctgatcggtttagcggctccaaaagcgggacctctgccacacttggaattaccggcctgcagacaggcgacgaagcggattactattgtgggacctgggacacatccctcagcgctggaggcgtgttcgggaccggaacgaaggtcaccgtgctg

SEQ ID NO: 40985 - RNA, 333 nt, synthetic construct
  misc_feature 1..333: note = derived and/or modified sequence opt5 from anti-HIV_048-005652_VR-Chain
  source 1..333: mol_type = other RNA
cagagcgtgctgacccaacccccttccgtctctgccgctccgggccagaaggttacaatcagctgctccgggtctaacagcgccattggaaataactacgtgtcctggtatcaggtgctccccggcacggcgcctaaactgcttatctacgacacctataagagagcttctgggattcccgatcggttcagcggatccaaaagcggcacatctgccaccctggggatcacaggactccagaccggcgacgaggccgattactattgtggcacatgggacacctccctgagcgggggaggcgtctttgggacgggaaccaaggtgacagttctt

SEQ ID NO: 40986 - RNA, 333 nt, synthetic construct
  misc_feature 1..333: note = derived and/or modified sequence opt5 from anti-HIV_048-005532_VR-Chain
  source 1..333: mol_type = other RNA
cagagcgtgctgacccaacccccttccgtctctgccgctccgggccagaaggttacaatcagctgctccgggacgtctagcaacattggaaatacctacgtgtcctggtatcagcagctccccggcacagcccctaactacctgatctataaaattgacaagagaccctctgggatccctgatcggttcagcggatccaaaagcggcacctctgcgacacttgggattaccggactgcaaacaggcgacgaggctgattactattgtggcacctgggacacgtccctcagcgccgggggagtgtttggcaccgggacaaaggtcaccgtgctg

SEQ ID NO: 40987 - RNA, 333 nt, synthetic construct
  misc_feature 1..333: note = derived and/or modified sequence opt5 from anti-HIV_048-005189_VR-Chain
  source 1..333: mol_type = other RNA
cagagcgtgctgacccaacccccttccgtctctgccgctccgggccagaaggttacaatcagctgctccgggtctggaagcacgattggcaacaatgacgtgtcctggtaccagcagctccccggggccgcgcctaaactgcttatctatgaggataacaagagaccctctggcattcctgctcggttcagcggatccaaaagcgggacctctgccacactgcgcatcaccggactccaaacaggcgacgaagccgattactattgtggcacctgggactccagcctgtctgctgggggagtgtttggcacagggaccagagtctccgtgctt

SEQ ID NO: 40988 - RNA, 333 nt, synthetic construct
  misc_feature 1..333: note = derived and/or modified sequence opt5 from anti-HIV_048-005088_VR-Chain
  source 1..333: mol_type = other RNA
cagagcgtgctgacccaacccccttccgtctctgccgctccgggccagaaggttacaatcagctgctccgggtctagctccaacattggcaaaaattacgtgtcttggtatcagcagctccccggaacggcccctaagctgcttatctacgacaacaataacagacccagcgggattcctgatcggttctccggaagcaaatctggcacctccgcgacactggggatcaccggactccaaacaggcgacgaggctgattattactgtggcgcctgggacaccagcctgtctgccgggggagtgtttggcacagggaccaaggtcacggtgctt

SEQ ID NO: 40989 - RNA, 333 nt, synthetic construct
  misc_feature 1..333: note = derived and/or modified sequence opt5 from anti-HIV_048-004023_VR-Chain
  source 1..333: mol_type = other RNA
cagagcgtgctgacccaacccccttccgtctctgccacaccgggccagaaggttacgatcagctgctccgggggatctagcaacattggcaaaaatgacgtgtcctggtaccagcagctccccgggaccgctcctaagctgcttatctatgatacaaacaaaagaccctctggcattcctgaccggttcagcgccgcgcgctccggaaccagcgctacactggatatcaccgggctccaaacaggagacgaggccgattactattgtggcacctgggacacgtctctgtccgccggcggggtgtttggaaccggcacaaaggtcaccgtgctt

SEQ ID NO: 40990 - RNA, 333 nt, synthetic construct
  misc_feature 1..333: note = derived and/or modified sequence opt5 from anti-HIV_048-001580_VR-Chain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttctgtacgagaataacaagagacccagcgggatccctgaccggttctccggaagcaaatctggcacctccgcgacactcgctattaccgggctgcaaacaggagatgaagccgcctattactgtggcacctgggacggcagcctttctacagggggagtgatcggcaccgggacgaaggtcaccgtgctg

SEQ ID NO: 40991 - RNA, 333 nt, synthetic construct
  misc_feature 1..333: note = derived and/or modified sequence opt5 from anti-HIV_038-221120_VR-Chain
  source 1..333: mol_type = other RNA
cagagcgtgctgacccaacccccttccgtctctgccgctccgggccagaaggttacaatcagctgctccgggtctacgagcaacattggcaaaaattacgtgtcctggtatcagcagctccccggaaccgcccctaagctgcttatctacgacaacaatgagagaccctctgggattcctgatcggttcagcggatccaaaagcggcacatctgcgaccctggggatcacaggactccaaaccggcgacgaagctgattattactgtgccacatgggactccagcctgtctggcgggggagtgtttggcaccgggacgcgcgtcaccgtgctt

SEQ ID NO: 40992 - RNA, 333 nt, synthetic construct
  misc_feature 1..333: note = derived and/or modified sequence opt5 from anti-HIV_038-197677_VR-Chain
  source 1..333: mol_type = other RNA
cagagcgtgctgacccaacccccttccgtctctgccgctccgggccagaaggttacagtgagctgctccgggtctaacagcaatatcggaaaccactacgtgtcctggtatcagcagctccccggcacggcccctaaactgcttatttacgacaataacaagagaccctctgggatccctgatcggttcagcggatccaaaagcggcacctctgcgacactggggattaccggactccaaacaggcgacgaggctgattattactgtggcacctgggactccagcctgtctgccgggggagtctttggcacagggaccaaggtgacggttctt

SEQ ID NO: 40993 - RNA, 333 nt, synthetic construct
  misc_feature 1..333: note = derived and/or modified sequence opt5 from anti-HIV_038-196765_VR-Chain
  source 1..333: mol_type = other RNA
cagagcgccctgacccaacccgcttccgtgtctggcagccctgggcagtccatcacaatttcttgcacgggaaccagcggcgacgtcgggtacaacctcgtttcctggtatcagcagctgccgggaacagcccccaaggtgcttatctacgagaataacaaaagaccttctggcattcccgatcggttcagcgggtccaagagcggaacctctgcgacactgggcatcaccggcctccaaacaggggacgaagctgattattactgtggaacctgggactccagcctgtctgccggcggggtgtttggaacgggcaccaaagtcacagtgctt

SEQ ID NO: 40994 - RNA, 333 nt, synthetic construct
  misc_feature 1..333: note = derived and/or modified sequence opt5 from anti-HIV_038-186200_VR-Chain
  source 1..333: mol_type = other RNA
cagagcgtgctgacccaacccccttccgcctctggcacaccggggcagagaatcacgattagctgctccggaacctctagcaacatcggctccaatattgtctcttggtaccagcacctccccgggacaacccctaagctggttatcttccggaacaatcagcgccccagcggcattcctgacagattttccggaagcaaatctgggacatccgctacccttggaatcacaggcctgcaaaccggcgatgaggccgactattactgtgggacgtgggatagctctctctccgcgggaggcgtgttcgggaccggaacaaaggtgaccgtcctg

SEQ ID NO: 40995 - RNA, 333 nt, synthetic construct
  misc_feature 1..333: note = derived and/or modified sequence opt5 from anti-HIV_038-126170_VR-Chain
  source 1..333: mol_type = other RNA
cagagcgtgctgacccaacccccttccgtctctgccccgcccggccagaaggttacaatcagctgctccgggacgacctctaacattggaagcaattacgtggcttggtatcagcagctccctggcacagcccccaaactgcttatctacgacaacgtgaagagacctaccaatattcccgatcggttctccgggtctaaaagcggaacatccgcgaccctgggcatcacagggctccaaaccggagacgaggctgattattactgtggcacgtgggacagctctctgtccgccggcggggtctttggaaccggcacaaaggtgaccgttctt

SEQ ID NO: 40996 - RNA, 333 nt, synthetic construct
  misc_feature 1..333: note = derived and/or modified sequence opt5 from anti-HIV_038-108545_VR-Chain
  source 1..333: mol_type = other RNA
cagagcgtgctgacccaacccccttccgcctctggcacaccggggcagagagtcacgatcagctgctccggatctagctccaacattggctacaataccgtttcttggtatcagcagctccccgggacagctcctaagctgcttatctacgagaacaataaacggcccagcggcattcctgaccgcttctccggaagcaagtctgggacctccgccacactgggaatcaccggcctccaaacaggcgatgaagcggactattactgtgggacctgggatagctctctgtccgctggaggcgtgtttgggacgggaaccaaagtgacagtcctt

SEQ ID NO: 40997 - RNA, 333 nt, synthetic construct
  misc_feature 1..333: note = derived and/or modified sequence opt5 from anti-HIV_038-107263_VR-Chain
  source 1..333: mol_type = other RNA
cagagcgtgctgacccaacccccttccgcctctggcacaccggggcagagagtcacgatcagctgctccggatctagctccaacattggctctaataccgttaactggtaccaacaggtgcccgggacagctcctaatctcctgatctatagcaacgaccagcggccctccggcattcctgatcgcttcagcggatctaagtccgggaccagcgccacacttggaatcaccggcctgcagacaggcgacgaggcggattactattgtgggacctgggactcttccctcagcgctggaggcgtgtttgggacgggaaccaaagtcacagtgctg

SEQ ID NO: 40998 - RNA, 333 nt, synthetic construct
  misc_feature 1..333: note = derived and/or modified sequence opt5 from anti-HIV_038-104530_VR-Chain
  source 1..333: mol_type = other RNA
cagagcgtgctgacccaacccccttccgtctctgccgctccgggccagaaggttacaatcagctgctccgggtctagctccaacattggatctaattacgtgagctggtatcagcacctccccggcaaagcccctaagctgcttatctacgacaacaataaaagaccctccgggattcctgatcggttcagcggatctaagtccggcacgagcgcgaccctggggatcacaggactccagaccggcgacgaggctgattattactgtggcacatgggactcttccctgagcgccgggggagtgtttggcaccgggacaaaagtcaccgtgctt

SEQ ID NO: 40999 - RNA, 333 nt, synthetic construct
  misc_feature 1..333: note = derived and/or modified sequence opt5 from anti-HIV_038-099169_VR-Chain
  source 1..333: mol_type = other RNA
cagagcgtgctgacccaacccccttccgcctctggcacaccggggcagagagtcagcatctcctgctctggaattacgagctccctcggctctaaccacatgagctggtaccagcagctgcccgggaccgctcctaaacttctgatctatgagaataacaagcggccctccggcattcctgaccgcttcagcggatctaagtccgggacaagcgccaccctcggaatcacaggcctgcaaaccggcgatgaagcggactactattgtgggacatgggattcttcccttagcgctggaggcgtttttgggaccggaacgaaagtgaccgtgctg

SEQ ID NO: 41000 - RNA, 333 nt, synthetic construct
  misc_feature 1..333: note = derived and/or modified sequence opt5 from anti-HIV_038-075067_VR-Chain
  source 1..333: mol_type = other RNA
cagagcgtgctgacccaacccccttccgtctctggcgccccggggcagagagttacaatcagctgctccggatctagctccacgattggcaacaattacgtgtcttggtatcagctcctgcccgggaccgctcctaaacttctgatctacaagaacaataagcggcccagcggcattcctgaccgcttctccggaagcaaatctgggacatccgccaccctcggaatcacaggcctgcagaccggcgatgaggcggactattactgtgggacatgggataccagcctttctgctggaggcgtgtttgggacgggaaccaaggtcacagtgctg

SEQ ID NO: 41001 - RNA, 333 nt, synthetic construct
  misc_feature 1..333: note = derived and/or modified sequence opt5 from anti-HIV_038-072368_VR-Chain
  source 1..333: mol_type = other RNA
cagagcgtgctgacccaatccccctctgccagcggcacacctgggcagagagtcacgatctcctgctctggaagctcctctaacattggcaataactacgttagctggtatcagcagctcccggggaccgctcccaagctgcttatctacgagaataacaaacggccttccggcattcccgaccgcttcagcggatctaagtccgggacaagcgccaccctgggaatcacaggcctccaaaccggcgatgaagcggactattactgtgggacatgggattcttccctgagcgctggaggcgtgtttgggaccggaacgaaagtgaccgtcctt

SEQ ID NO: 41002 - RNA, 333 nt, synthetic construct
  misc_feature 1..333: note = derived and/or modified sequence opt5 from anti-HIV_038-068503_VR-Chain
  source 1..333: mol_type = other RNA
cagagcgtgctgacccaacccccttccgtctctgccgctccgggccagatggttacaatcagctgctccgggtctagaagcaacattgagaatcactacgtgtcctggtatcagcatctccccggagccgcgcctaagctgcttatctacgacaacggcaaacggccctctgggattcctgatcgcttcagcggatccaagagcggcacgtctgctaccctggggatcacaggactccagaccggcgacgaagccgattattactgtggcacatgggactccagcctgtctgccgggggagtgtttggcaccgggacaaaagtcaccgtgctt

SEQ ID NO: 41003 - RNA, 333 nt, synthetic construct
  misc_feature 1..333: note = derived and/or modified sequence opt5 from anti-HIV_038-068016_VR-Chain
  source 1..333: mol_type = other RNA
cagagcgtgctgacccaacccccttccgcctctggcacaccggggcagagagtcacgatcagctgctccggatctagctccaacattgagtctaatttcgtttactggtatcagcagtttcccggcaccacacctaagctcctgatctaccgggacgggcaacgccccagcggcattcctgatagattctccggaagcaaatctgggacctccgctacacttggaatcaccggcctgcagacaggcgacgaagccgattattactgtgggacctgggacagctctctctccgcgggaggcgtgtttgggacgggaaccaaggtgacagtcctg

SEQ ID NO: 41004 - RNA, 333 nt, synthetic construct
  misc_feature 1..333: note = derived and/or modified sequence opt5 from anti-HIV_038-063958_VR-Chain
  source 1..333: mol_type = other RNA
cagagcgtgctgacccaacccccttccgtctctggcgccccggggcagagagttacaatcagctgcacgggatcctctagcaacattggcaattccggggtgcactggtaccagcagctccccggaaccgctcctaagctgcttatctatgagaacaataaacggccctctggcattcctgaccgcttcagcgggtccaagagcggaacatctgccaccctgggcatcacaggcctccaaaccggggatgaagcggactactattgtggaacatgggattccagcctgtctgctggcggggtgtttggaaccggcacgaaagtcaccgtgctt

SEQ ID NO: 41005 - RNA, 333 nt, synthetic construct
  misc_feature 1..333: note = derived and/or modified sequence opt5 from anti-HIV_038-033733_VR-Chain
  source 1..333: mol_type = other RNA
cagagcgtgctgacccaacccccttccgcctctggcacaccggggcagagagtcacgatcagctgctccggatctagctccaacattggctctaagtacgtttattggtaccagcagctccccgggaccgctcctaaactgcttatctatgacaatgataagcggcccagcggcattcctgaccgcatctccgccagcaaatctggaacatccgcgaccctggatattacaagactccaaaccggggacgaggctgattactattgtggaacatgggacagctctctgtccgccggcggcgtgttcgggaccggaacgaaggtgaccgtcctt

SEQ ID NO: 41006 - RNA, 333 nt, synthetic construct
  misc_feature 1..333: note = derived and/or modified sequence opt5 from anti-HIV_038-030557_VR-Chain
  source 1..333: mol_type = other RNA
cagagcgtgctgacccaacccccttccgtctctgccgctccgggccagaaggttacaatcagctgctccgggtctagctccacgattggaaacaattacgtgtcttggtatcagctcctgcccggcaccgcccctaaacttctgatctacaagaacaataaaagacccagcgggattcctgaccggttctccggaagcaagtctggcacatccgcgaccctcgggatcacaggactgcagaccggcgatggcgctgactattactgtgggacatgggataccagcctttctgccggaggcgtgtttgggacgggaaccattgtcacagtgctg

SEQ ID NO: 41007 - RNA, 333 nt, synthetic construct
  misc_feature 1..333: note = derived and/or modified sequence opt5 from anti-HIV_038-024298_VR-Chain
  source 1..333: mol_type = other RNA
cagagcgtgctgacccaacccccttccgtctctgccgctccgggccagaaggttacaatcagctgctccgggtctagctccaacattggaaattctcacgtgagctggtaccagcagttccccggcacggggcctaaactcctgatctatgagaacgccaagagaccctccggcattcctgaccggatcagcggatctaaatccgataccagcgcgacacttgggattaccggactgcaaacaggcgacgaagctgattactattgtggcacctgggactcttccctcagcgccgggggagtgtttggcacagggaccaaggtcacggtgctg

SEQ ID NO: 41008 - RNA, 333 nt, synthetic construct
  misc_feature 1..333: note = derived and/or modified sequence opt5 from anti-HIV_038-011154_VR-Chain
  source 1..333: mol_type = other RNA
cagagcgtgctgacccaacccccttccgtctctgccgctccgggccagagaatcacaattagctgctccgggtctagctccaacatcggaaataactacgtttcttggtatcagcagctccccggcacggcccctaagctgcttatttacaaaaataacaagcggcccagcgggatccctgaccgcttctccggaagcaaatctggcacctccgcgacactggggattaccggactccaaacaggcgatgaggctgactattactgtggcacctgggatacaagcctgtctgccgggggagtgtttggcaccgggacgaaggtgaccgtcctt

SEQ ID NO: 41009 - RNA, 318 nt, synthetic construct
  misc_feature 1..318: note = derived and/or modified sequence opt5 from anti-HIV-1_LightChain
  source 1..318: mol_type = other RNA
gagatcgtgctgacccagagccccggcacactctccctgtctcctggggaaagagccacgcttagctgccgggcttcccaatctgtcagcaacaatttcctggcctggtaccagtataagccgggacagccccctcgcgttctcatttacggcacctccagacgggcgtctgggatccccgaccgctttagcggatccggcagcgggacagatggatctctgaccatttccagacttgaggctgaagacttcgccgtgtattactgtcagcaatatgagtttttcggccagggcacacggctggaaatgaaacgcacc

SEQ ID NO: 41010 - RNA, 318 nt, synthetic construct
  misc_feature 1..318: note = derived and/or modified sequence opt5 from anti-HIV-1_LightChain
  source 1..318: mol_type = other RNA
gaggtggtcctgacccagagccccggcacactctccctgtctcctggggaaagagccacgcttagctgccgggcttcccaatctgttagccgcaactacctggcctggtatcagcagaagctcggacacggcccgagactgcttgtgtacgcgacctcccggcgcgctacagggatccccgacagattcattggatctcagagcggcaccgagtataatctgacaatcacccggctcgatcctggggactttgcccaatacttctgtcagcagtatgaatttttcggacccggcacacgcctggatattaaaagaacc

SEQ ID NO: 41011 - RNA, 309 nt, synthetic construct
  misc_feature 1..309: note = derived and/or modified sequence opt5 from anti-HIV-1_LightChain
  source 1..309: mol_type = other RNA
gaagtggtcctgacccagagccccggcacactctccctgtctcctggggaaagagccagcttctcctgcaagtctagccaatacggacacacggcttggtatcagcagaaacttggccatgggccgcggctgctcatctacgccacctcccgcagagcgacaggcattcccgaccggtttatcggatctcagagcgggaccgagtataacctgacaattacccgccttgatcctggagacttcgctcactacttttgtcaacagaatgagttctttggccccggcacaagactggatatgaagcggacc

SEQ ID NO: 41012 - RNA, 306 nt, synthetic construct
  misc_feature 1..306: note = derived and/or modified sequence opt5 from anti-HIV-1_LightChain
  source 1..306: mol_type = other RNA
gagatcgtgctgacccagagcccctcctctctcagcctgtcccctggcgaaagagcctctcttagctgccgggggtcccacggacatgtcgcttggtaccaacacaagccgggccagattccccgcctgctcatctatgccacatctaaaagagcgagcgggatttccgaccggttcagcggatctggctccgggacggatgctaccctgagcatctctcgccttgagcctgaagactttgccgtttacttctgtcagcagtatgagtttttcggacaaggcacaagactggaaattaagcggacc

SEQ ID NO: 41013 - RNA, 306 nt, synthetic construct
  misc_feature 1..306: note = derived and/or modified sequence opt5 from anti-HIV-1_LightChain
  source 1..306: mol_type = other RNA
gagatcatgctgacccagagccccggcacactctccctgtctcctggggaaagagccacgcttagctgccggggatcccacggccatgtggcttggtaccaacagaagccggggcgcattcccagactgctcatctatggaacctctaaacgggccagcggcattcctgaccgcttctccgggtctggaagcggcacagatgcgaccctgacaatctccagacttgagagcgaagactttgctgtctacttctgtcagcagtatgagtttttcggccaagggacccggctggatattaaccgcaca

SEQ ID NO: 41014 - RNA, 309 nt, synthetic construct
  misc_feature 1..309: note = derived and/or modified sequence opt5 from anti-HIV-1_LightChain
  source 1..309: mol_type = other RNA
gagagcgtgctgacccagtcccccggcacactctctctgagccctggggaaacggcctccctttcttgcaccgctgccctgtacggacacatgacatggtatcaaaagaaaccgggccagccccctaagctcctgctttacgcgagctccaaaagagcttctgggatccccgaccggttcagcggatcccagtttggcaagcagtataccctgattatcacaaaaatggagcctgaagatttcgccgagtactattgtcaacagtttgaagtcttcgggcagggaacccgcctcgacatgagacggaca

SEQ ID NO: 41015 - RNA, 306 nt, synthetic construct
  misc_feature 1..306: note = derived and/or modified sequence opt5 from anti-HIV-1_LightChain
  source 1..306: mol_type = other RNA
gaggtggtcctgacccagagccccggcacactctccctgtctcctggggaaagagccacgcttagctgccggggatcccacggccatctgtcttggtaccaatataagccggggcagccccctcgcgttctcatctacggaaccagcagacgggcttccggcattcccgaccgcttctctgggagcggatccggcacagatggcagcctgaccatctctagacttgaggccgaagactttgcggtgtattactgtcagcagtatgagttctttgggcaaggaacacggctggaaatgaaacgcacc

SEQ ID NO: 41016 - RNA, 309 nt, synthetic construct
  misc_feature 1..309: note = derived and/or modified sequence opt5 from anti-HIV-1_LightChain
  source 1..309: mol_type = other RNA
gaggtggtcctgacccagagccccggcacactctccctgtctcctggggaaagagccagcctttcctgcaagtctagccaatacggacacacggcttggtatcagcagaaactgggccaggggccgcggctcctgatctacgccacctcccgcagagcgacaggcattcccgaccggttctctggaagccaatccgggaccgagtataaccttacaatcacccgcctggatcctggagactttgctcagtacttctgtcagcagtatgaatttttcggccccggcacaagactcgatattaagcggacc

SEQ ID NO: 41017 - RNA, 306 nt, synthetic construct
  misc_feature 1..306: note = derived and/or modified sequence opt5 from anti-HIV-1_LightChain
  source 1..306: mol_type = other RNA
gagatcatgctgacccagagccccggcacactctccctgtctcctggggaaagagccacgcttagctgccggggatcccacggccatgtggcttggtaccaacagaagccggggcgcattcccagactgctcatctatggaacctctaaacgggccagcggcattcctgaccgcttctccgggtctggaagcggcacagatgcgaccctgacaatctccagacttgagagcgaagactttgctgtctactattgtcagcagtacgagttctttggccaagggacccggctggatattaagcgcaca

SEQ ID NO: 41018 - RNA, 309 nt, synthetic construct
  misc_feature 1..309: note = derived and/or modified sequence opt5 from anti-HIV-1_LightChain
  source 1..309: mol_type = other RNA
gagagcgtgctgacccagtcccccggcacactctctctgagccctggggaaacggcctccctttcttgcaccgctgccagctacggacacatgacatggtatcaaaagaaaccgggccagccccctaagctgctcatcttcgcgacctccaaaagagcttctgggattcccgaccggtttagcggatcccagttcggcaagcagtacacactgaccatcacacgcatggagcctgaagattttgccgggtattactgtcaacaggtcgagttctttggacagggcaccagacttgaaattcggcgcacg

SEQ ID NO: 41019 - RNA, 309 nt, synthetic construct
  misc_feature 1..309: note = derived and/or modified sequence opt5 from anti-HIV-1_LightChain
  source 1..309: mol_type = other RNA
gacatccagatgacccaaagcccctcctctctgagcgcctccgtgggcgatagagtcacaattacgtgccaggcttctcaggacatcagcaactacctcaattggtatcagcaaaagcctgggaaagccccgaagctgcttatttacgatgcgtccaacctggagaccggagttccctctcggttcagcggctccgggtttcacacaaccttcagcctcacaatctctggactgcagcgcgacgattttgctacctatttctgtgccgtgcttgaatttttcggccctgggacaaaagtggactttaat

SEQ ID NO: 41020 - RNA, 309 nt, synthetic construct
  misc_feature 1..309: note = derived and/or modified sequence opt5 from anti-HIV-1_LightChain
  source 1..309: mol_type = other RNA
gacatccagatgacccaaagcccctcctctctgagcgcctccgtgggcgatagagtcacaattacgtgccaggcttctcaggacatcaccaactacctcaattggtatcagcaaaagcctgggcgggccccgaaactgcttgttcacggagcgagcaacctgcagcgcggcgtgccctccagattctctgggagcggatttcatacaaccttcacactcaccatttccagcctgcagcctgatgacgtggctacatacttttgtgaggtcttccagtggtttggccccgggacccgggtggatttcaat

SEQ ID NO: 41021 - RNA, 309 nt, synthetic construct
  misc_feature 1..309: note = derived and/or modified sequence opt5 from anti-HIV-1_LightChain
  source 1..309: mol_type = other RNA
ggcttccagctgacccaaagcccctcctctctcagcgcctccgtgggggacagagtctctatcaactgccaggctggagagggcattgggagctccctgaattggtaccagcagaagcctggacgggccccgaaacttctggttcacggcgcgtctaacctccaacgcggggtgcccagcagattttccggaagcggcttccatacaacgtttaccctgacaatctcttcccttcagcctgatgacgtggctacctatttctgtgaagtctttcagtggttcggccccgggacacgggtggattttaat

SEQ ID NO: 41022 - RNA, 309 nt, synthetic construct
  misc_feature 1..309: note = derived and/or modified sequence opt5 from anti-HIV-1_LightChain
  source 1..309: mol_type = other RNA
ggcatccagctgacccaaagcccctcctctctcagcgtgtccgtcggggacagagttacaattacgtgccgggcctctcagggaatcggcaacagcctgaattggtaccagcagaagcctgggaaagctccgaaccttatggtgttcggaaccacaaagctgaatcgcggcgtgccctccagattttctgggagcggatccggcaccacagccaccctcacaattaacagcctgcaacctgaagatatcgcgacctatttctgtcaggtctttgagttccttggccccgggacgaaactggacatgaag

SEQ ID NO: 41023 - RNA, 309 nt, synthetic construct
  misc_feature 1..309: note = derived and/or modified sequence opt5 from anti-HIV-1_LightChain
  source 1..309: mol_type = other RNA
gacatccagatgacccaaagcccctcctctctgagcgcctccgtgggcgatagagtcacaattacgtgccaggctgggcagggaatcggctctagcctcaagtggtaccagcaaaaacctgggcgggccccgcgcctgcttgttcacggagcgtccaacctgcatagaggcgtgccctctcggttcagcgggtccggatttcacaccacattcagcctcaccatttctggcctgcagcgcgacgattttgctacatatttctgtgccgtgcttgagtttttcggccctgggaccaaggtcgactttaat

SEQ ID NO: 41024 - RNA, 309 nt, synthetic construct
  misc_feature 1..309: note = derived and/or modified sequence opt5 from anti-HIV-1_LightChain
  source 1..309: mol_type = other RNA
ggcatccagctgacccaaagcccctcctctctcagcgcctccgtgggggacagagtcacaattacgtgccaggcttctcagggaatcggcagctccctgcagtggtaccaacagaagcctgggcgggccccgaaccttctggttcacggagcgtctaatctccatcgcggcgtgcccagcagattctccgggagcggatttcacaccacattctctctgaccatttccggccttcagcgggatgactttgctacatatttctgtgccgtgctggagtttttcggccctgggaccaaagtcgaaatcaag

SEQ ID NO: 41025 - RNA, 309 nt, synthetic construct
  misc_feature 1..309: note = derived and/or modified sequence opt5 from anti-HIV-1_LightChain
  source 1..309: mol_type = other RNA
ggcgtgcagctgacccaaagcccctcctctctcagcgcctccgtcggggacagagtttctatcaactgccaggctggacagggcattgggagctccctgaattggtaccagcaaaagcggggaaaggcccctaaacttctggtgcacggcgcgtctacactccagcgcggggtgccgagcagattctccggaagcggctttcatacgaccttcacactgaccatctcttcccttcagcccgatgacgtcgctacatatttttgtgaggtgttccagtggtttggccctgggacccgggttgatttcaac

SEQ ID NO: 41026 - RNA, 306 nt, synthetic construct
  misc_feature 1..306: note = derived and/or modified sequence opt5 from anti-HIV-1_LightChain
  source 1..306: mol_type = other RNA
tacatccagctgacccaaagcccctcctctctcagcgcctccattggcgacagagtgacaatcgcttgccgggcctctcaggggattggatatgtccactggtaccagcagaagcgcggcaaacctccgaagctgcttatccatggggcgagcattctggagagaggagttccctcccggttctctggcagcgggtccggaacgctctttaacctgaccgtgagcggccttcaacctgaagatttcgctacatatatgtgtcaggtgtttgagtctttcggccccgggaccaaagtccagatgaag

SEQ ID NO: 41027 - RNA, 309 nt, synthetic construct
  misc_feature 1..309: note = derived and/or modified sequence opt5 from anti-HIV-1_LightChain
  source 1..309: mol_type = other RNA
ggcatccagctgacccaaagcccctcctctctcagcgcctccctgggggacagagtgacaattacgtgccaggcttctcagggaatcggcagctcccttcagtggtaccaacagaagcctgggaaagccccgaagctgctcgtccacggagcgtctaaactgcatcggggcgttcccagccgcttctccgggagcggatttcacaccacattctctcttaccatttccagcctgcagcctgaagattttgctacatatctctgtcaggtgctggagttctttggccccggcaccaaggtggacttcaac

SEQ ID NO: 41028 - RNA, 309 nt, synthetic construct
  misc_feature 1..309: note = derived and/or modified sequence opt5 from anti-HIV-1_LightChain
  source 1..309: mol_type = other RNA
ggcatccagctgacccaaagcccctcctctctcagcgcctccgtgggggacacagtcacgattacctgccaggcttctcagggaatcggcagctccctgcagtggtaccaacagaagagagggcgggcccctaaacttctggttcacggagcgtctaacctccagggcggggtgccgagccgcttctccggaagcggctttcatacaaccttcacactggctattagaggccttcagcccgatgactttgccacctatttctgtcaatctctggagtttttcgggcctggaacaaaggtggatatgaaa

SEQ ID NO: 41029 - RNA, 306 nt, synthetic construct
  misc_feature 1..306: note = derived and/or modified sequence opt5 from anti-HIV-1_LightChain
  source 1..306: mol_type = other RNA
tacatccagctgacccaaagcccctcctctctcagcgcctccgtgggcgacagagtcacaattacgtgccgggcttctcaggatatcgggtatgttagctggtacgcccagaagcgcggcagagcgcctaaactgcttattcacggagcttccgggctggagcggggagtgccgtctcgcttcagcggctccgggagcggaaccctctttacactgaccatcgaatctcttcagcccgaggacttcgccacatatatgtgtcaagtgtttgaatccttcggccctggcaccaaggtcgagatgaaa

SEQ ID NO: 41030 - RNA, 309 nt, synthetic construct
  misc_feature 1..309: note = derived and/or modified sequence opt5 from anti-HIV-1_LightChain
  source 1..309: mol_type = other RNA
ggcatccagctgacccaaagcccctcctctctcagcgcctccgtgggggacagagtctctattaactgccaggctggacagggcatcgggagctccctgaattggtaccagcaaaagcctggacgggccccgaaacttctggttcacggcgcgtctaacctccagcgcggggtgcccagcagattctccggaagcggctttcatacaacgttcaccctgacaatttcttcccttcagcctgatgacgtggctacctatttttgtgccgtcttccagtggtttggccccgggacacgggtggatttcaat

SEQ ID NO: 41031 - RNA, 366 nt, synthetic construct
  misc_feature 1..366: note = derived and/or modified sequence opt5 from anti-HIV-1_HeavyChain
  source 1..366: mol_type = other RNA
agccagcaactggtgcagtccggcacccaggtcaagaaacccggggcctctgttagaatcagctgccaggcttccggatacacattcacggactatgtgctccactggtggcggcaagcccctggccaggggctggagtggatgggatggattaagccggtgtacggcgcgcgcaactatgctagacggtttcaggggcgcatcgatttctctagagacatttaccgggaaatcgcctatatggatcttagcggactgcgctccgacgataccgccctctacttttgtgctagagacggctctggcgatgacacaagctggcatctggatccctgggggcagggaacccttgtcattgtgtccgcc

SEQ ID NO: 41032 - RNA, 366 nt, synthetic construct
  misc_feature 1..366: note = derived and/or modified sequence opt5 from anti-HIV-1_HeavyChain
  source 1..366: mol_type = other RNA
agccagcaactggtgcagtccggcacccaggtcaagaaacccggggcctctgttagaatcagctgccaggcttccggatacacattcacggactatctcctgcactggtggcggcaagcccctggccagcgccttgagtggatggggtggattaagccggtgtacggagcgagaaactatgctcatcggtttcagggccgcatcaatttcgatagagacatttaccgggaaatcgcctttatggatctgtctgggctccgcagcgacgataccgccgtgtatttctgtgctagagacggaggcggcgatgaccggacatggctgcttgatacctgggggcagggaacactggtcgtggtttcctct

SEQ ID NO: 41033 - RNA, 366 nt, synthetic construct
  misc_feature 1..366: note = derived and/or modified sequence opt5 from anti-HIV-1_HeavyChain
  source 1..366: mol_type = other RNA
caggtgcacctggagcaacccggcagcgtcgttagatggcctggggcctccctcaccctgtcttgcacagctagcggatacatcttcgtgaactatcatattcactggcttcggcaggccccgggccagcgcctggaactcctggggacgatcaatcccgtgggaggcgcgacctcctacgctcagaagtttagagggcggcttgtcctgacacgcgacattggatctagcaccgtgacactcctgctgaaccatctcagacgggatgactccgccgtttatttctgtgcccgcgagtctaatgctagcggcagaggccggtccatggatcactgggggcgcggaagcagagtgatcgtctctcaa

SEQ ID NO: 41034 - RNA, 366 nt, synthetic construct
  misc_feature 1..366: note = derived and/or modified sequence opt5 from anti-HIV-1_HeavyChain
  source 1..366: mol_type = other RNA
caggtgcaactggtccagagcggcgccgaggttaagaaacccggggcttccgtgagagtgtcttgccaggccagcggatacaccttcacaaactatatcctccactggtggcggcaggcgcctggccaagggctggaatggatgggacttattaagccggtctacggcgctgtgaattatgcccgccagtttcaggggagaatccagctgacgcgggacatttaccgcgagatcgccttcctcgatctgtccggacttagatctgacgataccgctgtttattactgtgcccgggacgaaagcggcgatgacctgaaatggcatctccacccctggggccaagggacacaggtgattgtctcccct

SEQ ID NO: 41035 - RNA, 366 nt, synthetic construct
  misc_feature 1..366: note = derived and/or modified sequence opt5 from anti-HIV-1_HeavyChain
  source 1..366: mol_type = other RNA
caggtgcaactggtccagagcggcgccgaggttaagaaacccggggcttccgtgagaatctcttgccaggccagcggatacaccttcacagactatgtgctccactggtggcggcaggcgcctggccaagggctggaatggatgggatggattaagccggtctacggcgctcgcaactatgccagacggtttcaggggcgcatcaatttcgatagagacatttaccgggagatcgcctatatggatctttccggactgcgctctgacgatacggctagatacttttgtgcccgggacggcagcggcgatgacacctcctggcatctccacccctgggggcagggaacactggtgattgtttctgct

SEQ ID NO: 41036 - RNA, 366 nt, synthetic construct
  misc_feature 1..366: note = derived and/or modified sequence opt5 from anti-HIV-1_HeavyChain
  source 1..366: mol_type = other RNA
agccagcaactggtgcagtccggcacccaggtcaagaaacccggggcctctgttagagtgagctgccaggcttccggatacacattcacgaactatatcctccactggtggcggcaagcccctggccaggggctggagtggatgggacttattaagccggtgtacggcgcggtcaattatgctcgccagtttcaggggagaatccaactgacccgggacatttaccgcgaaatcgccttcctcgatctgtctggacttagaacagacgataccgccgtgtattactgtgctcgggacgagagcggcgatgacctgaaatggcatctccacccctggggccaggggacacaggttattgtgtcccct

SEQ ID NO: 41037 - RNA, 366 nt, synthetic construct
  misc_feature 1..366: note = derived and/or modified sequence opt5 from anti-HIV-1_HeavyChain
  source 1..366: mol_type = other RNA
caggtgcacctggagcaaagcggctccgtcgttagatggcccggggcctctctcaccctgagctgcacagcttccggatacatcttcgtgaactatcatattcactggcttcggcaggcccctggccagcgcctggaactcatggggacgatcaatccggtgggaggcgcgacctcttacacacagagatttcgggggcgcctggtccttaccagagacattggaagcaacacagtgaccctgctcctgaatcatctgcggtccgatgactctgctgtttatttctgtgcccgcgagagcaacgcctccggcagaggccggagcatggatcactgggggcgcggatctcatgtgatcgtctccccc

SEQ ID NO: 41038 - RNA, 366 nt, synthetic construct
  misc_feature 1..366: note = derived and/or modified sequence opt5 from anti-HIV-1_HeavyChain
  source 1..366: mol_type = other RNA
agccagcacctggtgcaatccggcacccaggtcaagaaacccggggcctctgttagagtgagctgccaggcttccggatacacattcacgaactatatcctccattggtggcggcaggcccctggccaagggctggagtggatgggacttattaagccggtgtacggcgcggtcaattatgctcgccagtttcaggggagaatccagctgacccgggacatttaccgcgatatcgccttcctcgacctgtctggacttagaagcgatgacacagccgtgtattactgtgctcgggatgaatccggcgacgatctgaaatggcacctccatccctggggccaagggacccaggttattgtgtctcct

SEQ ID NO: 41039 - RNA, 366 nt, synthetic construct
  misc_feature 1..366: note = derived and/or modified sequence opt5 from anti-HIV-1_HeavyChain
  source 1..366: mol_type = other RNA
agccagcaactggtgcagtccggcacccaggtcaagaaacccggggcctctgttagaatcagctgccaggcttccggatacacattcacggactatgtgctccactggtggcggcaagcccctggccaggggctggagtggatgggatggattaagccggtgtacggcgcgcgcaactatgctagacggtttcaggggcgcatcaatttcgatagagacatttaccgggaaatcgcctatatggatctttctggactgcgcagcgacgataccgccagatacttttgtgctcgggacggctccggcgatgacacatcttggcatctccacccctgggggcagggaaccctggtcattgtgagcgcc

SEQ ID NO: 41040 - RNA, 366 nt, synthetic construct
  misc_feature 1..366: note = derived and/or modified sequence opt5 from anti-HIV-1_HeavyChain
  source 1..366: mol_type = other RNA
caggtgcacctggagcaacccggcagcgtcgttagatggcctggggcctccctcaccctgtcttgcacagctagcggatacatcttcgtgaactatcatattcactggcttcggcaggccccgggccagcgcctggaactcctggggacgatcaatcccgtgggaggcgcgacctcctacgctcagaagtttagagggcggcttgtcctgacacgcgacattggatctagcaccgtgacactcctgctgaaccatctcagacgggatgactccgccgtttatttctgtgcccgcgagtctaatgctagcggcagaggccggtccatggatcactgggggcgcggaaaacctgtgatcgtcagcccc

SEQ ID NO: 41041 - RNA, 321 nt, synthetic construct
  misc_feature 1..321: note = derived and/or modified sequence opt5 from anti-HIV-1_HeavyChain
  source 1..321: mol_type = other RNA
gagatcgtgatgacccagagccccgccattctgtccgtctctcctggcgacagagctacattcagctgccgggcctcccaatctgttaagaacaatctcgcgtggtaccagaaacgcccggggcaggctcccagactgcttatctttgatgccagctcccgggcctctggcattcctgctcgcttcagcggagggggatccggcacggaatttaccctgacagtgaacagcatgcagtctgaggacttcgccacctattactgtcaacagtatgaagagtggcccagaacatttgggcagggaaccaaggtggaaatcatg

SEQ ID NO: 41042 - RNA, 321 nt, synthetic construct
  misc_feature 1..321: note = derived and/or modified sequence opt5 from anti-HIV-1_HeavyChain
  source 1..321: mol_type = other RNA
cagatcgtgctgacccaaagccctcccacactctccctgtctccgggcgagagagccacgcttagctgccgggcttcccagtctgtcaagaacaatctggcctggtaccagaaacgccccgggcaggcgcctagactcctgattttcgacaccagctcccgggcttctaacatccccgcccgctttagcggaggcgggtccggaacagagttcacccttacagttaatagcatgcaatctgaagattttgccacctattactgtcagcagtatgaagagtggcctagaacattcggccaggggaccaaggtggaaattatc

SEQ ID NO: 41043 - RNA, 321 nt, synthetic construct
  misc_feature 1..321: note = derived and/or modified sequence opt5 from anti-HIV-1_HeavyChain
  source 1..321: mol_type = other RNA
gagatcgtgatgacccagagccccgccgtcctgtccgtttctcctggcgacagagctacactcagctgccgggcctcccaatctgtgaagaacaatctggcgtggtaccagaaacgcccggggcaggctcccagacttctgattttcgatacgagctcccgggcctctaacatccctgcccgctttagcggaggcgggtccggaaccgagttcacactcaccgtgaatagcatgcagtctgaagactttgctacatattactgtcaacagtatgaagagtggcccagaaccttcggccaggggacaaaggtcgaaattaac

SEQ ID NO: 41044 - RNA, 321 nt, synthetic construct
  misc_feature 1..321: note = derived and/or modified sequence opt5 from anti-HIV-1_HeavyChain
  source 1..321: mol_type = other RNA
gagatcgtgctgacccagagccctcccacactctccgtctctccgggcgaagccgctacgctgagctgcagagcctcccaatctgttaagaacaatcttgcgtggtaccacctgaaagctgggcaggctccccggctcctgattttcgacgccagctcccgcgccggagatgcccctgctagagtgtctggcagcgggtatggaaccgagtttacacttaccgtgaactccgtccagagcgaagacttcggcgattactattgtcagcaatacgaggaatggccccggacatttgggcagggaaccaaggtggacctgcgc

SEQ ID NO: 41045 - RNA, 321 nt, synthetic construct
  misc_feature 1..321: note = derived and/or modified sequence opt5 from anti-HIV-1_HeavyChain
  source 1..321: mol_type = other RNA
gagatcgtgatgacccagagccctcccacactgtccgtctctccgggcgaaacggccaccctcagctgcagagcttcccaaaacgttaagaataacctggcctggtaccagcttaaacccgggcaggcgcctcggctgctcattttcgacgcttctagccgcgccggaggcatccccgatagattttccgggtctggatatggcacagacttcaccctgacagtgaatagcgtgcagtccgaggattttggggactacttctgtcaacagtatgaagagtggcctcggacctttggacagggcacaaaggtcgatcttcgc

SEQ ID NO: 41046 - RNA, 321 nt, synthetic construct
  misc_feature 1..321: note = derived and/or modified sequence opt5 from anti-HIV-1_HeavyChain
  source 1..321: mol_type = other RNA
gagatcgtgatgacccagagccccgccgtcctgtccgtttctcctggcgacagagctacactcagctgccgggcctcccaatctgtgaagaacaatctggcgtggtaccagaaacgcccggggcaggctcccagacttctgattttcgatacgagctcccgggcctctaacatccctgcccgctttagcggaggcgggtccggaaccgagttcacactcaccgtgaatagcatgcagtctgaagactttgctacatattactgtcaacagtatgaagagtggcccagaaccttcggccaggggacaaaggtcgaaattatc

SEQ ID NO: 41047 - RNA, 399 nt, synthetic construct
  misc_feature 1..399: note = derived and/or modified sequence opt5 from anti-HIV-1_HeavyChain
  source 1..399: mol_type = other RNA
gaggtgcatctgcaggaaagcggccccgggctcgtcagacctctggagaccctttccctgacatgcacggcctctggagctagcatccggggcggggaatggggagacaacgattaccactggggctgggttcgccactccccggagaaggggctcgaatggattggatctatccattggagaggcaccacacactataatgcccccttccggggccgcgcgaccctgagcattgacacatccagaaaccaatttttccttcggctgacctctatgacagctgatgacaccgccgtgtactattgtgtgaaacataagtaccacgatatcgtcatggtggttcctattgccgggtggtttgacccctggggacagggcctccaggtgacggtcagcgct

SEQ ID NO: 41048 - RNA, 399 nt, synthetic construct
  misc_feature 1..399: note = derived and/or modified sequence opt5 from anti-HIV-1_HeavyChain
  source 1..399: mol_type = other RNA
gaggtgcatctgcaggaaagcggccccgggctcgtcagacctctggagaccctttccctgacatgcacggcctctggagctagcatccggggcggggaatggggagacaacgattaccactggggctgggttcgccactccccggagaaggggctcgaatggattggatctatccattggagaggcaccacacactataatgcccccttccggggccgcgcgaccctgagcattgacacatccagaaaccaatttttccttcggctgacctctatgacagctgatgacaccgccgtgtactattgtgtgaaacataagtaccacgatatcgtcatggtggttcctattgccgggtggtttaatccctggggacagggcctccaggctacggtgcctagc

SEQ ID NO: 41049 - RNA, 399 nt, synthetic construct
  misc_feature 1..399: note = derived and/or modified sequence opt5 from anti-HIV-1_HeavyChain
  source 1..399: mol_type = other RNA
caggtgcaactgaaggagagcggccccgggctcgtcaaaccttccgaaaccctgtctcttacatgcacggttagcggaggctccatgagagggaccgactggggagagaacgatttccactacggctggatccggcattctagcgccgaagggctggagtggattggatccatccactggcgcggcacaacccattataagatgtcttttagaagccgggctacaatttccatcgacaccagcaataaccgcttctctctcatgttttccttcgtgacagccgaagataccgcggtgtactattgtgctagacacaaataccatgacatttttcgggtcgtgccggttgccggctggttcgatccctgggggcagggactgcttgtgacggtcagctct

SEQ ID NO: 41050 - RNA, 399 nt, synthetic construct
  misc_feature 1..399: note = derived and/or modified sequence opt5 from anti-HIV-1_HeavyChain
  source 1..399: mol_type = other RNA
gaggtgcatctgcaggaaagcggccccgggctcgtcagacctctggagaccctttccctgacatgcacggcctctggagctagcatccggggcggggaatggggagacaacgattaccactggggctgggttcgccactccccggagaaggggctcgaatggattggatctatccattggagaggcaccacacactataatgcccccttccggggccgcgcgaccctgagcattgacacatccaaaaaccaattttctcttagactgaccagcatgacagctgatgacaccgccgtgtactattgtgtgaagcataaataccacgatatcgtcatggtggttcctttcgccgggtggtttgacccctggggacagggcctccgggtgacggtctccgct

SEQ ID NO: 41051 - RNA, 399 nt, synthetic construct
  misc_feature 1..399: note = derived and/or modified sequence opt5 from anti-HIV-1_HeavyChain
  source 1..399: mol_type = other RNA
gaggtgcatctgcaggaaagcggccccgggctcgtcagacctctggagaccctttccctgacatgcacggcctctggagctagcatccggggcggggaatggggagacaacgattaccactggggctgggttcgccactccccggagaaggggctcgaatggattggatctatccattggagaggcaccacacactataatgcccccttccggggccgcgcgaccctgagcattgacacatccaaaaaccaatttttccttagactgacctctatgacagctgatgacaccgccgtgtactattgtgtgaagcataaataccacgatatctgcatggtcgtgcctattgccgggtggtttgacccctggggacagggcctccaggttacggtgagccag

SEQ ID NO: 41052 - RNA, 399 nt, synthetic construct
  misc_feature 1..399: note = derived and/or modified sequence opt5 from anti-HIV-1_HeavyChain
  source 1..399: mol_type = other RNA
caggtgcatctgcaagagagcggccccgggctcgtcagacctctggaaaccctttccctgacatgcacggcctctggagctagcatccggggcggggagtggggagacaacgattaccactggggctgggttcgccactccccggaaaaggggctcgagtggattggatctatccattggagaggcaccacacactataatgcccccttccggggccgcgcgaccctgagcattgacacatccagaaaccagtttttccttcggctgacctctatgacagctgatgacaccgccgtgtactattgtgtgaaacataagtaccacgatatcgtcatggtggttcctattgccgggtggtttgacccctggggacagggcctccaggtgacggtcagctcc

SEQ ID NO: 41053 - RNA, 399 nt, synthetic construct
  misc_feature 1..399: note = derived and/or modified sequence opt5 from anti-HIV-1_HeavyChain
  source 1..399: mol_type = other RNA
caggtgcatctgcaagagagcggccccgggctcgtcagacctctggaaaccctttccctgacatgcacggcctctggagctagcatccggggcggggagtggggagacaacgattaccactggggctgggttcgccactccccggaaaaggggctcgagtggattggatctatccattggagaggcaccacacactataatgcccccttccggggccgcgcgaccctgagcattgacacatccagaaaccagtttttccttcggctgacctctatgacagctgatgacaccgccgtgtactattgtgtgaaacataagtaccacgatatcgtcatggtggttcctattgccgggtggtttgacccctggggacagggcctccgcgtgacggtcagccag

SEQ ID NO: 41054 - RNA, 399 nt, synthetic construct
  misc_feature 1..399: note = derived and/or modified sequence opt5 from anti-HIV-1_HeavyChain
  source 1..399: mol_type = other RNA
caggtgcatctgcaagagagcggccccgggctcgtcagacctctggaaaccctttccctgacatgcacggcctctggagctagcatccggggcggggagtggggagacaacgattaccactggggctgggttcgccactccccggggaagggactcgaatggattggctctatccattggagaggcaccacacactataatgcccccttccgggggcgcgcgaccctgagcattgacacatttagaaaccagttctttcttcggctgacctccatgacagctgatgacaccgccgtgtactattgtgtgaaacataagtaccacgatatcgtcatggtggttcctattgccggatggttcgacccctggggccaggggctccaggtgacggtctctcaa

SEQ ID NO: 41055 - RNA, 399 nt, synthetic construct
  misc_feature 1..399: note = derived and/or modified sequence opt5 from anti-HIV-1_HeavyChain
  source 1..399: mol_type = other RNA
gaggtgcatctgcaggaaagcggccccgggctcgtcagacctctggagaccctttccctgacatgcacggcctctggagctagcatccggggcggggaatggggagacaacgattaccactggggctgggttcgccactccccggagaaggggctcgaatggattggatctatccattggagaggcaccacacactataatgcccccttccggggccgcgcgaccctgagcattgacacatccagaaaccaatttttccttcggctgacctctatgacagctgatgacaccgccgtgtactattgtgtgaaacataagtaccacgatatcgtcatggtggttcctattgccgggtggtttgacccctggggacagggcctccgcgggacggtgagcgct

SEQ ID NO: 41056 - RNA, 393 nt, synthetic construct
  misc_feature 1..393: note = derived and/or modified sequence opt5 from anti-HIV-1_HeavyChain
  source 1..393: mol_type = other RNA
caggtgcaactggtccagagcggcgccgttatcaagacccccgggtcctctgtgaaaattagctgcagagcttccggatacaacttccgggactattctatccactgggtgcgcctcattcctgataagggctttgagtggatcgggtggattaaaccgctgtggggagccgtcagctacgcgagacagcttcagggccgggtgtccatgacacgccaactgtctagagaccccgatgaccctgattggggagttgcttatatggagttcagcgggctcacgcccgccgacaccgccgaatacttttgtgtgcggcgcggctcctgcgattattgtggcgacttcccttggcagtactgggggcagggaacagtcgtggttgtgagctctgct

SEQ ID NO: 41057 - RNA, 393 nt, synthetic construct
  misc_feature 1..393: note = derived and/or modified sequence opt5 from anti-HIV-1_HeavyChain
  source 1..393: mol_type = other RNA
caggtgcaactggtccagagcggcgccgttatcaagacccccgggtcctctgtgaaactcagctgcagagcttccggatacaacttccgggactattctattcactgggtgcgcctgatccctgataagggctttgagtggattgggtggatcaaaccgctttggggagccgtcagctacgcgagacagctgcagggccgggtgtccatgacacgccaactctctcaggaccccgatgaccctgattggggagttgcttatatggagttcagcgggctgacgcccgccgacaccgccgaatacttttgtgtgagacggggctcctgcgattattgtggcgacttcccttggcagtactgggggcagggaacagtcgtggttgtgagctctgct

SEQ ID NO: 41058 - RNA, 303 nt, synthetic construct
  misc_feature 1..303: note = derived and/or modified sequence opt5 from anti-HIV-1_LightChain
  source 1..303: mol_type = other RNA
accgccggcctgacacagagccccgggacgctctccctgtctcctggagagagagctatccttagctgccggacctcccaatacggctctctggcctggtatcagcagcgcccggggcaggcgcccagactcgtgatttacgctggactgacacgggccaccggcatccctgaccgcttcagcgggtccagatggggagccgaatataaccttacaatttctaatctggagagcgaagattttggcgtctactattgtcaacagtacgacttctttggccaggggaccaaggttcaggtggat

SEQ ID NO: 41059 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggctccggggttaagaaactcggagcctctgtgagagtgagctgctggacctccgaggacatcttcgaacggacagagctgattcactgggtccgccaggctcccggccaggggcttgaatggatcggatgggtgaaggccgtttctggcgcggtgaactacgggagcctggattttagacatcgggtctccctcacgcgcgacagagatctgtctaccgctcacatggacattcggggacttacacaagatgacaccgccacatatttctgtgcccgccagaaatttgctagaggcgatcagggctggttctttgacctgtgggggcggggaaccctcatcgtggttagctccgcc

SEQ ID NO: 41060 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggctccggggttaagaaactcggagcctctgtgagagtgagctgctggacctccgaggacatcttcgaacggacagagctgattcactgggtccgccaggctcccggccaggggcttgaatggatcggatgggtgaaggccgttacgggcaccgtgaactttgggtctctgaatttcagacaacgggtcagcctcacacgcgatagagacctgtttaccgcgcatatggatattcggggacttacacagggcgacaccgctacatacttctgtgcccgccagaaatttgagaagtataccggcgggcagggatggtacttcgatctgtggggcagagggacgctcatcgtggtttcctctgcc

SEQ ID NO: 41061 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggctccgccatgaagaaacccggggcttctgttagagtgagctgctggacctccgaggacatcttcgatacaacggaactcatttactgggtgcggcaggcccctggacagggcctggagtggatcgggtgggtcaagattgtgtctggaaccgttaactttgcgagccttgacttccgcaatagaatctccctgtctcgggatcgcgacctctttacagctcacatggatattagaggcctgacccaaggggacacagccacctatttctgtgcccggcagaaattttacgctggaggccagggctggtatttcgatctttgggggcgcggaacactgatcgtggtcagctccgcc

SEQ ID NO: 41062 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagctcacatggatattagaggcctgacccaagacgatacagccacctatttttgtgcccggcagaaattcgagagccgctacacagggggacagggctggtattttgacctttggggcagagggacccatatcgtcgtgtccagcgct

SEQ ID NO: 41063 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccagagcggctccgccatgaagaaacccggggcttctgttagagtgagctgctggacctccgaggacatcttcgaacggacagagctcatttactgggtgcgccaggcccctggaagaggcctggaatggatcgggtgggtcaagacggtgtctggaaccgttaactttggcagctccgatttccggaatcgcatttctcttacaagagaccgggatctgagcaccgcgcacatggacatccgcgggctcacacaggatgacaccgctacatatttttgtgccagacaaaaattcgagtccctgtacagcgatgaccagggatcttattttgatctttggggccggggcaccctgattatcgtgtccagcgcc

SEQ ID NO: 41064 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccagagcggcctcgaggttaagaaacccggggcctccgtgagagtgtcttgctggaccagcgaagacatcttcgatacaacggagctgatttactgggtccggcaggctcctggacagggccttgaatggatcgggtgggtgaagattgtttccggaaccgtgaactttgcctctctggacttccgcaatagaatcagcctctcccgggatcgcgacctgtctacagcgcacatggatattagaggccttacccaagacgatacagctacctatttttgtgcccggcagaaattcgccagccgctactccggggaccagggaagctattttgatctgtggggcagaggcacactcatcatcgtctcttccgct

SEQ ID NO: 41065 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccagagcgcctccggcgttagacggcccggggcttctgtgcgcgtgagctgctggacctccgaggacatcttcgaaagatctgagctcatttactgggtccggcaggcccctggacgcggcctggaatggatcgggtggattaaacttgtgagcggagcggttaactttggctccgtggatttcagagaccgggtctctctgacacgcgatagagacctctttacggctcacatggatatccgggggctgacccaggacgatacagccacctatttctgtgcccgccaaaagtttgctagcagatactccggagaccagggcagctatttcgatctttggggccgggggacactgattatcgtgtcttccgcc

SEQ ID NO: 41066 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggctccggggttaagaaacccggagcctctgtgagagtgagctgctggacctccgagggcatcttcgaaaagtctgagctcattcactgggtccggcaggctcctgggcagggactggaatggatcggctgggtgaaaacagttacgggggccgtgaactttggacatcaaattagcgaccgcgtctcccttaccagagatcgggacctgttcacagcgcacatggatatccgcggcctcacccagggcgacacagctacctacttttgtgccagacagaagttcgagcgcgggggacagggctggatttttgatctgtgggggcggggaacacttatcgccgtgtctagcgct

SEQ ID NO: 41067 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagaaacccggggcttccgtgagagtgtcttgctggaccagcgaagacatcttcgagaagtccgaactcattcactgggtccggcaggcccctggacagggcctggagtggatcgggtgggtgaaaacagttacgggagcggtgaactttggctctagcgatttccgccaaagagtctcccttacccgggaccgcgatctgtttacagctcatatggacattagagggctcacccagggagatacagccacctacttctgtgcccggcagaagtttgaacgcggcggccaggggtggtatttcgacctgtggggaagaggcacacttatcgtggtttctagcgct

SEQ ID NO: 41068 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagagacccggggcttccgtgaaagtgtcttgctggaccagcgaagacatcttcgagcggacagaactcattcactgggtccgccaggcccctggacagggcctggagtggatcgggtgggtgaagacggtttccggagcggtgaactttggctctccgaatttcagacatcgggtcagccttacccgcgatagagacctgtttacagctcacatggatattcgggggctcacccaaggagacacagccacctacttctgtgcccgccagaaatttgaaagaggcggccaggggtggtatttcgatctgtggggacggggcacacttatcgtggtttcctctgct

SEQ ID NO: 41069 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggctccggggttaagaaacccggagcctctgtgagagtgagctgctggacctccgaggacatcttcgaaggctctgagctcattcactgggtccggcaggctcctgggcagggactggaatggatcggctgggtgaagacagttacgggggccgtgaactttggaagcgcgtacttccgccatagagtctcccttacccgggatcgcgacctgtttacagctcacatggatattagaggcctcacccaaggcgacacagccacctatttctgtgcccggcagaaatttatgtctgggggacagggctggtacttcgatctgtgggggcgcggaacagtgatcgttgtgagctccgct

SEQ ID NO: 41070 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccccagcggctccggggttaagaaacctggagcctctgtgagagtgagctgctggacctccgaggacatcttcgaacggacagagctcattcactgggtccgccaggctccgggccaggggctggaatggatcggatgggtgaagacggttaccggcgccgtgaactttgggtctcttgatttcagacatcggattagcctgacacgcgacagagatctctttaccgcgcacatggacatccggggactgacacagggcgataccgctacatacttctgtgcccgccaaaaatttgagtccagatataccggcgggcagggatggtacttcgacctttggggccgggggacgcatattgtcgtgtctagcgcc

SEQ ID NO: 41071 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggctccggggttaagaaagtgggagcctctgtgagagtcagctgctggacctccgaggacatcttcgaacggacagagctcattcactgggtgcgccaggctcccggccaggggctggaatggatcggatgggttaaggccgtgtctggcgcggtcaactacgggagccttgattttagacatcgggtgtccctgacgcgcgacagagatctcttcaccgctcacatggacattcggggactgacacaagatgacaccgccatctatttttgtgcccgccagaaattctacgctggcggccaggggtggtattttgatctttggggaagaggcacactgattgttgtgtctagcgcc

SEQ ID NO: 41072 - RNA, 387 nt, synthetic construct
  misc_feature 1..387: note = derived and/or modified sequence opt5 from anti-HIV-1_HeavyChain
  source 1..387: mol_type = other RNA
caggtgcaactggtccagagcggcgccgaggttaagaaacccgggtcctctgtgagagtgagctgctggacctccgaagacatcttcgagcggacagaactcattcactgggtccgccaggctcctggacagggcctggagtggatcgggtgggtgaagacggttaccggagccgtgaactttggctctccgaatttcagacatcgggtcagccttacacgcgatagagacctgtttaccgcgcacatggatattcgggggctcacacaaggagacaccgctacatacttctgtgcccgccagaaatttgaatccagatattctggcgatcagggcagctacttcgacctgtgggggcggggaacccttatcattgtgtccagcgcc

SEQ ID NO: 41073 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatcggatgggtgaagccggttacgggcgctgtgaactttgggtctcccaatttccggcatcgcgtcagcctgaccagagaccgggatctttttacagcccacatggacattcgcggactgacccaaggcgatacagccacctatttctgtgctagacagaaatactatgccggcgggcagggatggtactttgacctctggggccgggggacactgatcgtggtttcctctgct

SEQ ID NO: 41074 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtccaggtgtcttgcaaggccagcggataccctttcaccaaatattacatgcactgggtgagacaggcgccgggccaagggctcgaatggatcggatgggtgaaggctgtttccggcgccgtgaactatgggtctctggactttcggcatcgcgtcagccttacaagagatcgggacctgtccacggcccacatggatattcgcggactcacccaggacgatacagctacctacttctgtgccagacagaaatttgctcggggcgaccagggctggttctttgatctgtgggggcgcggaacacttatcgtggtttctagcgcc

SEQ ID NO: 41075 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagggactcgaatggatcggctgggtgaagacggtttccggggctgtgaactttggatctctgaatttccggcatcgcgtcagccttaccagagaccgggatctgtttacagcccacatggacattcgcggcctcacccaaggcgatacagccacctatttctgtgctagacagaaatttgcccgcggggaccagggatggttctttgatctgtggggccgggggacacttatcgtggtttcctctgct

SEQ ID NO: 41076 - RNA, 402 nt, synthetic construct
  misc_feature 1..402: note = derived and/or modified sequence opt5 from anti-HIV-1_HeavyChain
  source 1..402: mol_type = other RNA
caggtgcaactggtccagagcggctccggggttaagaaacccggagcctctgtgagagtgagctgccgggcttccgaggacctcttcggcgatgaaatcatttacgacgatgaggtcatccactggctgcgccaggtgcctgggcagagaccggaatggatgggatggattcggcccaagaccggcgcccgcaaccaagcgagacagtttcagcctcggatctctcttacacgcgacagagctctgagcacggcctatctcgatcttaattccctgacctctgccgacagcgggacatacttctgtgctcggcagacctttaaacccgatttctattttgccgaccaaggatggtccttcaacctgtggggccgcggcgctcattttattgttagctctgcc

SEQ ID NO: 41077 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgggggagttaagaaacccggcgcctccgcttctttcagctgcagaacctccgaggacccttttgataacgaatttttcgactctgagttcatgcactgggtgcggctcacaccggggcagcgccccgaatggatgggatggatgaatcctagaagcggcggggtgaactacgccggacagtttcggccccgcatgtccatgtggagagatcgggagctgtctacggcgtatatggaacttcgcgacctgaccttcgctgatacaggcctctacttttgtgccagacggaaggaggacgattatgactggtactatgatctgtggggccgcggggcccatatcattgtcagcgctgcc

SEQ ID NO: 41078 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccaggccggcgggggagttaagaaacccggcgctagcgtgaccctctcctgcaagacagccgacgaggatgtgttcgacgcggcttacatgcactgggtcagacaggcccctgggcagacgtttgaatggctgggatggatgaaaccggtgaccggcgccgttaactatgctcggaagttccaagggcgcgtgtctttttacagaacacgggagcttggaatcgcctatatggatctgcgcaatctcagattcgacgataccgctgtctacttttgtgcccggaaaacagcgggcgacgtgagcggcgataagcgcgggttctttttcgacctgtggggaagaggctcccgggttattgtgtctagcgcc

SEQ ID NO: 41079 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggcgccgaggttaagaaacccggggcttccgtgaccctctcttgcaagacagccgacgaagatgtgttcgacgcggcttacatgcactgggtcagacaggcccctggacagacgtttgagtggctgggctggatgaaaccggtgaccggggccgttagctatgctcggaagttccaaggacgcgtgtccttttacatgacaagagaacttggcatggcctatatggatctgcggaacctccgcttcgacgataccgctgtctacttttgtgccagaaaaacagcgggggacgtgtctggagataatcggggctatttctttgacctgtggggccgcgggagcagagttatcgtgtcctctgcc

SEQ ID NO: 41080 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcgaggccgaagttaagaaacccggcgcttccatgaccgtgtcttgcgagacagccgacgaagatatcttcgacgcggcttacatgcactgggtgagacaggcccctgggcagacgtttgagtggctcggatggatgaagccggtcaccggcgccgtgaactatgctcggaaattccaagggcgcattagcttttacagaacacgggaactggccatcgcttatatggatcttcgcgacctgagattcgatgacaccgccgtttacttttgtgcgcggaagacagccggagatgtgtccggcgacaatcgcgggtatttctttgatctctggggaagaggctctcgggtcattgtgagctccgct

SEQ ID NO: 41081 - RNA, 420 nt, synthetic construct
  misc_feature 1..420: note = derived and/or modified sequence opt5 from anti-HIV-1_HeavyChain
  source 1..420: mol_type = other RNA
cagagccacctggagcaatccggctctgccatgaagaaacccggggctagcgtgagagtctcctgctggacctctgaagacatcttcgatacaacggagctcctgtgggttcggcaggcccctggacagggccttgaatggattgggtgggtgaagatcgtgagcggaaccgtcaactttgcgtccctggacttccgcaatagaatttctctcagccgggatcgcgacctgtccacagctcatatggatatcagaggccttacccaggacgatacagccacctactattgtgcccggcaaaaatttgctagccgctactctggggaccagggatcctatttcgatctgtggggcagaggcacactcattatcgtgagctctgcctccaccaaggggccgagcgtttttccccacgacctg

SEQ ID NO: 41082 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtttaccgcgcatatggacatccgcgggctcacacagggagataccgctacatatttctgtgccagacagaaatttgaacggggcggccaagggtggtacttcgacctgtggggacgcggcacccttattgtggtttccagcgcctctacgaacgggccgatcggactgccccctagatccgct

SEQ ID NO: 41083 - RNA, 423 nt, synthetic construct
  misc_feature 1..423: note = derived and/or modified sequence opt5 from anti-HIV-1_HeavyChain
  source 1..423: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagcctgtattccgacgatcagggcagctacttcgacctttgggggcgcggaacactgatcattgtgtcttccgctagcaccaaaggcccgtcttccagccccacgatctgc

SEQ ID NO: 41084 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagcgcttccaccaagggacccagcgtgtttcctcacgacctgcgc

SEQ ID NO: 41085 - RNA, 411 nt, synthetic construct
  misc_feature 1..411: note = derived and/or modified sequence opt5 from anti-HIV-1_HeavyChain
  source 1..411: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagctccctgcaccagggacccagcggcctccctcatgac

SEQ ID NO: 41086 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttccccatgatctgaga

SEQ ID NO: 41087 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctactattgtgcccgccaaaaattcgaatctctgtacagcgatgaccagggctcctattttgatctttgggggagaggaacactgatcattgtgagctctgcttccaccaagggccccagcgtcttccctcacgacctccgg

SEQ ID NO: 41088 - RNA, 384 nt, synthetic construct
  misc_feature 1..384: note = derived and/or modified sequence opt5 from anti-HIV-1_HeavyChain
  source 1..384: mol_type = other RNA
caggtgcacctggagcaaagcggctccggggtcaagaaacccggagcctctgttagagtgagctgctggacctccgaagacatcttcgagaagtctgaactcattcattgggtgcggcaggctcctggccaggggctggagtggatcggatgggtcaaaacagtgacgggcgccgttaactttgggagctccgatttccgccagagagtgtctcttacccgggaccgcgatctgtttacagcgcacatggacattagaggactcacccaaggcgatacagctacctacttctgtgcccggcagaagtttgaaagccgctatacaggcgggcagggatggtacttcgacctgtggggcagagggacccatatcgtcgtgtccagc

SEQ ID NO: 41089 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgaactacgcccggaagttccagggccgcgtttctttttatagaacacgggaactggggatcgcttacatggatcttcgcaatctgagattcgacgataccgccgtgtatttttgtgcgcggaaaacagccggagacgtcagcggcgataagcgcggcttctttttcgacctctgggggagaggatcccgggtgattgtttctagcgcttccaccaagggcccctctgtgtttcctcatgatctgcgc

SEQ ID NO: 41090 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgccagaggcgatcaggggtggttctttgacctgtggggacggggcacgcttatcgtggtctcctctgctagcaccaaggggccctccgtgttccctacaatttgc

SEQ ID NO: 41091 - RNA, 411 nt, synthetic construct
  misc_feature 1..411: note = derived and/or modified sequence opt5 from anti-HIV-1_HeavyChain
  source 1..411: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatcggatgggtgaagccggttacgggcgctgtgaactttgggtctcccaatttccggcatcgcgtcagcctgaccagagaccgggatctttttacagcccacatggacattcgcggactgacccaaggcgatacagccacctatttctgtgctagacagaaatactatgccggcgggcagggatggtactttgacctctggggccgggggacactgatcgtggtttcctctgctagcaccaagggacctgtggtcttccccacgatttgc

SEQ ID NO: 41092 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccgggtgattgtttctagc

SEQ ID NO: 41093 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatggattaagacggtgaccggcgcggtcaactttgggtctcttgatttcagacaccggatcagcctgacacgcgacagagatctctttaccgctcatatggacattcggggactgacacagggcgataccgccacatacttctgtgcccgccaaaaatttgaatccagatataccggcgggcagggatggtacttcgacctttggggccgggggacgcacatcgtggtttctagc

SEQ ID NO: 41094 - RNA, 420 nt, synthetic construct
  misc_feature 1..420: note = derived and/or modified sequence opt5 from anti-HIV-1_HeavyChain
  source 1..420: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaacggggaggccaaggctggtactttgatctgtgggggcgcggaacccttattgtggttagctctgcctccacggagggcccgagcagatctttcccccagatcctgcgg

SEQ ID NO: 41095 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatctgcgtgagctccgccagcccgagagctcatcggtctagcccccgctccgcc

SEQ ID NO: 41096 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccgcggcgatacagccacctactattgtgccagacagaaattcgaatctcggtacacaggcgggcaaggatggtattttgacctttggggccgcgggacccacattgttgtgagctcc

SEQ ID NO: 41097 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattatcgttagctcc

SEQ ID NO: 41098 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacgagcatttttatcggatgtgaccggcctctcgataaggactggtccggccttgggggatctaaactgagcctggccccgtccattttcgcgagcctcgattttcgcaacagaatctctctgtcccgggaccgcgatcttagcaccgcttacatggacattagaggcctgacacaggatgacaccgccacatatttctgcgcccggcagaagtttgcttctcgctactccggggatcagggaagctatttcgacctctggggcagaggcaccctgatcgttgtgtcttccgccagcacaaaagggccctccgtgtttcctcatgatctg

SEQ ID NO: 41099 - RNA, 399 nt, synthetic construct
  misc_feature 1..399: note = derived and/or modified sequence opt5 from anti-HIV-1_HeavyChain
  source 1..399: mol_type = other RNA
agagagtacctggaacagagcggcgggggagtgaagaaactcggcgcctccgtccgggtttcttgccgcgctagcgaggacctgttcggggatgaagtgatctatgacgatgagcttattcactggctgagacaagtgcccggacagcggcctgaatggatgggctggatccgcccgaagaccggggccagaaaccaggcgcggcagtttcaaccccgcattaatctctccagagaccgggctctgaacacagcctaccttgatctgtctagcctcacgtccgccgactctgctacctatttctgtgcccgccagacatttaaacctgatttctactttgctgaccagggatggagcttcaatctgtggggcagaggcgcccgggtcatcgtgtccagc

SEQ ID NO: 41100 - RNA, 384 nt, synthetic construct
  misc_feature 1..384: note = derived and/or modified sequence opt5 from anti-HIV-1_HeavyChain
  source 1..384: mol_type = other RNA
caggtgcacctggtccaaagcggcgccgaggttaagaaacccgggtcctctgtgagagtgagctgctggacctccgaagacatcttcgagcggacagaactcattcattgggtccgccaggctcctggacagggcctggagtggatcgggtgggtgaagacggttaccggagccgtgaactttggctctccgaatttcagacaccgggtcagccttacacgcgatagagacctgtttaccgcgcatatggatattcgggggctcacacagggagacaccgctacatacttctgtgcccgccaaaaatttgaatccagatattctggcgatcagggcagctacttcgacctgtgggggcggggaacccttatcattgtgtccagc

SEQ ID NO: 41101 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgcctccacaaagggacccagcgtctttcctaccatctgc

SEQ ID NO: 41102 - RNA, 441 nt, synthetic construct
  misc_feature 1..441: note = derived and/or modified sequence opt5 from anti-HIV-1_HeavyChain
  source 1..441: mol_type = other RNA
agagagttcctggaacagagcggcgggggagtgaagaaactcggcgcctccctgcgggtctcttgccgcgctagcgaggacctttttggggatgagttcatctacgacgatgaagttattcactggctgagacaagtgcccggacagcggcctgaatggatgggctggatccgcccgaagaccggggccagaaaccaggcgacacagtttcaaccccggatttccctcacgcgcgacagagctctgtctaccgcctatcttgatctgaatagcctcacatccgccgactctggaacctacttctgtgctcggcagacatttaaacctgatttctattttgccgaccagggctggagcttcaacctgtggggccgcggggctcattttatcgtgtccagcgcctctaccaagggaccctccgtcttccctcacgatagcgcg

SEQ ID NO: 41103 - RNA, 399 nt, synthetic construct
  misc_feature 1..399: note = derived and/or modified sequence opt5 from anti-HIV-1_HeavyChain
  source 1..399: mol_type = other RNA
agagagtacctggaacagagcggcgggggagtgaagaaactcggcgcctccctgcgggtctcttgccgcgctagcgaggaccttttcggggatgaaatcatttatgacgatgaggttatccactggctgagacaagtgcccggacagcggcctgaatggatgggctggattcgcccgaagaccggggccagaaaccaggcgcggcagtttcaaccccgcatctccctcacaagagaccgggctctgtctacggcctaccttgatctgaatagcctcacctccgccgactctggaacatatttctgtgctcgccagacctttaaacctgatttctactttgccgaccagggctggagcttcaacctgtggggcagaggggctcattttattgtgtccagc

SEQ ID NO: 41104 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctcc

SEQ ID NO: 41105 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctctagagtgatcgttagctcc

SEQ ID NO: 41106 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggcaccggggtgaagaaacccggagcttccgtcagagtttcttgctggacaagcgaagacatcttcgagaagtccgaactcattcattgggtgcggcaggcccctggccaggggctggagtggatcggatgggtgaaaattgtctctggcgcggtgaactttgggagcccgaatttccgccagagagtttcccttacgcgggatcgcgacctgtttaccgctcaaatggatatcagaggactcacacagggcgacaccgccacatacttctgtgcccggcagaagtttgaacgcggcgggcagggatggattttcgatctgtggggcagagggacccttatcgctgtgtctagcgcctccacaaaaggacccagcgtctttcctcacgacctg

SEQ ID NO: 41107 - RNA, 399 nt, synthetic construct
  misc_feature 1..399: note = derived and/or modified sequence opt5 from anti-HIV-1_HeavyChain
  source 1..399: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctggg

SEQ ID NO: 41108 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacatgatcgcgacctgtttaccgctcacatggatattagaggactcacacagggcgacaccgccacatacttctgtgcccggcaaaaattttatgctggcgggcagggatggtacttcgatctgtggggccgcgggacccttatctgcgtgtcctctgccagcacgaagggaccctccggcctgcctcccagaagc

SEQ ID NO: 41109 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagcctgtactccgatgaccagggcagctatttcgatctctggggcagagggaccctgatcattgtgtcttccgccagcacaaagggaccttctgtctttccgcacgacctgcgg

SEQ ID NO: 41110 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctactattgtgcccgccaaaaattcgaaagaggcgggcagggatggtactttgatctgtggggccgggggacacttatcgtggtctctagcgcttccaccaagggacccagcgtgttccctacgatttat

SEQ ID NO: 41111 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctactattgtgcccgccaaaaattcgaatctagatacacaggcgggcagggatggtattttgacctttggggccgggggacccacattgttgtgagctcc

SEQ ID NO: 41112 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctattactgtgctcggcaaaaattctataaagggggacagggctggtactttgatctgtgggggcgcggaacacttatcgtggtctctagcgcctccaccaagggcccgagcgtgttccccacgatttgc

SEQ ID NO: 41113 - RNA, 399 nt, synthetic construct
  misc_feature 1..399: note = derived and/or modified sequence opt5 from anti-HIV-1_HeavyChain
  source 1..399: mol_type = other RNA
agagagtacctggaacagagcggcgggggagtgaagaaacccggcgcctccgtccgggtttcttgccgcgctagcgaggacctcttcggggatgaaatcatttatgacgatgaggtgatccactggctgagacaagtgcctggacagcggccggaatggatgggctggattcgccccaagaacgggggaagaaatcaggcccggcagtttcaacctcgcatctcccttaccagagaccgggcgctgaacacagcttacctcgatcttaattctctgacgagcgccgactccggcacctatttctgtgcccgccagacatttaaacccgatttctactttgctgaccagggctggtctttcaacctgtgggggagaggagcccgggtcattgtgagctcc

SEQ ID NO: 41114 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctcc

SEQ ID NO: 41115 - RNA, 420 nt, synthetic construct
  misc_feature 1..420: note = derived and/or modified sequence opt5 from anti-HIV-1_HeavyChain
  source 1..420: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctctagagtgatcgttagctccgcctctaccaaggggcccagcgtgttccctacaatttgc

SEQ ID NO: 41116 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagtctgacacagccacctatttctgtgctcggcaaaaattttacgccggcgggcagggatggtatttcgatctgtggggccgcgggacacttatcgtggtcagctccgctagcaccaagggaccgtctgtgtttccccacgacctgaga

SEQ ID NO: 41117 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtgagctctgcctccccgaaggggcccagcggactccctccccgctctgct

SEQ ID NO: 41118 - RNA, 411 nt, synthetic construct
  misc_feature 1..411: note = derived and/or modified sequence opt5 from anti-HIV-1_HeavyChain
  source 1..411: mol_type = other RNA
caggtgcaactggtccagagcggcgccgaggttaagaaacccggggcttccgtgaaggtgtcttgcaaagccagcggatacaccttcacaacgtatggcatctcctgggtcagacaggcgcctgggcagggactcgaatggattggctgggtgaagaccgttacaggggctgtgaactttggacaccaaatctctgaccgggtcagcctgacccgcgatagagaccttttcacagcccatatggatattcggggcctgacccagggcgacacagccacctacttttgtgctcgccagaaattctatgccgggggacagggctggtactttgatctctgggggagaggaacgctgatcgtggtttcctctgctagcaccaagggcccgtccgtgttcccccacgaccttcgg

SEQ ID NO: 41119 - RNA, 417 nt, synthetic construct
  misc_feature 1..417: note = derived and/or modified sequence opt5 from anti-HIV-1_HeavyChain
  source 1..417: mol_type = other RNA
caggcccaactggagcagagcggctccggggtgaagaaacccggagcttctgtcagagttagctgctggacctccgaagacatcttcgagcggacagaactcattcactgggtgcgccaggcccctggccaggggctggagtggatcggatgggtgaagacggtcaccggcgcggtgaactttgggtctagcgatttcagacaacgggtttcccttacacgcgacagagatctgtttaccgctcatatggacattcggggactcacacagggcgataccgccacatacttctgtgcccgccagaaattttatgctggcgggcagggatggtacttcgacctgtggggcagagggacccttatcgtggtctctagcgcctccacgaagggaccgagcgtgtttccccacgatctgcgg

SEQ ID NO: 41120 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatactattgtgcccgccaaaaattcgaaagaggcgggcagggatggtactttgatctgtggggccgggggacccttatcgtggtctcctct

SEQ ID NO: 41121 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctactattgtgcccggcagaagttcgaaagccgctacacaggcgggcagggatggtattttgacctgtggggcagagggacccatatcgtggtctccagc

SEQ ID NO: 41122 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctctgctagcacgaagggaccctccgtgtttcctaccatttgc

SEQ ID NO: 41123 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttcagaagcccggggcttccgtgaccgtgtcttgcaaagccagcggatacacactcatctcctatggcatttcttgggtcagacaggcgcctgggcaaggaccggaatggatgggctggatccggcccaagacgggggctcgcaaccaggccagacagttccagcctcggattagcctgacccgcgacagagccctttccacagcttacctggatctcaattctctgaccagcgccgactccggaacatatttttgtgctcggcaaaccttcaaacccgatttttacttcgccgaccagggctggagctttaacctttggggccgcggggcgcacttcatcgtgtcttcc

SEQ ID NO: 41124 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcctccggaagaaagagctgattcattgggtgcgccaggcccctggccaggggcttgaatggatcggatgggtgaagacagtcacgggcaccgtgaacttcgggtctagcgattttagacagcgggtttccctgacacgcgacagagatctcttcaccgcgcacatggacattcggggactgacacaaggcgataccgctacatacctttgtgcccgccagaaatttgagagaggcgggcagggatggatcttcgacctgtggggccgggggaccctcattgccgtgtctagcgcttccacgaagggaccgagcgtctttccccatgatctg

SEQ ID NO: 41125 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaatggaccgatcggcctgccccatcgctctgcc

SEQ ID NO: 41126 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcggcaagtctgagctcattcattgggtgcggcaggcccctgggcagggactggaatggatcggctgggtgaaaacagtcacgggggcggtgaactttggaagctccgatttccgccagagagtttctcttacccgggaccgcgatctgtttacagctcacatggacattagaggcctcacccaaggcgatacagccacctacttctgtgcccggcagaagtttgagagcctgtattccgacgatcaggggagctacttcgacctttggggacgcggcacactgatcattgtgtcttcc

SEQ ID NO: 41127 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggtatttcgatctgtggggccgggggacccttattgtggtctctagcgcttccacaaagggacccagcggcctgcctcatgggtctgcc

SEQ ID NO: 41128 - RNA, 423 nt, synthetic construct
  misc_feature 1..423: note = derived and/or modified sequence opt5 from anti-HIV-1_HeavyChain
  source 1..423: mol_type = other RNA
caggtgcaatacggcagagaggccggggctggaatgaagaaacccggcgccagcatgaccgtctcctgcaagacagcggacgaagatatcttcgacgctgcctatatgcaccgggttcgccaggcccctgggcagacgtttgagtggctgggatggatgaaaccggtgaccggcgctgtgaactacgccagacagttccaagggcgggtctctttttatcgcacaagagaactcggaattgcttacatggatctgcgggaccttaagttcgatgacaccgccgtgtatttttgtgcgcgcaaaacaaagggcgatgttagcggcgacgatagagggttctttttcgacctgtggggacggggcacccgcgtgatcgtctcctctgccagcacaaaggggccctccgtgtttcctaccatttac

SEQ ID NO: 41129 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgcacattgttgtgtctagcgcttccaccaagggaccgagcgtctttccccatgatctgcgc

SEQ ID NO: 41130 - RNA, 423 nt, synthetic construct
  misc_feature 1..423: note = derived and/or modified sequence opt5 from anti-HIV-1_HeavyChain
  source 1..423: mol_type = other RNA
caggtgcaactggtccagagcgaggccgaactcaagaaacccggcgcttccgtttctgtgagctgcaaggcctccgggtactctttcaccagctatggaatctcctgggtgagacaggtccctggccaggggctggagtggattgcgtggatccggccgaaaacaggagctcgcaaccaagccagacagtttcagccccggatttctcttacgcgcgacagagccctgagcaccgcttacctcgatcttaattccctgacaagcgccgactctggcacctatttctgtgctcggcagacatttaagcctgatttctactttgccgaccaagggtggtccttcaacctgtggggacgcggcgcgcactttatcgtgagctctgcctccaccaaaggccccagcgttttccctcatgatctcaga

SEQ ID NO: 41131 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatactattgtgcccgccaaaaattcgaaagaggcgggcagggatggtactttgatctgtggggccgggggacccttatcgtggtctcctctgctagcacgaagggaccctccgtgttccctcacgacctg

SEQ ID NO: 41132 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttcagaagcccggggcttccgtgaccgtgtcttgcaaagccagcggatacacactcatctcctatggcatttcttgggtcagacaggcgcctgggcaaggaccggaatggatgggctggatccggcccaagacgggggctcgcaaccaggccagacagttccagcctcggattagcctgacccgcgacagagccctttccacagcttacctggatctcaattctctgaccagcgccgactccggaacatattactgtgctcggcaaacctttaaacccgatttctattttgccgaccagggctggagcttcaacctttggggccgcggggcgcactttatcgtgtcttcc

SEQ ID NO: 41133 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgtgtttccgcagatttgc

SEQ ID NO: 41134 - RNA, 378 nt, synthetic construct
  misc_feature 1..378: note = derived and/or modified sequence opt5 from anti-HIV-1_HeavyChain
  source 1..378: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatctgcgtgtcctctgct

SEQ ID NO: 41135 - RNA, 438 nt, synthetic construct
  misc_feature 1..438: note = derived and/or modified sequence opt5 from anti-HIV-1_HeavyChain
  source 1..438: mol_type = other RNA
cagggctacctggcccaaagcgggggaggcgtgaagaaacccgggacctccgcttctttcagctgcagaacatccgacgatatctatgacaacgagtttttcgattctgcctttatgcactgggtccggctcattcctggacagcgcccggaatggatgggctggatgaatcccagaagcggggcggttaactacgctcggcagctgcagcctcgcgtgtccatgtatagagaccgggatctttctacggcctacctggacctcaatagcctgacctccgccgatagcggaacatatttctgtgctcgccaaacctttaagcccgacttctactttgccgatcagggctggtctttcaacctttggggcagaggggctcattttatcgtgtccagcgcctctacaaaaggaccttccgtcctgccccacgacctccgg

SEQ ID NO: 41136 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcacgcattgggtgcgccaggcccctggccaggggctggagtggattggatgggtgaagatcgtctctggcgcggtgaactttgggagcccgaatttcagacagcgggtttcccttacccgcgatagagacctgtttacagctcacatggatattcggggactcacccaaggcgacacagccacctacttctgtgcccgccagaaatttgaaagaggcgggcagggatggatcttcgatctgtggggccgggggacacttattgctgtgtctagcgcctccaccaagggacccagcgtctttcctcgctctgct

SEQ ID NO: 41137 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagaaagaactcattcattgggtgcggcaggcccctggccaggggctggagtggatcggatgggtgaagacagtcacgggcgcggtgaactttgggtctagcgatttccgccagagagtttcccttacccgggaccgcgatctgtttacagctcacatggacattagaggactcacccaaggcgatacagccacctacttctgtgcccggcagaaattttatgctggcgggcagggatggtacttcgacctgtggggccgcgggacacttatcgtggtctctagcgcctccaccaagggaccgagcgtgtttccccatgatctg

SEQ ID NO: 41138 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagccttgatttccgccacagaatttccctgacccgggaccgcgatctctttacagctcatatggacatcagaggactgacccagggcgatacagccacctactattgtgcccggcaaaagttcgaatctcgctacacaggcgggcagggatggtattttgacctttggggcagagggacccacattgttgtgagctcc

SEQ ID NO: 41139 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctactattgtgcccggcagaagttctacgctggcgggcagggatggtattttgacctgtggggccgcgggacacttatcgtggtcagctccgccagcaccaaaggaccgtctgtgttccccacgatttgc

SEQ ID NO: 41140 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagcctgtactccgatgaccagggcagctatttcgatctctggggcagagggaccctgatcattgtgtcttcc

SEQ ID NO: 41141 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaatttgaatctcgctacacagggggacagggctggtatttcgatctgtgggggagaggaacccacatcgtggtcagctccgccagcacgaagggcccgtctgtgtttccccatgaccttcgg

SEQ ID NO: 41142 - RNA, 408 nt, synthetic construct
  misc_feature 1..408: note = derived and/or modified sequence opt5 from anti-HIV-1_HeavyChain
  source 1..408: mol_type = other RNA
caggtgcaactggtccacagcggcgccgaggttaagaaacccggggcttccatgaaggtgtcttgcaaaaccagcggatactccttcacaggctattacatgcattgggtgagacaggcccctgggcagggactcgaatggatgggctggatcaacccgtctagcaatgacacgaactatgcgcagaagtttcaagggcgggtcaccatgacacgcgatacctccattaatacagcttacatggagctgtctagacttcggagcggagacaccgccatctatttctgtgcccgccagaaattttacgctggcggccaggggtggtatttcgatctgtggggaagaggcacactcattgtggtttccagcgcctctaccaaggggccctccgtgtttcctacgatctgc

SEQ ID NO: 41143 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggcgcttccaggggagagttagcttttatatgacacgggaactgggaatggcctacatggatcttcgcaacctgagattcgacgataccgctgtgtatttttgtgcccggaagacagcgggcgacgtctccggcgataatcgcgggtacttctttgacctctggggaagaggctctcgggtgatcgttagctcc

SEQ ID NO: 41144 - RNA, 414 nt, synthetic construct
  misc_feature 1..414: note = derived and/or modified sequence opt5 from anti-HIV-1_HeavyChain
  source 1..414: mol_type = other RNA
cagggcaccctggagcaaagctggtccgaagtgaagaaactcggggcctctgtcagagttagctgctggacatccgaggacatcttcaagacggaactgattcactgggtgcggcaggctcccggacagggccttgagtggatcgggggaatgaaagccgtgtctggcgcggtcaactacgggagcctggattttcgccatagagtgtccctcacccctgaccgggatctgtctacagctcacatggacattcgcggacttacccaggatgacacagccacctatttctgtgccagacaaaagtttgctcggggcgatcagggctggttctttgacctgtgggggcgcggaacactcatcgttgtgagctccgccagcaccaaaggcccgtctgtcttcccccatgatctgaga

SEQ ID NO: 41145 - RNA, 423 nt, synthetic construct
  misc_feature 1..423: note = derived and/or modified sequence opt5 from anti-HIV-1_HeavyChain
  source 1..423: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgctagccttgatttccgcaatagaatttccctgtctcgggaccgcgatctcagcaccgcctacatggacatcagagggctgacacaggatgacaccgccacatatttttgtgctcggcaaaagttcgcctcccgctacagcggagatcagggctcttattttgacctttggggcagagggaccctgatttgcgtttccagcgcttctacacgggcccaccgcctcccgcccagatccgcg

SEQ ID NO: 41146 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgctagaggcgatcaggggtggttctttgacctgtggggacggggcacccttatcgtggtctcctctgccagcccccgcgctcacagatccagccctcggtctgcc

SEQ ID NO: 41147 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttccccatgattccgct

SEQ ID NO: 41148 - RNA, 414 nt, synthetic construct
  misc_feature 1..414: note = derived and/or modified sequence opt5 from anti-HIV-1_HeavyChain
  source 1..414: mol_type = other RNA
caggcccacctggtgcaaagcggctccggggtcaagaaacccggagcttctgttagagtgagctgctggacctccgaggacatcttcaagtctgaactcattcattgggtgcggcaggcccctggccaggggctggagtggatcggatgggtcaaaacagtgacgggcgcggttaactttgggagctccgatttccgccagagagtgtctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtcgtgagctccgccagcaccaaaggaccgtctgtttttccccatgatctgaga

SEQ ID NO: 41149 - RNA, 414 nt, synthetic construct
  misc_feature 1..414: note = derived and/or modified sequence opt5 from anti-HIV-1_HeavyChain
  source 1..414: mol_type = other RNA
caggcccaactggagcagagcggctccggggtgaagaaacccggagcttctgtcagagttagctgctggacctccgaagacatcttcaagacagagctcattcactgggtgcggcaggcccctggccaggggctggaatggatcggatgggtgaaaacggtcaccggcgcggtgaactttgggtctccgaatttccgccatagagttagccttacacgggatcgcgacctgtttaccgctcacatggatattagaggactcacacaaggcgacaccgccacatacttctgtgcccggcagaagtttgagcgcggcgggcagggatggtatttcgatctgtggggcagagggacccttatcgtggtctcctctgctagcacgaaaggaccctccgtgtttcctcatgacctgcgg

SEQ ID NO: 41150 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggcagagaagtgaagaaacccggggcttccgtccgggtttcttgctggaccagcgaggacatcttcgaaaagtccgagctcattcattgggtgcgccaggcccctggacagggcctggaatggatcgggtgggtgaaaacagtcacgggagcggtgaactttggctctagcgatttcagacagcgggtttcccttacccgcgacagagatctgtttacagctcacatggacattcgggggctcacccaaggagatacagccacctacttctgtgcccgccagaagttttatgctggcggccaggggtggtacttcgacctgtggggaagaggcacacttatcgtggtctctagcgcctccaccaaagggccgagcgtgtttccccatgatctgcgg

SEQ ID NO: 41151 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccggatttcccttacccgcgatagagacctgtttacagctcatatggatatccggggactcacccagggcgacacagccacctactattgtgcccgccaaaaattcgaatctagatacacaggcgggcagggatggtattttgatctgtggggccgggggacccacattgttgtgagctcc

SEQ ID NO: 41152 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaagcccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctattactgtgctcggcaaaaattctataaagggggacagggctggtactttgatctgtgggggcgcggaacacttatcgtggtctctagc

SEQ ID NO: 41153 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggatacaccttcacagactattacctccactgggtcagacaggcgcctggccaggggctggattgggtgggatggatcaaccccaattccggcgggacgaactatgctcaaaagtttcagggacgggttgccatgacccgcgacacatctcttagctccgtgtacctggatctcaattctctgaccagcgccgactccggcacatatttctgtgctagacagacctttaaaccggatttctactttgccgaccagggctggagcttcaacctttgggggcggggagctcattttattgtctcttcc

SEQ ID NO: 41154 - RNA, 414 nt, synthetic construct
  misc_feature 1..414: note = derived and/or modified sequence opt5 from anti-HIV-1_HeavyChain
  source 1..414: mol_type = other RNA
caggccgacctggagcaaagcggctccggggtgaagaaacccggagcttctgtcagagttagctgctggacctccgaagatatcttcgagcggacaaactacgtgcactgggtgcgccaggcccctggcagagggctcgaatggattggatggtctaagacggtcaccggcgcggtgaattttgggagcccgaacttccggcatcgcgtttccctgacaagagaccgggatctttttaccgctcacatggacatccgcggactgacacagggcgataccgccacatatttctgtgccagacagaaatttgagcggggcgggcaaggatggtacttcgacctctggggccgcgggaccctgattgtggtctctagcgcttccacgaagggacccagcgtgtttcctcatgatctt

SEQ ID NO: 41155 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcagttccaagggcgcgtctctttttatagaacacgggaactcggaattgcctacatggatctgcgcgaccttaagttcgatgacaccgctgtgtatttttgtgccagaaaaacaaagggcgatgttagcggcgacgatcgggggttctttttcgacctgtggggacgcggcaccagagtgatcgtctcctct

SEQ ID NO: 41156 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtgagctct

SEQ ID NO: 41157 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaactcggagcttctgtcagagttagctgctggacctccgaagacatcttcgagcggacaaacctgattcattgggtgcgccaggcccccggccaggggcttgaatggatcggatgggtgaaggcggtctctggcgctgtgaattacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgttcccgcacgatctg

SEQ ID NO: 41158 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccggggaagacgtgttcgatgcggcttatatgcactgggtgagacaggcccctggacagacgtttgagtggctcggctggatgaaaccggtcaccggggccgtgaactacgctcggaagttccagggacgcgtttctttttatagaacacgggaactgggcatcgcctacatggaccttcgcaatctgagattcgatgacaccgctgtgtatttttgtgcccggaaaacagcgggcgatgtcagcggggacaagcgcggattctttttcgatctctggggcagagggtcccgggtgattgtttctagc

SEQ ID NO: 41159 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattacggtgagctct

SEQ ID NO: 41160 - RNA, 429 nt, synthetic construct
  misc_feature 1..429: note = derived and/or modified sequence opt5 from anti-HIV-1_HeavyChain
  source 1..429: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctggcctgccccctaccatctgccgc

SEQ ID NO: 41161 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgctcgcggcgaccaggggtggttctttgatctgtggggaagaggcacacttatcgtggtcagctccgccagcaccaaagggccgtctgtgttcccccatgacctgcgg

SEQ ID NO: 41162 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgaaagaggcgggcagggatggtatttcgatctgtggggccgggggacgcttatcgtggtctcctctgccagcaccaagggaccctccgtgtttcctcacgacctgcgc

SEQ ID NO: 41163 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcggaagagatctgtttaccgctcatatggacattcggggcctcacacagggcgataccgccacatactattgtgcccgccaaaaattcgaaagagggggacagggctggtactttgacctgtgggggcggggaacccttatcgtggtctcctctgctagcacgaagggcccctccgtgttccctcacgatctgcgc

SEQ ID NO: 41164 - RNA, 411 nt, synthetic construct
  misc_feature 1..411: note = derived and/or modified sequence opt5 from anti-HIV-1_HeavyChain
  source 1..411: mol_type = other RNA
caggcccacctgggcgctaactggagcggggtgaagaaactcggagcctccgtcagagtttcttgctggaccagcgaggacatcttcgaacggacagagctgattcattgggtgcgccaagcgcccggccaggggcttgaatggatcggatgggtgaaggctgtctccggcgccgtgaattacgggtctctggattttagacaccgggttagcctcacgcgcgacagagatctgtccaccgcccatatggacattcggggacttacacaggatgacaccgctacatatttctgtgcccgccagaaatttgctagaggcgatcaaggctggttctttgacctgtgggggcggggaaccctcatcgtggtctctagcgcctccacaaagggccctagcgtgttcccgcagatt

SEQ ID NO: 41165 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctcc

SEQ ID NO: 41166 - RNA, 423 nt, synthetic construct
  misc_feature 1..423: note = derived and/or modified sequence opt5 from anti-HIV-1_HeavyChain
  source 1..423: mol_type = other RNA
caggcccaactggagcagagcggcgtgggggtcaagaaacccggagcttccgttagagtgtcttgcctcgccagcgaagacatcttcaagaccgagctgattcactgggtgcggcaggcgcctggccaggggcttgaatggatcggatgggtcaaaacagtgacgggcgctgttaactttgggtcccaaattttccgccatagaatctctctgacccgggatcgcgacctctttacagcccacatggatattagaggactgacccagggcgacacagccacctacttctgtgctcggcagaagtttgagagccgctatacaggcgggcagggatggtacttcgatctttggggcagagggacccatatcgtggtctcctctgccagcacgaaaggaccgtccgtgtttccccacgacctgcgg

SEQ ID NO: 41167 - RNA, 411 nt, synthetic construct
  misc_feature 1..411: note = derived and/or modified sequence opt5 from anti-HIV-1_HeavyChain
  source 1..411: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgctcaccagattagcgatcgcgtttcccttaccagagaccgggatctgttcacagcccatatggacatccgcgggctcacccaaggagatacagccacctacttttgtgctagacagaagttctatgccggcggccaggggtggtactttgacctgtggggacggggcacacttattgtggtctctagcgcttccaccaaagggccgagcgtgttccccacgatctgc

SEQ ID NO: 41168 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatattacgctggcgggcagggatggtattttgatctgtggggcagagggacacttatctgcgtgtctagc

SEQ ID NO: 41169 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagc

SEQ ID NO: 41170 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatatttttgtgctagacagaaattcgcccggggcgatcaaggctggtttttcgacctgtgggggcgcggaaccctcatcgtggtctctagc

SEQ ID NO: 41171 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaaggggtgttcgatgcggcttatatgcactgggtgagacaggcccctggacagacgtttgagtggctcggctggatgaaaccggtcaccggggccgtgaactacgctcggaagttccagggacgcgtttctttttatagaacacgggaactgggcatcgcctacatggaccttcgcaatctgagattcgatgacaccgctgtgtatttttgtgcccggaaaacagcgggcgatgtcagcggggacaagcgcggattctttttcgatctctggggcagagggtcccgggtgattgtttctagc

SEQ ID NO: 41172 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaatactatgccgggggacagggctggtactttgatctgtgggggcgcggaacacttatcgtggtctctagc

SEQ ID NO: 41173 - RNA, 378 nt, synthetic construct
  misc_feature 1..378: note = derived and/or modified sequence opt5 from anti-HIV-1_HeavyChain
  source 1..378: mol_type = other RNA
caggtgtacatggagcaacccggcgtcgaagttaccaagcctggggccagcgtgacactgtcctgcaaaacggctgaggacgtgttcgatgccgcgtatatgcactgggtcagacaggctccgggacagacctttgaatggctcggctggatcaagcccgtgacaggggccgttaactacgcccggaaattccagggacgcgtgtctttttatagaacccgggagctgggcattgcttacatggaccttcgcaatctgagattcgatgacacagccgtctatttttgtgctcggaagaccgccggggatgtgagcggagacaaacgcggcttctttttcgatctctggggcagagggtcccgggttatcgtgtctagc

SEQ ID NO: 41174 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaacgcggcgggcagggatggatcttcgacctgtggggcagagggacacttattatcgtgagctcc

SEQ ID NO: 41175 - RNA, 384 nt, synthetic construct
  misc_feature 1..384: note = derived and/or modified sequence opt5 from anti-HIV-1_HeavyChain
  source 1..384: mol_type = other RNA
caggcccacctggtgcaaagcggctccgaggtcaagaaacccggggctttcgttagagtgtcttgctggaccagcgaagacatctttgaggaaacagagctcattcattgggtgcggcaggcccctggacagggcctggaatggatcgggtgggtcaagacggtgaccggagcggttaacttcggctcccttgattttcgccacagaatttctctgacacgggaccgcgatctcttcaccgctcatatggacatcagagggctgacacagggagataccgccacatacttttgtgcccggcaaaaattcgagagccgctataccggcggccaggggtggtactttgacctttggggaagaggcacgcacattgtggtctcctct

SEQ ID NO: 41176 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgcaaggcctccgaagacatcttcgagcggaccgaactcattcattgggtgcgccaggcgcctggccaggggctggagtggatcggatgggtgaaaacagtcacgggcgctgtgaactttgggtctccgaatttcagacaccgggttagccttacccgcgatagagacctgtttacagcccatatggatattcggggactcacccagggcgacacagccacctacttctgtgctcgccaaaagtttgaaagaggcgggcagggatggtatttcgatctgtggggccgggggacacttatcgtggtctcctct

SEQ ID NO: 41177 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccgaagtgaagaaacccggggcttctgtcagagttagctgctggacctccgaggacatcttcgaacggacagagctcattcattgggtgcgccaggcccctggacagggcctggaatggatcgggtgggtgaagacggtctctggagcggtgaactttggcagcccgaatttcagacaccgggtttcccttacccgcgatagagacctgtttacagctcatatggatattcgggggctcacccagggagacacagccacctacttctgtgcccgccaaaaatttgagagaggcggccaggggtggtatttcgatctgtggggacggggcacacttatcgtggtctctagc

SEQ ID NO: 41178 - RNA, 375 nt, synthetic construct
  misc_feature 1..375: note = derived and/or modified sequence opt5 from anti-HIV-1_HeavyChain
  source 1..375: mol_type = other RNA
caggcccacctggtgcaaagcggctccggggtcaagaaacccggagcttctgttagagtgagctgctggacctccgaggacatcttcgaaaagtctgagctcattcattgggtgcggcaggcccctggccaggggctggaatggatcggatgggtcaaaacagtgacgggcgcggttaactttgggagctccgatttccgccagagagtgtctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtcgtgagctcc

SEQ ID NO: 41179 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagaggcggccaggggtggtacttcgatctgtggggacggggcaccctcatctgcgtgagctcc

SEQ ID NO: 41180 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccagagcttctgtccgggttagctgctggacctccgaagacatcttcgagaagtctgaactcattcattgggtgcgccaggcccctggacagggcctggagtggatcgggtgggtgaaaacagtcacgggagcggtgaactttggcagctccgatttcagacagcgggtttctcttacccgcgacagagatctgtttacagctcacatggacattcgggggctcacccaaggagatacagccacctacttctgtgcccgccagaagttttatgctggcggccaggggtggtacttcgacctgtggggaagaggcacacttatcgtggtcagctcc

SEQ ID NO: 41181 - RNA, 381 nt, synthetic construct
  misc_feature 1..381: note = derived and/or modified sequence opt5 from anti-HIV-1_HeavyChain
  source 1..381: mol_type = other RNA
caggtgcaactggagcaggccggcgctggggtcaagaaacccggacctagcgttaccctctcctgcaagacagccgacgaagatgtgttcgacgcggcttacatgcactgggtgagacaggccccgggccagacgtttgagtggctggggtggatgaaacccgtcaccggagccgtgtcttatgctcggaagttccaaggccgcgttagcttttacatgacaagagaacttgggatggcctatatggatctgcggaacctccgcttcgacgataccgctgtgtacttttgtgccagaaaaacagcgggagacgtctccggcgataatcggggctatttctttgacctgtgggggcgcggatctagagtgatcgttagctcc

SEQ ID NO: 41182 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacagcgggtttcccttacccgcgatagagacctgtttacagctcacatggatattcggggactcacccaaggcgacacagccacctacttctgtgcccgccagaaattttatgctggcgggcagggatggtacttcgatctgtggggcagagggacacttatcgtggtctctagc

SEQ ID NO: 41183 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcgctgggatgaagaaacccggagccagcatgaccgtctcctgcaagacagcggacgaagatgtttttgacgctgcctacatgcactgggtgagacaggcccctggccagacgttcgagtggctggggtggatgaaaccggtgaccggagctgtcaactatgcccggaagtttcagggccgcgtgtctttctacagaacacgggaactcgggatcgcttatatggatctgcgcaatcttagatttgacgataccgccgtttacttctgtgcgcggaaaacagccggagacgtgagcggcgataagcgcggctttttctttgacctgtgggggagaggatcccgggtcattgtgtctagc

SEQ ID NO: 41184 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagccagctgctggacctccgaagacatcttcgagcggacagaactcattcattgggttcgccaggcgcctggccaggggctggagtggatcggatgggtgaagattgtgtctggcgctgtcaactttgggagcccgaatttcagacagcgggtgtcccttacgcgcgatagagacctgtttaccgcccacatggatatccggggactcacacaaggcgacaccgccacatacttctgtgctcgccagaaatttgaaagaggcgggcagggatggattttcgatctgtggggccgggggacccttatcgccgtttctagc

SEQ ID NO: 41185 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccgggggcagacgtttgagtggctgggatggatgaaacctgtgaccggcgccgtgaactacgctcgccagttccaagggagagtctctttttatcggacacgcgaactcggaattgcctacatggatctgagagaccttaagttcgatgacaccgctgtgtatttttgtgcccggaaaacaaagggcgatgttagcggcgacgatcgcgggttctttttcgacctgtggggaagaggcacccgggtgatcgtctcctct

SEQ ID NO: 41186 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggcgctggggtgaaggaacccggagcctccgtcagagtttcttgctggagctccgaggacatcttcgaacggaccgagctcattcattgggtgcgccaggcgcctggccaggggctggaatggatcggatgggtgaaaacagtcacgggcgctgtgaactttgggtctcttgatttcagacaccggattagcctgacccgcgacagagatctcctgacagcccatatggacatccggggacttacccagggcgatacagccacctacttttgtgctcgccaaaagttcgagtccagatatacaggcgggcagggatggtactttgacctgtggggccgggggacccacattgttgtgtctagc

SEQ ID NO: 41187 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggctccgccatgaagaaacccggggcttctgttagagtgagctgctggacctccgaggacatcttcgaacggacagagctcatttactgggtgcgccaggcccctggaagaggcctggaatggatcgggtgggtcaagacggtgtctggaaccgttaactttggcagctccgatttccggaatcgcatttctcttacaagagaccgggatctgagcaccgcgcacatggacatccgcgggctcacacaggatgacaccgctacatatttttgtgccagacaaaaattcgagtccctgtacagcgatgaccagggatcttattttgatctttggggccggggcaccctgattatcgtgtccagc

SEQ ID NO: 41188 - RNA, 384 nt, synthetic construct
  misc_feature 1..384: note = derived and/or modified sequence opt5 from anti-HIV-1_HeavyChain
  source 1..384: mol_type = other RNA
caggcccacctggtgcaaagcgcttccggcgtcaagagacccggggcctctgttcgggtgagctgctggacctccgaggacatcttcgaacgcacagagctcatttactgggtgagacaggcgcctggacagggcctggaatggatcgggtgggtcaaaacggtgtctggagctgttaactttggcagccaggatttccggcatcgcatttcccttaccagagaccgggatctgtttacagcccacatggacatccgcgggctcacccaaggagatacagccacctatttctgtgctagacagaagtttgagtctcggtacacaggcggccaggggtggtatttcgacctgtggggacgcggcacccatattgtggtcagctcc

SEQ ID NO: 41189 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataagcgggggttctttttcgacctctggggacgcggctctagagtgatcgttagctcc

SEQ ID NO: 41190 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaagcccggagcttctgtcagagttagctgctggacctccgaagacatcttcgagggctacatgattcattgggtgcggcaggcccctgggcagggactcgaatggatcggctgggtgaagacagtcacgggggcggtgaactttggatctgcttatttccgccacagagttagcctgacccgggatcgcgacctttttacagcccatatggatattagaggcctgacccagggcgacacagccacctacttctgtgctcggcaaaaattttataaagggggacagggctggtacttcgatctctgggggcgcggaacactgatcgtggtctcctct

SEQ ID NO: 41191 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatatttttgtgctagacagaaattcgcccggggcgatcaaggctggtttttcgacctgtgggggcgcggaaccctcatctgcgtgtctagc

SEQ ID NO: 41192 - RNA, 375 nt, synthetic construct
  misc_feature 1..375: note = derived and/or modified sequence opt5 from anti-HIV-1_HeavyChain
  source 1..375: mol_type = other RNA
caggcccacctggtgcaaagcggctccggggtcaagaaatctggagctagcgttagagtgtcctgctggacctctgaggacatcttcgaaaagagcgagctcattcattgggtgcggcaggcccccggccaggggctggaatggatcggatgggtcaaaacagtgacgggcgcggttaactttgggtcctctgatttccgccagagagtgagccttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtcgtgtccagc

SEQ ID NO: 41193 - RNA, 378 nt, synthetic construct
  misc_feature 1..378: note = derived and/or modified sequence opt5 from anti-HIV-1_HeavyChain
  source 1..378: mol_type = other RNA
caggtgtacatggagagagccggcgctggggtcaagaaacccggagccagcgttaccctgtcctgcaagacagcggacgaagatgtgttcggcgcttatatgcactgggtgcggcaagcccctgggcagacgtttgagtggctcggatggatgaaaccggtcaccggcgccgtgtcttacgctcgcaagttccaggggagagttagcttttatatgacacgggaactgggaatggcctacatggaccttcgcaacctgagattcgatgacaccgctgtgtatttttgtgcccggaaaacagcgggcgatgtctccggcgacaatcgcgggtacttctttgatctctggggaagaggctctcgggtgatcgttagctcc

SEQ ID NO: 41194 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaagcccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaattttacaaagggggacagggctggtatttcgatctgtgggggcgcggaacacttatcgtggtctctagc

SEQ ID NO: 41195 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcgtgagccttacaagagaccgggatctgtttaccgcgcatatggacattcgcgggctcacacaggatgacaccgctacatatttctgtgccagacagaaatttgcccggggagatcaaggctggttctttgacctgtggggccgcgggacccttatcgttgtgtccagc

SEQ ID NO: 41196 - RNA, 384 nt, synthetic construct
  misc_feature 1..384: note = derived and/or modified sequence opt5 from anti-HIV-1_HeavyChain
  source 1..384: mol_type = other RNA
caggcccacctggtgcaaagcggctccggggtcaagaaacccggagcttctgttagagtgagctgctggacctccgaggacatcttcgaacggacagagctcattcattgggtgcgccaggcccctggccaggggctggaatggatcggatgggtcaagacggtggcgggcgctgttaacttttctagccttgatttcagacaccggatttccctgacccgcgacagagatctctttacagcccatatggacatccgggggctgacccagggagatacagccacctacttctgtgctcgccaaaaatttgagtctagatatacaggcggccaggggtggtacttcgacctttggggacggggcacccacattgtggtcagctcc

SEQ ID NO: 41197 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaatctggagctagcgccagagtctcctgctggtctagcgaagacatcttcgagcggaccgaactcattcattgggttcgccaggcgcccggccaggggctggagtggatcggatgggtgaagacagtgacgggcgctgtcaactttgggtcccttgatttcagacaccggatttctctgacccgcgacagagatctctttacagcccatatggacatccggggactgacccagggcgatacagccacctacttctgtgctcgccaaaaatttgaaagcagatatacaggcgggcagggatggtacttcgacctttggggccgggggacccacattgtggtttccagc

SEQ ID NO: 41198 - RNA, 369 nt, synthetic construct
  misc_feature 1..369: note = derived and/or modified sequence opt5 from anti-HIV-1_HeavyChain
  source 1..369: mol_type = other RNA
ctgctccagctggtgcaaagcggcgccgaggtcaagaaacccggggcttccgttaaggtgacctgcaaagcctctggatacacattcacgggctatatccactgggtgagacaggcgcctgggcagggacttgaatggattggctgggtcaaggctgtgagcggggccgttaactacggatccctggactttcggcatcgcgtgtctctcacccacgatagagacctgagcacagcccatatggatatccggggccttacccaggacgatacagctacctatttctgtgcccgccaaaaatttgctagaggcgaccaggggtggttctttgatctgtggggacggggcacactcattgtcgtgtcctct

SEQ ID NO: 41199 - RNA, 369 nt, synthetic construct
  misc_feature 1..369: note = derived and/or modified sequence opt5 from anti-HIV-1_HeavyChain
  source 1..369: mol_type = other RNA
caggtgcaactggtccagagcggcgccgaggttaagaaaccgggggcttccgtgaaggtgtcttgcaaagccagcggatgtaccttcacaggctactatatgcactgggtcagacaggcgcctgggcagggactcgaatggatgggctggatcaaccccaattccgggggaacgaactacgctcaaaagtttcagggccgggtgaccatgacacgcgacacctctattagcacagcctatatggagctgtccagacttcggtctgatgacaccgccgtttactattgcgctcgccagaaattcgccagaggcgatcaggggtggtttttcgacctgtggggacggggcacactcatcgtggtcagctcc

SEQ ID NO: 41200 - RNA, 369 nt, synthetic construct
  misc_feature 1..369: note = derived and/or modified sequence opt5 from anti-HIV-1_HeavyChain
  source 1..369: mol_type = other RNA
caggtgcaactggtccagagcggcaccgagctcagaaagcccggggcctccgttaaagtgtcttgcaaggctagcggatacacattctccggctcttatatccactgggtgcggcaggcccctgggcagggactggaatgggtcggctggattaacccgagctccggggcgacgcaatgtgctaaaaagtttcaggacaaagtgaccatgacacgcgataccacaaataacaccgtttacatggaggtgaatagacttatctctgacgatacagccacctatttctgcgcccggcagaagtttgctcgcggagaccagggctggttctttgatctgtggggcagagggacgctcattgtcgtgagctcc

SEQ ID NO: 41201 - RNA, 372 nt, synthetic construct
  misc_feature 1..372: note = derived and/or modified sequence opt5 from anti-HIV-1_HeavyChain
  source 1..372: mol_type = other RNA
caggtgctgctcgtccaaagcggcgccgaggttaagaaacccgggtcctctgtgaaggtgagctgcaaaacctccggagactctctgacaaagtacgcccttcactgggctagacaggcgcctggccaggggctggaatggatcggatgggtcaaaacggtgaccggcgctgttaacttcgggagctccgattttcggcagcgcgtgtctctcacaagagaccgggatctgttcaccgcccatatggacattcgcggacttacacaaggcgataccgccacatatttttgtgctagacagaagttctacgccggcgggcagggatggtattttgacctgtggggccgggggaccctcatcgtcgtgagctcc

SEQ ID NO: 41202 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcaccgaggttaagacacccggggcctccgtgaaagtgtcttgcaaggctagcggatacacgttcaccaactatgacatcaattgggtcagacaggcccctggccaggggctcgaatggattggatgggtgaaaacagttaccggcgcggtgaactttgggtcctctgatttccggcaacgcgtcagcctgacaagagaccgggatctttttaccgctcacatggacatccgcggactgacacagggcgataccgccacgtacttctgtgccagacagaagttttatgctggcgggcagggatggtacttcgacctctggggccgggggaccctgattgtggtttcctct

SEQ ID NO: 41203 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgacgaggttaagaaacccggggcctccgtgaaggtgtcttgcaaagctagcggaaagggcttccctacctccctcgtcacatgggtgagacaggccccggggcagggactggaatggatcggctgggttaaagcggtgtctggggctgtcaactacggaagccttgattttcggcaccgcgtgtccctgacgagagaccgggatctcttcaccgcccatatggacattcgcggcctgacacaagatgacaccgccacatatttttgtgctagacagaagttcgcccggggcgatcaggggtggtttttcgacctttggggacgcggcaccctgatcgttgtgtctagc

SEQ ID NO: 41204 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccgggtcctctgtgaaggtgagctgcaaaacctccggagacatcctcacaaactacggcctgaattgggtcagacaggctcctgggcagggacttgaatggattggctgggtgaaggccgtttctggggcggtgaactatggaagcctggatttccggcaccgcgtctccctcacgagagaccgggatctgtctaccgctcatatggacatccgcggccttacacaagatgacaccgccacatacttttgtgccagacagaaattcgctcggggcgatcaggggtggtttttcgacctgtggggacgcggcaccctcattgtggttagctcc

SEQ ID NO: 41205 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgagagtgtcttgcaagaccagcggataccctttctcccggtatggcatctcttgggtccgccaggccccggggcagggactcgtgtggatggcgtgggttaaagctgtgagcggcgccgtcaactacgggtccctggactttagacaccgggtgtctcttacacgcgatagagacctgagcacggcccatatggatattcggggactcacccaagacgatacagctacctatttctgtgcccgccagaagtttgctagaggcgaccagggctggttctttgatctgtgggggcggggaacacttatcgttgtgtccagc

SEQ ID NO: 41206 - RNA, 372 nt, synthetic construct
  misc_feature 1..372: note = derived and/or modified sequence opt5 from anti-HIV-1_HeavyChain
  source 1..372: mol_type = other RNA
agagagcagctggtgcaaagcggcgccgaagtcaagaaacccggggcttccgttaaggtgtcttgcaaaaccagcggaaacacattcggctcctacgactttaattgggtgcggcaggcccctgggcagggactcgagtggatcggctgggtcaagattgtgtctggggcggttaacttcggaagcccgaattttcgccagagagtgtccctgacgcgggatcgcgaccttttcaccgctcacatggatatcagaggcctgacacaaggcgacaccgccacatatttttgtgcccggcagaaattcgaacgcgggggacagggctggatttttgatctctgggggagaggaaccctgatcgctgtctctagc

SEQ ID NO: 41207 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatcggatgggtgaagacggttaccggcgctgtgaactttgggtctccgaatttccggcatcgcgtcagcctgacaagagaccgggatctttttaccgcccacatggacattcgcggactgacacaaggcgataccgccacatatttctgtgctagacagaaatactatgccggcgggcagggatggtactttgacctctggggccgggggaccctgatcgtggtttcctct

SEQ ID NO: 41208 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatcggatgggtgaagacggttaccggcacagtgaactttgggtctctgaatttccggcaacgcgtcagccttaccagagaccgggatctgtttacagctcatatggacattcgcggactcacccagggcgatacagccacctatttctgtgccagacagaaatttgagcggggcgggcagggatggtacttcgacctgtggggccgcgggacgcttatcgtggtttcctct

SEQ ID NO: 41209 - RNA, 372 nt, synthetic construct
  misc_feature 1..372: note = derived and/or modified sequence opt5 from anti-HIV-1_HeavyChain
  source 1..372: mol_type = other RNA
caggtgcaactgggccagagcggggccgagatgaagaaacccggatcctctgtcaaggttagctgcaaggcttccggcgggaccttcagacactctcctatcagctgggtgcggcaggccccgggacagggcctcgaatggattgggtgggtgaaagcggtctccggagctgtgaactacggctctctggactttcgccatagagttagccttacacgggatcgcgacctgtccacggcccacatggatatcagaggcctcacccaagacgatacagccacctatttctgtgctcggcagaaatttgcccgcggggaccagggatggttctttgatctgtggggcagagggacacttattgtggtcagctct

SEQ ID NO: 41210 - RNA, 369 nt, synthetic construct
  misc_feature 1..369: note = derived and/or modified sequence opt5 from anti-HIV-1_HeavyChain
  source 1..369: mol_type = other RNA
caggtgcaactggtccagagcggcgccgaggttagaacccccggggcttccgtgaaggtgtcttgcaaagccagcggatacaacttcatcgcgtatcacgtccattgggtgcggcaggctcctggccaggggctcacatggatgggatggattaatccggactccggcgatacggtttacgcccaaaactttgtggaccgcgtcatgatgaccagaaatacatctatccagaccgtgtatctggaacttaacgttctgacactcgaggataccgccacatacttctgtgctcggcagaagtttgcccgcggggaccagggatggttctttgatctgtggggcagaggcacccttattgtggtcagctcc

SEQ ID NO: 41211 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgaaggtgtcttgcaaagccagcggatacaccttcacagtctattacatgcactgggtgagacaggcgcctggccgggggctcgaatggatcggatgggttaaggctgtgtccggcgccgtcaactatgggtctctggactttcgccatagagtgagccttacgcgggatcgcgacctgttcaccgcccacatggatattagaggactcacacaggacgataccgctacatacttttgtgcccggcaaaaattcgctcgcggcgaccagggctggtttttcgatctgtgggggagaggaacccttatcgttgtgtcctct

SEQ ID NO: 41212 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattcgaaagaggcgggcagggatggtactttgacctgtggggccgggggaccctcatcgtggtctctagc

SEQ ID NO: 41213 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgaaggtgtcttgcaaagccagcggatacaccttcatcggctattacatgcactgggtcagacaggcgcctgggcagggactcgaatggatgggctgggtgaagacagttacgggggctgtgaactttggatccccgaatttccggcatcgcgtctctctgaccagagaccgggatctttttacagcccacatggacattcgcggcctgacccaaggcgatacagccacctatttctgtgctagacagaaatttgagcgcgggggacagggctggtacttcgacctctgggggcggggaacactgatcgtggttagctcc

SEQ ID NO: 41214 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagccttaatttcagacaccgggtttccctgacccgcgatagagacctctttacagctcatatggatattcggggactgacccagggcgacacagccacctacttctgtgcccgccaaaaatttgctagaggcgatcaggggtggttctttgacctttggggacggggcacactgatcgtggtctctagc

SEQ ID NO: 41215 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaactcggagcttctgtcagagttagctgctggacctccgaagacatcttcaaggatcggattgaccattgggtgcgccaggcccccggccaggggctggagtggatcggatgggtgaaagcggtctctggcgctgtgaactacgggagccttgattttagacaccgggtttccctgacacgcgacagagatctcttcacggcccatatggacattcggggactgacccaggatgacacagccacctatttttgtgctcgccaaaagttcgccagaggcgatcagggctggtttttcgacctttgggggcggggaacactgatcgtggtctctagc

SEQ ID NO: 41216 - RNA, 375 nt, synthetic construct
  misc_feature 1..375: note = derived and/or modified sequence opt5 from anti-HIV-1_HeavyChain
  source 1..375: mol_type = other RNA
caggtgcaactggcccagagcggcgctgaggtcaagaaactcggggcctccgttagagtgtcttgctggaccagcgaagacatcttcgagcggacagaactgattcactgggtgcgccaggcgcccggacagggccttgagtggatcgggtgggtcaaggctgtgtccggagccgttaactacggctctctggattttagacatcgggtgagcctcacgcgcgacagagatctgttcaccgcccacatggacattcgggggcttacacaagatgacaccgctatctatttttgtgcccgccagaaattcgctagaggagatcagggctggtttttcgacctgtggggccgggggacactcattgtcgtgtcctct

SEQ ID NO: 41217 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatctctaaggccgagctcattcattgggtgcggcaggcgcctggccaggggctggaatggatcggatgggtgaaaacagtcagcggcgctgtgaacttcgggtccccgaattttcgccacagagtttctcttacgcgggatcgcgacctgttcaccgcccatatggatattagaggactcacacagggcgacaccgccacatacttttgtgctcggcaaaagttcgagcgcggcgggcagggatggtattttgatctgtggggcagagggacccttatcgtggtcagctcc

SEQ ID NO: 41218 - RNA, 372 nt, synthetic construct
  misc_feature 1..372: note = derived and/or modified sequence opt5 from anti-HIV-1_HeavyChain
  source 1..372: mol_type = other RNA
accgcccacctggagcagagcggctccggggtgagacggcccggagcttctgtccgcgttagctgctggacatccggcgacatcttcaagtctgaactcattcattgggtgagacaagcccctgggcagggactggagtggatcggctgggtgaaaacggtcaccggggcggtgaactttggaagctccgatttccggcagcgcgtttctcttacaagagaccgggatctgtttaccgctcacatggacattcgcggcctcacacagggcgataccgccacatacttctgtgccagacaaaagttttatgctgggggacagggctggtacttcgacctgtgggggcggggaacccttatcgtggtcagctcc

SEQ ID NO: 41219 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagagacccggagcttctgtccgggttagctgctggacctccgaagacatcttcaacacagagctcattcattgggtgcgccaggcccctggccaggggctggaatggatcggatgggtgaaaacggtctctggcgcggtgaattttgggagccttaacttcagacaccgggtttccctgacccgcgatagagacctctttacagctcatatggatattcggggactgacccagggcgacacagccacctacttctgtgcccgccaaaagtttgctagaggcgatcaggggtggttctttgacctttggggacggggcacactgatcgtggtctctagc

SEQ ID NO: 41220 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagacagagctcattcattgggtgcggcaggcccctggccaggggctggaatggatcggatgggtgaaagcggtctctggcgctgtgaactacgggagccttgattttcgccacagagtttccctgacgcgggaccgcgatctctctaccgcccatatggacattagaggactgacacaggatgacaccgccacatatttctgtgctcggcaaaagtttgcccgcggcgatcagggctggttctttgacctttgggggagaggaaccctgatcgtggtcagctcc

SEQ ID NO: 41221 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgagagtgtcttgcaaggccagcggatacaccttcacagcgtattacatccactgggtccggcaggctcctggccaggggctcgaatggattggatgggtgaaaacggtttccggcgccgtgaactttgggtctccgaatttccgccatagagtcagcctgacccgggaccgcgatctttttacagcccacatggacatcagaggactgacccaaggcgatacagctacctatttctgtgcccggcagaagtttgagcgcggcgggcagggatggtacttcgacctctggggcagagggacactgattgtggtttcctct

SEQ ID NO: 41222 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccgaatctaagaaacccggggctagcgtgagagtctcctgctggtctagcgaggacatcttcaagaccgaactcattcattgggttcggcaggcccctggacagggcctggagtggatcgggtgggtgaaaattgtgtccggagcggtcaactttggctctccgaatttccgccagagagtgagccttacacgggatcgcgacctgtttacggctcacatggatatcagagggctcacccaaggagacacagccacctacttctgtgcccggcagaagtttgaacgcggcggccaggggtggattttcgatctgtggggaagaggcacacttatcgctgtttccagc

SEQ ID NO: 41223 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccgaagtgaagaaacccggggcttctgtcagagttagctgctggacctccgaggacatcttcgaaaagtctgagctcattcattgggtgcggcaggcccctggacagggcctggaatggatcgggtgggtgaaaacagtcacgggagcggtgaactttggcagctccgatttccgccagagagtttctcttacccgggaccgcgatctgtttacagctcacatggacattagagggctcacccaaggagatacagccacctacttctgtgcccggcagaagttttatgctggcggccaggggtggtacttcgacctgtggggacgcggcacacttatcgtggtcagctcc

SEQ ID NO: 41224 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaagtgtgggctggcgtcaagaaactcggggccagcgttagagtgtcctgctggacctctgaagacatcttcaagacagagctgattcattgggtgcggcaggcgcccggacagggccttgaatggatcgggtgggtcaaagctgtgagcggagccgttaactacggctccctggattttcgccacagagtgtctctcacgcgggaccgcgatctgagcaccgcccatatggacattagagggcttacacaggatgacaccgctacatatttctgtgcccggcaaaagtttgctcgcggagatcagggctggttctttgacctgtggggcagagggaccctcatcgtcgtgtcctct

SEQ ID NO: 41225 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcaatttcagacagcgggtttcccttacccgcgatagagacctgtttacagctcacatggatattcggggactcacccaaggcgacacagccacctacttctgtgcccgccagaaattttatgctggcgggcagggatggtacttcgatctgtggggcagagggacacttatcgtggtctctagc

SEQ ID NO: 41226 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgccatagagtgtctctgacacgggatcgcgacctcagcaccgctcacatggatatcagaggcctgacacaggacgataccgccacatatttttgtgcccggcaaaaattcgctcgcggggaccagggatggtttttcgatctttggggcagaggcaccctgattgttgtgtccagc

SEQ ID NO: 41227 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgccagaggcgatcaggggtggttctttgacctgtggggacggggcacgcttatcgtggtctcctct

SEQ ID NO: 41228 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccggcgggatcttcgaacggacagagctcattcattgggtgcgccaggcccctggacagggcctggaatggatcgggtgggtgaagacggtcaccggagcggtgaactttggctctccgaatttcagacaccgggttagccttacacgcgacagagatctgtttaccgctcatatggacattcggggcctcacacagggggataccgccacatacttctgtgcccgccaaaaatttgagagaggaggccaggggtggtatttcgacctgtggggacggggcacccttatcgtggtctcctct

SEQ ID NO: 41229 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccaggatgacacagccacctacttctgtgcccgccaaaaatttgctagaggcgatcagggctggttctttgacctttgggggcggggaacactgattgttgtgtctagc

SEQ ID NO: 41230 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgagcgcggcgggcagggatggatcttcgacctgtggggcagagggacacttattgctgtgagctcc

SEQ ID NO: 41231 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtctctggcgcggtgaactttgggagccttaatttcagacaccgggtttccctgacacgcgatagagacctctttaccgctcatatggatattcggggactgacacagggcgacaccgccacatacttctgtgcccgccaaaagtttgctagaggcgatcaggggtggttctttgacctttggggacggggcaccctgatcgtggtctctagc

SEQ ID NO: 41232 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacagcgggtttccctcacgcgcgacagagatctgttcaccgcccacatggacattcggggacttacacaaggcgataccgccacatatttttgtgctcgccagaaattctacgccggcgggcagggatggtattttgacctgtggggcagagggaccctcatcgtggtctctagc

SEQ ID NO: 41233 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaaccttgttcaccagattagcgatcgcgtgtccctgaccagagaccgggatctctttacagctcatatggacatccgcgggctgacccaaggagatacagccacctacttctgtgccagacagaagttttatgctggcggccaggggtggtacttcgacctttggggacggggcacactgattgtcgtgtctagc

SEQ ID NO: 41234 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccggggacgcgacctgtttacagctcacatggatattagaggcctcacccaaggcgacacagccacctacttctgtgcccggcagaagttttatgctgggggacagggctggtacttcgatctgtgggggcgcggaacacttatcgtggtcagctcc

SEQ ID NO: 41235 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtcaccggcgctgtgaactttgggtccccgaatttcagacaccgggtttctcttacacgcgatagagacctgtttaccgcccatatggatattcggggactcacacagggcgacaccgccacatacttctgtgctcgccaaaaatttgaaagaggcgggcagggatggtatttcgatctgtggggccgggggacccttatcgtggtcagctcc

SEQ ID NO: 41236 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcattcattgggttcggcaggcccctggacagggcctggaatggatcgggtgggtgaaggcggtgagcggagctgtcaactacggctcccttgactttcgccacagagtgtctctgacccgggatcgcgacctcagcacagcccatatggatattagagggctgacccaggacgatacagccacctatttctgtgctcggcaaaaatttgcccgcggagaccagggctggttctttgatctttggggcagagggacactgatcgttgtgtccagc

SEQ ID NO: 41237 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagacagagctcattcattgggtgcggcaggcccctggccaggggctggaatggatcggatgggtgaaaacggtctctggcgcggtgaactttgggagcccgaatttccgccacagagtttcccttacccgggatcgcgacctgtttacagctcatatggatattagaggactcacccagggcgacacagccacctacttctgtgcccggcaaaagtttgagcgcggcgggcagggatggtatttcgatctgtggggcagagggacacttatcgtggtctctagc

SEQ ID NO: 41238 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaactcggagcctctgttagagtgagctgctggacctccgaagacatcttcgagcggacagaactgattcattgggtgcgccaggctcccggccaggggcttgagtggatcggatgggtcaaggccgtgtctggcgcggttaactacgggagcctggattttagacaccgggtgtccctcacgcgcgacagagatctgttcaccgctcatatggacattcggggacttacacaggatgacaccgccacatatttttgtgcccgccaaaaattcgctagaggcgatcagggctggtttttcgacctgtgggggcggggaaccctcatcgtcgtgtctagc

SEQ ID NO: 41239 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcagcggagctgtgaaccttgccccgaattttcggcagcgcgtttccctgacgagagatcgggacctcttcaccgcccatatggatattcgcggcctgacacaaggggacaccgctacatatttttgtgccagacagaagttcgaacggggaggccagggctggatctttgatctttgggggcgcggaaccctgattgctgtgtctagc

SEQ ID NO: 41240 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggacggagatctgtttacagctcacatggacattcgcggcctcacccaaggcgatacagccacctacttctgtgccagacagaagttttatgctgggggacagggctggtacttcgacctgtgggggcggggaacacttatcattgtgagctcc

SEQ ID NO: 41241 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgtctgaccgcgatctgagcaccgcccatatggacattagaggacttacacaggatgacaccgccacatatttctgtgctcggcaaaaatttgcccgcggcgatcagggctggttctttgacctgtgggggagaggaaccctcatcgtggtctccagc

SEQ ID NO: 41242 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgagcacagctcacatggacattagaggactcacccaagatgacacagccacctacttttgtgcccggcagaagttcgctcgcggcgatcagggctggtttttcgacctgtgggggagaggaacacttatcgtggtctccagc

SEQ ID NO: 41243 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgagcgcggcgggcagggatggtatttcgacctgtggggcagagggacacttatcgtggtcagctcc

SEQ ID NO: 41244 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggcaccagattagcgatcgcgtttcccttaccagagaccgggatctgttcacagctcatatggacatccgcggactcacccaaggcgatacagccacctacttttgtgccagacagaagttctatgctggcgggcagggatggtactttgacctgtggggccgggggacacttattgtggtctctagc

SEQ ID NO: 41245 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaagatgacacagccacctacttctgtgcccggcagaagtttgctcgcggcgatcagggctggttctttgacctgtgggggagaggaacacttatcgtggtcagctcc

SEQ ID NO: 41246 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaactcggagcttctgtcagagttagctgctggacctccgaagacatcctgaagacagagcttattcattgggtgcggcaggcccccggccaggggctggaatggatcggatgggtgaaagcggtctctggcgctgtgaactacgggagcctcgatttccgccacagagtttccctgacgcgggaccgcgatctttttaccgcccatatggacattagaggactgacacaggatgacaccgccacatatttctgtgctcggcaaaagtttgcccgcggcgatcagggctggttctttgacctctgggggagaggaaccctgatcgtggtctctagc

SEQ ID NO: 41247 - RNA, 372 nt, synthetic construct
  misc_feature 1..372: note = derived and/or modified sequence opt5 from anti-HIV-1_HeavyChain
  source 1..372: mol_type = other RNA
gtgagaagcgtcgttcagtgcgaggccggcgtgaagaaacccggggcttccgtgaagatctcttgtgccaccagcggatacgcgttcacactgtattacctccactgggtccggcaagctcctggccaggggctggaatggattggatgggtgaaaacggttaccggcgccgtgaactttgggtccgcctatttccgccatagagtctctcttacaccggaccgggatctgtttaccgctcacatggacatccgcggactcacacagggcgataccgccacatacttctgcgctagacagaagttttataaaggcgggcaaggatggtacttcgacctgtggggccgggggacccttattgtggttagctcc

SEQ ID NO: 41248 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgcctggactccgaagatatcttcgagcggaccgaacttattcattgggtgcgccaggcccccggccaggggctggagtggatcggatgggtgaaggcggtctctggcgctgtgaactacgggagcctcgactttagacaccgggtttccctgacacgcgatagagaccttttcacggcccatatggatattcggggactgacccaggacgatacagccacctatttttgtgctcgccaaaaattcgccagaggcgaccagggctggtttttcgatctctgggggcggggaacactgatcgtggtctctagc

SEQ ID NO: 41249 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctcgcggggaccagggatggtttttcgatctttggggcagaggcacactgatcgtggttagctct

SEQ ID NO: 41250 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcaagagctcctgctggacctctgaagacatcttcgagagaacagaactgattcattgggttcggcaggcccccggccaggggcttgagtggatcggatgggtgaaagcggtgagcggcgctgtcaactacgggtccctggattttcgccacagagtgtctctcacgcgggaccgcgatctgagcaccgcccatatggacattagaggacttacacaggatgacaccgccacatatttctgtgctcggcaaaagtttgcccgcggcgatcagggctggttctttgacctgtgggggagaggaaccctcatcgttgtgtccagc

SEQ ID NO: 41251 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagattgtctccggcgctgtgaactttgggtctccgaatttcagacagcgggttagccttacgcgcgatagagacctgtttaccgcccacatggatatccggggactcacacaaggcgacaccgccacatacttctgtgctcgccagaaatttgaaagaggcgggcagggatggattttcgatctgtggggccgggggacccttatcgccgtgtcctct

SEQ ID NO: 41252 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatggatgaagacggtgaccggcgcggtcaactttgggtctccgaatttcagacaccgggtgagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgttgtgtcctct

SEQ ID NO: 41253 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccgaagtgaagaaacccggggcttctgtcagagttagctgctggacctccgaggacatcttcgaacggacagagctcattcattgggtgcgccaggcccctggacagggcctggaatggatcgggtgggtgaagacggtcaccggagcggtgaactttggctctccgaatttcagacaccgggttagccttacacgcgatagagacctgtttaccgctcatatggatattcgggggctcacacagggagacaccgccacatacttctgtgcccgccaaaaatttgagagaggcggccaggggtggtatttcgatctgtggggacggggcacccttatcgtggtctcctct

SEQ ID NO: 41254 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaactcggagcctccgtcagagtttcttgctggaccagcggcgacatcttcgaacggacagagctgattcattgggtgcgccaggcgcccgggcagggacttgaatggatcggctgggtgaaggctgtctccggggccgtgaactacggatctctggattttagacagcgggttagcctcacgcgcgacagagatctgttcaccgcccacattgacatccggggccttacacaaggcgataccgctacatatttttgtgcccgccagaaattcgagagagggggacagggctggatttttgacctgtgggggcggggaaccctcatcgctgtgtcctct

SEQ ID NO: 41255 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctgggcctccgaagacatcttcgagcggaccgaactgattcattgggtgcgccaggcgcccggccaggggcttgagtggatcggatgggtgaaggctgtctctggcgccgtgaactacgggagcctggattttagacaccgggtttccctcacacgcgacagagatctgtctacggcccatatggacattcggggacttacccaggatgacacagctacctatttctgtgcccgccaaaaatttgctagaggcgatcagggctggttctttgacctgtgggggcggggaacactcatcgtggtcagctcc

SEQ ID NO: 41256 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcagaatttcagacaacgggttagccttacccgcgatagagacctgtttacagcgcacatggatattcggggactcacccagggcgacacagctacctacttctgtgcccgccagaaatttgaaagaggcgggcagggatggatcttcgatctgtggggccgggggacgcttattgccgtgtcctct

SEQ ID NO: 41257 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtcacaggcgcggtgaactttgggtctccgaatttcagacaccgggttagccttacccgcgatagagacctgtttacagctcatatggatattcggggactcacccagggcgacacagccacctacttctgtgcccgccaaaagtttgaaagaggcgggcagggatggtatttcgatctgtggggccgggggacgcttatcgtggtctcctct

SEQ ID NO: 41258 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcctccggaagtctgagctgattcattgggtgcgccaggcccctggccaggggcttgaatggatcggatgggtgaaaacagtcacgggcgcggtgaacttcgggagctccgattttagacagcgggtttctctgacccgcgacagagatctcttcacagctcacatggacattcggggactgacccaaggcgatacagccacctacttttgtgcccgccagaagttctatgctggcgggcagggatggtactttgacctttggggcagagggacactgatcgtggtcagctcc

SEQ ID NO: 41259 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagacagagctcattcattgggtgcggcaggcccctggccaggggctggaatggatcggatgggtgaaaacggtcaccggcacagtgaactttgggtctcttaatttccgccagagagttagcctgacccgggatcgcgacctctttacagcgcacatggatattagaggactgacccaaggcgacacagctacctacttctgtgcccggcagaagttttatgccggcgggcagggatggtacttcgatctttggggccgcgggacgctgatcgtggtctcctct

SEQ ID NO: 41260 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagc

SEQ ID NO: 41261 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctagcgatttcagacagcgggtttcccttacacgcgacagagatctgtttaccgctcacatggacattcggggactcacacaaggcgataccgccacatacttctgtgcccgccagaaattttatgctggcgggcagggatggtacttcgacctgtggggcagagggacccttatcgtggtctctagc

SEQ ID NO: 41262 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgagagtgtcttgctggaccagcgaagacatcttcgagcggtccgaactcatttactgggtccgccaggcccctggaagaggcctggagtggatcgggtggattaaacttgtgtctggagcggttaactttggcagcgtggatttccgggaccgcgtctccctgacaagagatcgggacctctttacggctcacatggatatccgcgggctgacccaggacgatacagccacctatttctgtgccagacaaaagtttgctcggggagaccagggctggttctttgatctttggggccgcgggacactgattgtggtttctagc

SEQ ID NO: 41263 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcagatccggcgtgaagaaacccggggcttctgtccgggttagctgctggacctccgaagacatcttcgagcgcacagaactcattcattgggtgagacaggcccctggacagggcctggagtggatcgggtgggtgaaggcggtctctggagctgtgaactttggcagcccgaatttccggcaccgcgtttcccttacgagagatcgggacctgtctaccgcccatatggatattcgcgggctcacacaggacgataccgccacatacttttgtgctagacaaaaattcgcccggggagaccagggctggtttttcgatctgtggggccgcgggacccttatcgtggtcagctcc

SEQ ID NO: 41264 - RNA, 375 nt, synthetic construct
  misc_feature 1..375: note = derived and/or modified sequence opt5 from anti-HIV-1_HeavyChain
  source 1..375: mol_type = other RNA
cagagctacctggagcaatccggctctgccatgaagaaacccggggctagcgtgagagtctcctgctggacctctgaagacatcttcgatacaacggagctcatttattgggttcggcaggcccctggacagggcctggaatggatcgggtgggtgaagattgtgagcggaaccgtcaactttgcgtcccttgacttccgcaatagaatctctctgagccgggatcgcgacctctttacagctcacatggatattagaggcctgacccagggggacacagccacctacttctgtgcccggcaaaaattttatgctggaggccagggctggtacttcgatctttgggggcgcggaacactgatcgtggtttccagc

SEQ ID NO: 41265 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagacagaactcattcattgggtgcggcaggcccctggccaggggctggagtggatcggatgggtgaaagcggtctctggcgctgtgaactacgggagccttgattttcgccacagagtttccctgacgcgggaccgcgatctcttcaccgcccatatggacattagaggactgacacaggatgacaccgccacatatttttgtgctcggcaaaagttcgcccgcggcgatcagggctggtttttcgacctttgggggagaggaaccctgatcgtggtctctagc

SEQ ID NO: 41266 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctcc

SEQ ID NO: 41267 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccaggacgatacagccacctacttctgtgcccgccaaaaatttgctagaggcgaccagggctggttctttgatctgtgggggcggggaacacttatcgtggtctctagc

SEQ ID NO: 41268 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgctagaggcgatcaggggtggttctttgacctgtggggacggggcacccttattgtggtctctagc

SEQ ID NO: 41269 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattctacgccggcgggcagggatggtattttgacctgtggggcagagggaccctcatcgtggtctctagc

SEQ ID NO: 41270 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccagggggacacagccacctatttttgtgcccggcaaaaattcgagcgcggaggccagggctggtactttgatctttgggggagaggaacactgatcgtggttagctct

SEQ ID NO: 41271 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgccagagagtgtctctgacacgggatcgcgacctctttaccgctcatatggatatcagaggcctgacacaaggggacaccgccacatatttctgtgcccggcagaaatttgagcgcggaggccagggctggattttcgatctttgggggagaggaaccctgatcgctgttagctcc

SEQ ID NO: 41272 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaaggcgacacagctacctacttctgtgcccgccagaaatttgaaagaggcgggcagggatggatcttcgatctttggggccgggggacgctgattgccgtgtcctct

SEQ ID NO: 41273 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctct

SEQ ID NO: 41274 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaacccggagcctctgttcgggtgagctgctggacatccgaagacatcttcgagcgcacggaactgattcattgggtgagacaagctcctggccaggggctcgagtggatcggatgggtcaagaccgtgtctggcgccgttaactttgggagcccgaatttccggcaccgcgtgtccctgacaagagatcgggacctttttaccgcgcatatggatattcgcggactgacacagggcgacaccgctacatacttctgtgccagacagaaatttgaacggggcgggcaaggatggtatttcgatctctggggccgcgggaccctgatcgtcgtgtctagc

SEQ ID NO: 41275 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaacgcggcgggcagggatggtatttcgacctgtggggcagagggacacttatcgtggtcagctcc

SEQ ID NO: 41276 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaactgggagcctctgtccgggttagctgctggacatccgaagacatcttcgagcgcacggaactcattcattgggtgagacaagctcccggccaggggctggagtggatcggatggatgaaggccgtgtctggcgcggtcaactacgggagccttgattttcggcaccgcgtgtccctgaccagagaccgggatctctctacagctcatattgacatccgcggactgacccaggatgacacagccacctatttctgtgccagacagaaatttgctcggggcgatcaaggctggttctttgacctttgggggcgcggaacactgattgttgtgagctcc

SEQ ID NO: 41277 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctcctaatttcagacaccgggttagcctgacacgcgatagagacctctttaccgctcatatggatattcggggactgacacagggcgacaccgccacatacttctgtgcccgccaaaaatttgaaagaggcgggcagggatggtatttcgatctttggggccgggggaccctgatcgtggtctcctct

SEQ ID NO: 41278 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggatcttcgatctgtggggccgggggacccttattgctgtgtcctct

SEQ ID NO: 41279 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccacagagtttctcttacccgggaccgcgatctgtttacagctcatatggacattagaggactcacccagggcgatacagccacctacttctgtgcccggcaaaagtattacgctggcgggcagggatggtattttgacctgtggggccgcgggacacttatcgtggtcagctcc

SEQ ID NO: 41280 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatgggaattagaggcctcacccaaggcgacacagccacctacttctgtgcccggcagaagttttatgctgggggacagggctggtacttcgatctgtgggggcgcggaacacttatcgtggtcagctcc

SEQ ID NO: 41281 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttttcttacccgggaccgcgatctgttcacagctcacatggacattagaggactcacccaaggcgatacagccacctacttttgtgcccggcagaagttctatgctggcgggcagggatggtactttgacctgtggggccgcgggacacttatcgtggtctctagc

SEQ ID NO: 41282 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactacgggagccttgattttagacaccgggtttccctgacgcgcgacagagatctctctaccgcccatatggacattcggggactgacacaggatgacaccgccacatatttctgtgctcgccaaaaatttgccagaggcgatcagggctggttctttgacctttgggggcggggaaccctgatcgtggtcagctcc

SEQ ID NO: 41283 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagccaggatttccgcgacagattttcccttacccgggatcgcgacctgttcacagctcacatggatattagaggactcacccaaggcgacacagccacctacttttgtgcccggcagaagttctatgctggcgggcagggatggtactttgatctgtggggccgcgggacacttatcgttgtgtctagc

SEQ ID NO: 41284 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatgccacaggactcatttactgggttcggcaggcgcctggccaggggctggagtggatcggatgggtgaagattgtgagcggcacggtcaactttgcttcccttgacttccgccagagagtgtctctgacccgggatcgcgacctctttacagcccatatggatatcagagggctgacccaaggagacacagccacctatttctgtgctcggcagaaattttacgccggcggccaggggtggtatttcgatctttggggacgcggcacactgattgttgtgagctcc

SEQ ID NO: 41285 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcctatatggacattcggggacttacacaggatgacaccgccacatacttctgtgctcgccaaaaatttgccagaggcgatcagggctggttctttgacctgtgggggcggggaaccctcatcgtggtcagctcc

SEQ ID NO: 41286 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccatctatctgtgtgctcgccaaaaatttgccagaggcgatcagggctggttctttgacctctgggggcggggaacactgattgtggtctctagc

SEQ ID NO: 41287 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccagggggacacagccacctatttttgtgcccggcaaaaattcgagcgcggaggccagggctggatctttgatctttgggggagaggaacactgatcgctgtgagctct

SEQ ID NO: 41288 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagcccgaatttccgccacagagtttcccttacccgggatcgcgacctgtttacagctcatatggatattagaggactcacccagggcgacacagccacctacttctgtgcccggcaaaagtttgaacgcggcgggcagggatggtatttcgatctgtggggcagagggacacttatcgtggtctctagc

SEQ ID NO: 41289 - RNA, 375 nt, synthetic construct
  misc_feature 1..375: note = derived and/or modified sequence opt5 from anti-HIV-1_HeavyChain
  source 1..375: mol_type = other RNA
caggcccaccccgagcaaagcggctccggggtgaagaaacctggagcttctgtcagagttagctgctggacctccgaagacatcttcgagaagtctgaactgattcattgggtgcggcaggccccgggccaggggctcgagtggatcggatgggtgaaaacagtcacgggcgcggtgaactttgggagctccgatttccgccagagagtttctctgacccgggaccgcgatctttttacagctcacatggacattagaggactgacccaaggcgatacagccacctacttctgtgcccggcagaagttttatgctggcgggcagggatggtacttcgacctctggggccgcgggacactgatcgtggtcagctcc

SEQ ID NO: 41290 - RNA, 375 nt, synthetic construct
  misc_feature 1..375: note = derived and/or modified sequence opt5 from anti-HIV-1_HeavyChain
  source 1..375: mol_type = other RNA
agagcccacctggagcagagcggctccggggtgcggaagcccggagcttctgtccgcgttagctgctggacctccgaagacatcttcgagaaatctgaactcattcattgggtgagacaagcccctggccaggggctggagtggatcggatgggtgaagacagtcacgggcgcggtgaactttgggagctccgatttccggcagcgcgtttctcttaccagagaccgggatctgtttacagctcacatggacattcgcggactcacccagggcgatacagccacctacttctgtgccagacaaaaattttatgctggcgggcagggatggtacttcgacctgtggggccgggggacacttatcgtggtcagctcc

SEQ ID NO: 41291 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggatcttcgatctgtggggccgggggacacttattgctgtgtctagc

SEQ ID NO: 41292 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgaaaagagcgagctcattcattgggttcggcaggcccctggacagggcctggagtggatcgggtgggtgaaaacagtgacgggagcggtcaactttggctcctctgatttccgccagagagtgagccttacccgggaccgcgatctgtttacagctcacatggacattagagggctcacccaaggagatacagccacctacttctgtgcccggcagaagttttatgctggcggccaggggtggtacttcgacctgtggggacgcggcacacttatcgttgtgtccagc

SEQ ID NO: 41293 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacatatcgtggtcagctcc

SEQ ID NO: 41294 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagc

SEQ ID NO: 41295 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgccatagagtgagccttacacgggatcgcgacctgtccaccgctcacatggatatcagaggcctcacacaggacgataccgccacatatttttgtgcccggcaaaaattcgctcgcggggaccagggatggtttttcgatctgtggggcagaggcacccttattgttgtgagctct

SEQ ID NO: 41296 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaattttatgctggcgggcagggatggtacttcgatctgtggggcagagggacccttattgtggtctctagc

SEQ ID NO: 41297 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacagcgggtttcccttacccgcgatagagacctgtttacagctcacatggatattcggggactcaccgaaggcgacacagccacctacttctgtgcccgccaaaaattttatgctggcgggcagggatggtacttcgatctgtggggcagagggacacttatcgtggtctctagc

SEQ ID NO: 41298 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgccaactacgggagcctggattttagacaccgggtgtccctcacgcgcgacagagatctgttcaccgcccatatggacattcggggacttacacaggatgacaccgctacatatttttgtgcccgccaaaaattcgctagaggcgatcagggctggtttttcgacctgtgggggcggggaaccctcatcgttgtgtctagc

SEQ ID NO: 41299 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcagcggcgcggtgaactttgggtccccgaatttccgccacagagtttctcttacgcgggatcgcgacctgtttaccgctcatatggatattagaggactcacacagggcgacaccgccacatacttctgtgcccggcaaaagtttgaacgcggcgggcagggatggtatttcgatctgtggggcagagggacccttatcgtggtcagctcc

SEQ ID NO: 41300 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactttgggagccctaatttcagacaccgggtttccctgacgcgcgatagagacctctttaccgcccatatggatattcggggactgacacagggcgacaccgccacatacttctgtgctcgccaaaaatttgaaagaggcgggcagggatggtatttcgatctttggggccgggggaccctgatcgtggtctctagc

SEQ ID NO: 41301 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacctgtgtgcccgccagaaattcgaaagaggcgggcagggatggatttttgatctttggggccgggggaccctgatcgctgtgtctagc

SEQ ID NO: 41302 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcagcggcgcggtgaactttgggtccccgaatttcagacaccgggtttctcttacgcgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtcagctcc

SEQ ID NO: 41303 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaaggcgacacagctacctacttctgtgcccgccagaaattttatgccggcgggcagggatggtacttcgatctttggggcagagggacgctgatcgtggtctcctct

SEQ ID NO: 41304 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcagcggagctgtgaactttggctccacggatttccgggaacgcgtttctcttaccagagaccgggatctgtttacagcccatatggacattcgcgggctcacccagggagatacagccacctatttctgtgctagacaaaagtttgcccggggcgaccagggctggttctttgatctgtgggggcgcggaacacttatcgtggtcagctcc

SEQ ID NO: 41305 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagcggtctgaactcattcattgggtgcgccaggctcctggccaggggctggagtggatcggatgggtcaagacagtgacgggcgccgttaactttgggagcccgaatttcagacaccgggtgtcccttacccgcgatagagacctgtttacagcgcatatggatattcggggactcacccagggcgacacagctacctacttctgtgcccgccaaaaatattacgccggcgggcagggatggtattttgatctgtggggcagagggacacttatcgtcgtgtctagc

SEQ ID NO: 41306 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacatttgtggactcacccaaggcgatacagccacctacttctgcgccagacagaagttttatgctggcgggcagggatggtacttcgacctgtggggccgggggacacttatcgtggtcagctcc

SEQ ID NO: 41307 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccgaggcttctgtcagagttagctgctggacctccgaagacatcttcgaaaagtctgagctcattcattgggtgcggcaggcccctggacagggcctggaatggatcgggtgggtgaaaacagtcacgggagcggtgaactttggcagctccgatttccgccagagagtttctcttacccgggaccgcgatctgtttacagctcacatggacattagagggctcacccaaggagatacagccacctacttctgtgcccggcagaagttttatgctggcggccaggggtggtacttcgacctgtggggacgcggcacacttatcgtggtcagctcc

SEQ ID NO: 41308 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaatttgaaagaggcgggcagggatggatcttcgatctgtggggccgggggacccttattgctgtgtcctct

SEQ ID NO: 41309 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagcgcacagaactcatttactgggtgagacaggcgcctggacagggcctggagtggatcgggtgggtgaaaacggtctctggagctgtgaactttggcagccaggatttccgggaccgcttttcccttaccagagatcgggacctgttcacagcccatatggatattcgcgggctcacccaaggagacacagccacctatttttgtgctagacagaagttcgaacggggcggccaggggtggtactttgatctgtggggacgcggcacacttatcgttgtgtctagc

SEQ ID NO: 41310 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaattgtcagcggcgcggtgaactttgggtccccgaatttccgccagagagtttctcttacacgggatcgcgacctgtttacggctcacatggatatcagaggactcacccaaggcgacacagccacctacttctgtgcccggcagaagtttgaacgcggcgggcagggatggattttcgatctgtggggcagagggacacttatcgctgtgagctcc

SEQ ID NO: 41311 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacccctttaccgctcatatggatattcggggactgacacagggcgacaccgccacatacttctgtgcccgccaaaaatttgaaagaggcgggcagggatggtatttcgatctctggggccgggggaccctgatcgtggtctcctct

SEQ ID NO: 41312 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctggcctcattcattgggtgcggcaggcccctgggcagggactggaatggatcggctgggtgaaaacagtcacgggggcggtgaactttggaagctccgatttccgccagagagtttctcttacccgggaccgcgatctgtttacagctcacatggacattagaggcctcacccaaggcgatacagccacctacttctgtgcccggcagaagttttatgctgggggacagggctggtacttcgacctgtgggggcgcggaacacttatcgtggtcagctcc

SEQ ID NO: 41313 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaagcggtcagcggcacagtgaactacgggtcccttgattttcgccacagagtttctctgacgcgggaccgcgatctcttcaccgctcatatggacattagaggactgacacaggatgacaccgccacatatttttgtgcccggcaaaagttcgctcgcggcgatcagggctggtttttcgacctttgggggagaggaaccctgatcgtggtcagctcc

SEQ ID NO: 41314 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaattttacgccgggggacagggctggtatttcgatctgtgggggcgcggaacacttatcgtggtctctagc

SEQ ID NO: 41315 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaattttatgctggcgggcagggatggtacttcgacctttggggcagagggacactgattgttgtgtctagc

SEQ ID NO: 41316 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcagcacggcccatatggacattcggggactgacccaggatgacacagccacccacttctgtgctcgccaaaaatttgccagaggcgatcagggctggttctttgacctttgggggcggggaacactgatcgtggtctccagc

SEQ ID NO: 41317 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagggcacagaactcattcattgggtgcggcaggcccctgggcagggactggagtggatcggctgggtgaagattgtctctggggcggtgaactttggaagcccgaatttccgccagagagtttcccttacgcgggatcgcgacctgtttaccgctcacatggatatcagaggcctcacacaaggcgacaccgccacatacttctgtgcccggcagaaatttgaacgcgggggacagggctggattttcgatctgtgggggagaggaacccttatcgctgtgtctagc

SEQ ID NO: 41318 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaattttatgctggcgggcagggatggtacttcgatctgtggggcagagggacccttatcgtggtctcctct

SEQ ID NO: 41319 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcccgaatttccgccacagagtttcccttacccgggatcgcgacctgtttacagctcatatggatattagaggcctcacccagggcgacacagccacctacttctgtgcccggcaaaaatttgaacgcgggggacagggctggtatttcgatctgtgggggagaggaacacttatcgtggtctctagc

SEQ ID NO: 41320 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgctagaggcgatcaggggtggttctttgacctgtggggacggggcacacttatcgtggtctctagc

SEQ ID NO: 41321 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaaggcatcttcgagcggacagaactcattcattgggtgcgccaggcccctgggcagggactggagtggatcggctgggtgaagattgtctctggggcggtgaactttggaagcccgaatttcagacagcgggtttcccttacgcgcgacagagatctgtttgctgcccacatggacatccggggcctcacccaaggcgatacagccacctacttctgtgctcgccagaaatttgaaagagggggacagggctggattttcgacctgtgggggcggggaacacttatcgccgtgtctagc

SEQ ID NO: 41322 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcgggccgaactgattcattgggtgcgccaggcgcccggccaggggcttgagtggatcggatgggtgaaggctgtctctggcgccgtgaactacgggagcctggattttagacaccgggtttccctcacacgcgacagagatctgttcacggcccatatggacattcggggacttacccaggatgacacagctatctatttttgtgcccgccaaaaattctacgctggcggccaggggtggtattttgatctgtggggaagaggcaccctcattgtggtctctagc

SEQ ID NO: 41323 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagccctaattttagacagcgggtttccctgacgcgcgatagagacctcttcaccgcccacatggatattcggggactgacacaaggcgacaccgccacatatttttgtgctcgccagaaattcgaaagaggcgggcagggatggatctttgatctttggggccgggggaccctgattgccgtgtctagc

SEQ ID NO: 41324 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttaattttagaagccggatttccctgacacgcgatagagacctcttcaccgctcacatggatatccggggactgacagaaggcgacaccgccacatatttttgtgcccgccagaaattctacgctggcgggcaaggatggtattttgatctttggggcagagggaccctgattgttgtgtctagc

SEQ ID NO: 41325 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcagcggcgcggtgaactttgggtccccgaatttccgccagagagtttctcttacgcgggatcgcgacctgtttaccgctcacatggatattagaggactcacacaaggcgacaccgccacatacttctgtgcccggcagaagtttgaacgcggcgggcagggatggatcttcgatctgtggggcagagggacccttattgctgtgagctcc

SEQ ID NO: 41326 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcagatgggtgaaggcggtctctggagctgtgaactacggcagcctggattttcggcaccgcgtttccctcacgagagaccgggatctgtctaccgcccatatggacattcgcgggcttacacaggatgacaccgccacatatttctgtgctagacaaaaatttgcccggggagatcagggctggttctttgacctgtggggccgcgggaccctcatcgtggtcagctcc

SEQ ID NO: 41327 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctagcgatttcagacagcgggtttccctgacacgcgacagagatctctttaccgctcaaatggacattcggggactgacacagggcgataccgccacatacttctgtgcccgccagaaattttatgctggcgggcagggatggtacttcgacctttggggcagagggaccctgatcgtggtctctagc

SEQ ID NO: 41328 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgctcaccagattagcgatcgcgtttcccttaccagagaccgggatctgttcacagcccatatggacatccgcgggctcacccaaggagatacagccacctacttttgtgctagacagaagttctatgccggcggccaggggtggtactttgacctgtggggacggggcacacttattgtggtctctagc

SEQ ID NO: 41329 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggtcgtgtctggcgcggttaactttgggagcccgaatttcagacagcgggtgtcccttacgcgcgatagagacctgtttaccgctcacatggatattcggggactcacacaaggcgacaccgccacatacttctgtgcccgccagaaatttgaaagaggcgggcagggatggatcttcgatctgtggggccgggggacccttattgctgtctctagc

SEQ ID NO: 41330 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagaagtctgaactcattcattgggtgcggcaggctcctggccaggggctggagtggatcggatgggtcaaaacagtgacgggcgccgttaactttgggagctccgatttccgccagagagtgtctcttacccgggaccgcgatctgtttacagcgcacatggacattagaggactcacccaaggcgatacagctacctacttctgtgcccggcagaagttttatgccggcgggcagggatggtacttcgacctgtggggccgcgggacacttatcgtcgtgagctcc

SEQ ID NO: 41331 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaaagaggcgggcagggatggattttcgacctttggggccgggggacactgatcgctgtttctagc

SEQ ID NO: 41332 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctcgcggggaccagggatggtttttcgatctttggggcagaggcacactgatcgtggttagctct

SEQ ID NO: 41333 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacctgtgtgcccgccaaaaattcgaaagaggcgggcagggatggtattttgatctttggggccgggggaccctgatcgtggtctcctct

SEQ ID NO: 41334 - RNA, 372 nt, synthetic construct
  misc_feature 1..372: note = derived and/or modified sequence opt5 from anti-HIV-1_HeavyChain
  source 1..372: mol_type = other RNA
agacacacctgggagcagagcggctccggggtgaagaaacccggagcctctgtccgggttagctgctggacatccgaagacatcttcaagtctgagctgattcattgggtgcgccaagctcctggccaggggctcgaatggatcggatgggtgaaaacggtcaccggcgccgtgaactttgggagctccgatttcagacagcgggtttctctgacacgcgacagagatctttttaccgcgcacatggacattcggggactgacacagggcgataccgctacatacttctgtgcccgccaaaagttttatgccggcgggcagggatggtacttcgacctctggggcagagggaccctgatcgtggtcagctcc

SEQ ID NO: 41335 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacagaaggcgacaccgccacatacttctgtgcccgccagaaattttatgctggcgggcaaggatggtacttcgatctgtggggcagagggacccttatcgtggtctcctct

SEQ ID NO: 41336 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctgcttacttcagacaccgggttagccttacacgcgatagagacctgtttaccgcccatatggatattcggggactcacacagggcgacaccgccacatatttctgtgctcgccaaaaattttacaagggcgggcagggatggtatttcgatctgtggggcagagggacccttatcgtggtctcctct

SEQ ID NO: 41337 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggccccggggtgaagaaactcggagcttccgtcagagtttcttgctggaccagcgaagacatcttcgagcggacagaactgattcattgggtgcgccaggcccctggccaggggcttgagtggatcggatgggtgaaggcggtctccggcgctgtgaactacgggtctctggattttagacaccgggttagcctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctcctct

SEQ ID NO: 41338 - RNA, 375 nt, synthetic construct
  misc_feature 1..375: note = derived and/or modified sequence opt5 from anti-HIV-1_HeavyChain
  source 1..375: mol_type = other RNA
agagcccacctggagcagagcggctccggggtgaagaaacccggagcttctgtccgggttagctgctggacctccgaagacatcttcgagcgcacagaactcattcattgggtgagacaagcccctggccaggggctggagtggatcggatgggtgaagattgtctctggcgcggtgaactttgggagcccgaatttccggcagcgcgtttcccttacgagagatcgggacctgtttaccgctcacatggatatccgcggactcacacagggcgacaccgccacatacttctgtgccagacaaaaatttgaacggggcgggcagggatggattttcgatctgtggggccgcgggacccttatcgctgtgtctagc

SEQ ID NO: 41339 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctagcgatttcagacagcgggtttccctgacacgcgacagagatctctttaccgctcacatggacattcggggactgacacaaggcgataccgccacatacttctgtgcccgccagaaattttatgctggcgggcagggatggtacttcgacctttggggcagagggaccctgatcgtggtctctagc

SEQ ID NO: 41340 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcttcacggcccatatggacattcggggactgacccaggatgacacagccatctatttttgtgctcgccaaaaattcgccagaggcgatcagggctggtttttcgacctttgggggcggggaaccctgattgtggtcagctcc

SEQ ID NO: 41341 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaaggcggtgtctggcgctgttaactacgggagccttgattttagacaccgggtgtccctgacgcgcgacagagatctcttcaccgcccatatggacattcggggactgacacaggatgacaccgccatctatttttgtgctcgccaaaaattcgccagaggcgatcagggctggtttttcgacctttgggggcggggaacactgattgtcgtgtctagc

SEQ ID NO: 41342 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgagctcaagaaacccgggtcctctgttagagtgagctgctggacctccgaagacatcttcgagggatctgaactgattcactgggtgcggcaggctcctggccaggggcttgagtggatcggatgggtcaagacagtgacgggcgccgttaactttgggagcgcgtacttccgccatagagtgtccctgacccgggatcgcgacctctttacagctcacatggatattagaggactgacccaaggcgacacagccacctatttctgtgcccggcagaaattttacaagggcgggcagggatggtatttcgatctttggggccgcgggacactgatcgtcgtgtctagc

SEQ ID NO: 41343 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagtctctgttagagtgagctgctggacctccgaagacatcttcgagcggacagaactcattcattgggtgcgccaggctcctggccaggggctggagtggatcggatgggtcaagattgtgtctggcgccgttaactttgggagcccgaatttcagacagcgggtgtcccttacgcgcgatagagacctgtttaccgcgcacatggatatccggggactcacacaaggcgacaccgctacatacttctgtgcccgccagaaatttgaaagaggcgggcagggatggattttcgatctgtggggccgggggacccttatcgccgtctctagc

SEQ ID NO: 41344 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggtcgtgtctggcgcggttaactacgggagcctggattttagacaccgggtgtccctcacgcgcgacagagatctgttcaccgctcatatggacattcggggacttacacaggatgacaccgccacatatttttgtgcccgccaaaaattcgctagaggcgatcagggctggtttttcgacctgtgggggcggggaaccctcatcgtcgtgtctagc

SEQ ID NO: 41345 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccgcttatttttgtgcccgccaaaaattcgctagaggcgatcagggctggtttttcgacctgtgggggcggggaacactcatcgtggtctctagc

SEQ ID NO: 41346 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgagaaagcccggagcttctgtccgggttagctgctggacctccgaagacatcttcgagaaatctgaactcattcattgggtgcgccaggcccctggccaggggctggagtggatcggatgggtgaagacagtcacgggcgcggtgaactttgggagctccgatttcagacagcgggtttctcttacccgcgacagagatctgtttacagctcacatggacattcggggactcacccaaggcgatacagccacctacttctgtgcccgccagaaattttatgctggcgggcagggatggtacttcgacctgtggggcagagggacacttatcgtggtcagctcc

SEQ ID NO: 41347 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaaggcgacacagctacctacttctgtgcccgccagaaattttataagggcgggcagggatggtacttcgatctttggggcagagggacgctgatcgtggtctcctct

SEQ ID NO: 41348 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcattcattgggttcgccaggcccctggacagggcctggagtggatcgggtgggtgaaggcggtgagcggagctgtcaactacggctcccttgattttagacaccgggtgtctctgacgcgcgacagagatctcttcaccgcccatatggacattcgggggctgacacaggatgacaccgccacatatttttgtgctcgccaaaaattcgccagaggagatcagggctggtttttcgacctttggggccgggggaccctgatcgttgtgagctcc

SEQ ID NO: 41349 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccgggtttccctgacccgcgacagagatctctttacagctcatatggacattcggggactgacccagggcgatacagccacctacttctgtgcccgccaaaaatttgctagaggcgaccaggggtggttctttgatctttggggacggggcacactgatcgtggtctctagc

SEQ ID NO: 41350 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtctctggcgcggtgaactttgggagccttaatttcagacaccgggtttccctgacacgcgatagagacctctttaccgctcatatggatattcggggactgacacagggcgacaccgccacatacttctgtgcccgccaaaagttttataaaggcgggcagggatggtacttcgatctttggggcagagggaccctgatcgtggtctctagc

SEQ ID NO: 41351 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaaacttgtgagcggagctgtcaactttggctccgtggatttcagagaccgggtttctctgacacgcgatagagacctctttacggcccatatggatatccgggggctgacccagggagacacagccacctatttctgtgctcgccagaagttttacgccggcggccaagggtggtatttcgatctttggggaagaggcacactgattgtggtcagctcc

SEQ ID NO: 41352 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagattgtcagcggcgcggtgaactttgggtccccgaatttcagacagcgggtttctcttacacgcgatagagacctgtttacggctcacatggatatccggggactcacccaaggcgacacagccacctacttctgtgcccgccagaaatttgaaagaggcgggcagggatggattttcgatctgtggggccgggggacacttatcgctgtgagctcc

SEQ ID NO: 41353 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtctctggcgcggtgaactttgggagccctaatttcagacaccgggtttccctgacccgcgatagagacctctttacagctcatatggatattcggggactgacccagggcgacacagccacctacttctgtgcccgccaaaaatttgaaagaggcgggcagggatggtatttcgatctttggggccgggggacactgatcgtggtctctagc

SEQ ID NO: 41354 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagaaatctgaactcattcattgggtgcgccaggcccctggccaggggctggagtggatcggatgggtgaagacagtcacgggcgcggtgaactttgggagctccgatttcagacagcgggtttctcttacccgcgacagagatctgtttacagctcacatgggcattcggggactcacccaaggcgacacagccacctacttctgtgcccgccagaaattttatgctgggggacagggctggtacttcgatctgtgggggagaggaacacttatcgtggtcagctcc

SEQ ID NO: 41355 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactacgggagccttgattttagacaccgggtttccctgacgcgcgacagagatctcttcaccgcccatatggacattcggggactgacacaggatgacaccgccatctatttttgtgctcgccaaaaattcgccagaggcgatcagggctggtttttcgacctttgggggcggggaacactgattgtggtctctagc

SEQ ID NO: 41356 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaactcggggctagcgtgagagtcccctgctggacctccgaagacatcttcgagcggacagaactgattcattgggttcgccaggcccctggacagggccttgagtggatcgggtgggtgaaggcggtgtctggagctgtcaactacggcagcctggattttagacaccgggtgtccctcacgcgcgacagagatctgttcaccgcccatatggacattcgggggcttacacaggatgacaccgccacatatttttgtgctcgccaaaaattcgccagaggagatcagggctggtttttcgacctgtggggccgggggaccctcatcgttgtgtctagc

SEQ ID NO: 41357 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagcggacagaactcattcattgggtgcgccaggctcctggccaggggctggagtggatcggatgggtcaagattgtgtctggcgccgttaactttgggagcccgaatttcagacagcgggtgtcccttacgcgcgatagagacctgtttaccgcgcacatggatatccggggactcacacaaggcgacaccgctacatacttctgtgcccgccagaaatttgaaagaggcgggcagggatggattttcgatctgtggggccgggggacccttatcgccgtctctagc

SEQ ID NO: 41358 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactacgggagccttgattttagacaccgggtttccctgacgcgcgacagagatctcttcaccgcccatatggacattcggggactgacacaggatgacaccgccacatatttttgtgctcgccaaaaattcgccagaggcgatcagggctggtttttcgacctttgggggcggggaaccctgatcgtggtctctagc

SEQ ID NO: 41359 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtgggtgaagacagtcagcggagctgtgaactttggctccccgaatttcagacatcgggtttctcttacgcgcgatagagacctgtttaccgcccacatggatattcgggggctcacacagggagacaccgccacatatttctgtgctcgccagaaatttgaaagaggcggccaagggtggtacttcgatctgtggggacggggcacccttatcgtggtcagctcc

SEQ ID NO: 41360 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaatttgaaagaggcgggcagggatggtatttcgatctgtggggccgggggacccttatcgtggtctcctct

SEQ ID NO: 41361 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattctacgccggaggccaaggctggtattttgatctgtgggggcggggaacccttattgtggttagctct

SEQ ID NO: 41362 - RNA, 375 nt, synthetic construct
  misc_feature 1..375: note = derived and/or modified sequence opt5 from anti-HIV-1_HeavyChain
  source 1..375: mol_type = other RNA
caggtgcaactggagcagagcggctccggggtcaagaaacccggagcctctgttagagtgagctgctggacctccgaagacatcttcgagaagtctgaactcattcactgggtgcggcaggctcctggccaggggctggagtggatcggatgggtcaaaacagtgacgggcgccgttaactttgggagctccgatttccgccaaagagtgtctcttacccgggaccgcgatctgtttacagcgcatatggacattagaggactcacccagggcgatacagctacctacttctgtgcccggcagaagttttatgccggcgggcagggatggtacttcgacctgtggggccgcgggacacttatcgtcgtgagctcc

SEQ ID NO: 41363 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggcagagggctggagtggatcggatgggtgaaggcggtctctggcgctgtgaactacgggagccttgattttcggcaccgcgtttccctgacgagagaccgggatctcttcaccgcccatatggacattcgcggactgacacaggatgacaccgccacatatttttgtgctagacagaaattcgcccggggcgatcaaggctggtttttcgacctttgggggcgcggaaccctgatcgtggtctctagc

SEQ ID NO: 41364 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcattcattgggttcgccaggcccctggacagggcctggagtggatcgggtgggtgaagacggtgaccggagcggtcaactttggcagcccgaatttcagacaccgggtgtcccttacacgcgatagagacctgtttaccgctcatatggatattcgggggctcacacagggagacaccgccacatacttctgtgcccgccaaaaatttgaaagaggcggccaggggtggtatttcgatctgtggggacggggcacccttatcgttgtgtctagc

SEQ ID NO: 41365 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggacagggtgggtgaaaacggtcagcggagctgtgaactttggctccaccgatttccgggaacgcgtttctcttacaagagaccgggatctgtttaccgcccatatggacatccgcgggctcacacagggagataccgccacatatttctgtgctagacaaaagtttgcccggggcgaccagggctggttctttgatctgtgggggcgcggaacccttattgtggtcagctcc

SEQ ID NO: 41366 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaactcggagcctctgttagagtgagctgctggacctccgaagacatcttcgagcggacagaactgattcattgggtgcgccaggctcccggcagagggcttgagtggatcggatgggtcaaggccgtgtctggcgcggttaactacgggagcctggattttcggcaccgcgtgtccctcacgagagaccgggatctgttcaccgctcatatggacattcgcggacttacacaggatgacaccgccacatatttttgtgccagacagaaattcgctcggggcgatcaaggctggtttttcgacctgtgggggcgcggaaccctcatcgtcgtgtctagc

SEQ ID NO: 41367 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatattacgctggcgggcagggatggtattttgatctgtggggcagagggacacttatcgtggtctctagc

SEQ ID NO: 41368 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaattttatgctggcgggcagggatggtacttcgatctgtggggcagagggacccttatcgtggtctcctct

SEQ ID NO: 41369 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcggcacagccacctacttctgtgcccggcagaagttttatgctgggggacagggctggtacttcgatctgtgggggcgcggaacacttatcgtggtcagctcc

SEQ ID NO: 41370 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatatttgtggactcacccagggcgacacagccacctacttctgcgcccggcaaaaatttgaacgcggcgggcagggatggtatttcgatctgtggggcagagggacacttatcgtggtctctagc

SEQ ID NO: 41371 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgagaaaggtcggagcttctgttcgggtgagctgctggacctccgaagacatcttcgagcgcacagaactcattcattgggtgagacaggcccccggccaggggctggagtggatcggatgggtcaaagcggtgtctggcgctgttaactacgggagccttgattttcggcaccgcgtgtccctgacgagagaccgggatctcttcaccgcccatatggacattcgcggactgacacaggatgacaccgccatctatttttgtgctagacaaaagttcgcccggggcgatcagggctggtttttcgacctttgggggcgcggaacactgattgtcgtgtctagc

SEQ ID NO: 41372 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatattacgctggcgggcagggatggtattttgatctgtggggcagagggacccttatcgtggtctcctct

SEQ ID NO: 41373 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgagagtgtcttgctggaccagcgaagacatcttcgagcggacagaactcattcactgggtccgccaggcccctggacagggcctggagtggatcgggtgggtgaagacggttaccggagcggtgaactttggctccccgaatttcagacatcgggtctctcttacacgcgatagagacctgtttaccgctcacatggatattcgggggctcacacaaggagacaccgccacatacttctgtgcccgccagaaatttgaaagaggcggccaggggtggtatttcgatctgtggggacggggcacccttatcgtggttagctcc

SEQ ID NO: 41374 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggcttagcgatttccgccagagagtttccctgacccgggaccgcggactctttacagctcacatggatattagaggcctgacccaaggcgacacagccacctacttctgtgcccggcagaagttttatgctgggggacagggctggtacttcgatctttgggggcgcggaacactgatcgtggtctctagc

SEQ ID NO: 41375 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacagcgggttagccttacccgcgatagagacctgtttacagcgcacatggatattcggggactcacccaaggcgacacagctacctacttctgtgcccgccagaaatttgaaagaggcgggcagggatggatcttcgatctgtggggccgggggacgcttattgccgtgtcctct

SEQ ID NO: 41376 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgagcgcgggggacagggctggtactttgacctttggggcagagggacactgatcgtggttagctct

SEQ ID NO: 41377 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgagagtgtcttgctggaccagcgaagacatcttcgagggatccgaactcattcactgggtccggcaggcccctggccaggggctggagtggatcggatgggtgaagacagttacgggcgcggtgaactttgggtctgcttacttccgccatagagtcagccttacccgggatcgcgacctgtttacagcccacatggatattagaggactcacccaaggcgacacagccacctatttctgtgctcggcagaaattttacaagggcgggcagggatggtatttcgatctgtggggccgcgggacacttatcgtggtttcctct

SEQ ID NO: 41378 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatggatattagaggcctcacccaggacgatacagccacctatttttgtgcccggcaaaaattcgagcgcgggggacagggctggatctttgacctgtggggcagagggacacttatcgctgtgtcttcc

SEQ ID NO: 41379 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcaccgaggttaagaaacccggggcctccgtgagagtgtcttgcaaggctagcggatacacattcgaaaaatccgagctcatccactgggtccggcaggcccctggccaggggctggaatggattggatgggtgaagacggttaccggcgcggtgaactttgggtctagcgacttccgccaaagagtctcccttacacgggatcgcgacctgtttaccgctcatatggatatcagaggactcacacagggcgacaccgccacatatttctgtgcccggcagaaattttacgctggcgggcagggatggtatttcgatctgtggggccgcgggacccttattgtggtttctagc

SEQ ID NO: 41380 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaacggggaggccaaggctggatttttgatctgtgggggcgcggaacccttatcgccgtgagctct

SEQ ID NO: 41381 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcagcacggcccatatggacattcggggactgacccaggatgacacagccacctatttctgtgctcgccaaaaatttgccagaggcgatcagggctggttctttgacctttgggggcggggaacactgatcgtggtctccagc

SEQ ID NO: 41382 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaagatgacacagccatctacttctgtgcccggcagaagtttgctcgcggcgatcagggctggttctttgacctgtgggggagaggaacccttattgtggtcagctcc

SEQ ID NO: 41383 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaattttatgctggcgggcagggatggtacttcgacctttggggcagagggaccctgattgttgtgtcctct

SEQ ID NO: 41384 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcgtgcattgggtgcggcaggcccctggccaggggctggagtggattggatgggtcaaaacagtgacgggcgcggttaactttgggagctccgatttccgccagagagtgtctcttacccgggaccgcgatctgtttacagctcacatggacatcagaggactcacccaaggcgatacagccacctacttctgtgcccggcagaagtttgaacgcggcgggcagggatggattttcgacctgtggggcagagggacacttatcgctgtcagctcc

SEQ ID NO: 41385 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattcgccagaggcgaccaggggtggtttttcgatctgtggggacggggcaccctcatcgtggtctctagc

SEQ ID NO: 41386 - RNA, 375 nt, synthetic construct
  misc_feature 1..375: note = derived and/or modified sequence opt5 from anti-HIV-1_HeavyChain
  source 1..375: mol_type = other RNA
caggcccacagagagcaaagcggctccggggtgaagaaacccggagcttctgtccgggttagctgctggacctccgaagacatcttcgagcgcacagaactgattcattgggtgagacaggcccctggccaggggctcgagtggatcggatgggtgaagacggtcaccggcgcggtgaactttgggtctagcgatttccggcagcgcgtttccctgacaagagaccgggatctttttaccgctcacatggacattcgcggactgacacaaggcgataccgccacatacttctgtgccagacagaaattttatgctggcgggcagggatggtacttcgacctctggggccgggggaccctgatcgtggtctctagc

SEQ ID NO: 41387 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgcctcgcctccgaagacatcttcaagaccgagctgattcattgggtgcggcaggcgcctggccaggggcttgaatggatcggatgggtgaaaattgtctctggcgctgtgaactttgggagcccgaatttccgccagagagtttccctgacacgggatcgcgacctctttacggcccacatggatatcagaggactgacccaaggcgacacagccacctacttctgtgctcggcagaagtttgagcgcggcgggcagggatggattttcgatctttggggcagagggacactgatcgccgtgtctagc

SEQ ID NO: 41388 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaaggcggtgtctggcgctgttaactacgggagccttgattttagacaccgggtgtccctgacgcgcgacagagatctcttcaccgcccatatggacattcggggactgacacaggatgacaccgccatctatttttgtgctcgccaaaaattcgaaagaggcggccaggggtggatttttgatctttggggacggggcacactgatcgccgtctctagc

SEQ ID NO: 41389 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgctcgcggcgaccaggggtggttctttgatctgtggggaagaggcacacttatcgtggtcagctcc

SEQ ID NO: 41390 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcacgggagctgtgaactttggcagctccgatttccggcagcgcgtttctcttaccagagaccgggatctgtttacagcccatatggacattcgcgggctcacccaaggagatacagccacctatttctgtgctagacagaagttttacgccggcggccaggggtggtatttcgacctgtggggacggggcacacttatcgtggtcagctcc

SEQ ID NO: 41391 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctcctaatttcagacaccgggttagcctgacacgcgatagagacctctttaccgctcatatggatattcggggactgacacagggcgacaccgccacatacttctgtgcccgccaaaaatattacgctggcgggcagggatggtattttgatctttggggcagagggaccctgatcgtggtctcctct

SEQ ID NO: 41392 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggctccggggttaagaaacccggagcctctgtgagagtgagctgctggacctccgaggacatcttcgaacggacagagctcattcactgggtccgccaggctcctggccaggggctggaatggatcggatgggtgaagattgtttctggcgccgtgaactttgggagcccgaatttcagacaacgggtctcccttacgcgcgatagagacctgtttaccgcgcatatggatatccggggactcacacagggcgacaccgctacatacttctgtgcccgccagaaatttgagagaggcgggcagggatggattttcgatctgtggggccgggggacccttatcgccgtgtctagc

SEQ ID NO: 41393 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagattgtctctggcgccgtgaactttgggagcccgaatttccggcagcgcgtttccctgaccagagatcgggacctttttacagcgcacatggatatccgcggactgacccagggcgacacagctacctacttctgtgccagacaaaaatttgaacggggcgggcagggatggattttcgatctctggggccgcgggacactgatcgccgtgtctagc

SEQ ID NO: 41394 - RNA, 372 nt, synthetic construct
  misc_feature 1..372: note = derived and/or modified sequence opt5 from anti-HIV-1_HeavyChain
  source 1..372: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaacctggcgccgaattttcggcaccgcgtttctcttaccagagatcgggacctgttcacagctcatatggatattcgcgggctcacccagggagacacagccacctacttttgtgccagacagaaattcgaacggggcggccaagggtggtattttgatctgtggggacgcggcacgcttatcgtggtcagctcc

SEQ ID NO: 41395 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagctccgatttccgccagagagtttctcttacccgggaccgcgatctgtttacagctcacatggacattagaggcctcacccaaggcgatacagccacctacttctgtgcccggcagaaattttatgctgggggacagggctggtacttcgacctgtgggggcgcggaacacttatcgtggtcagctcc

SEQ ID NO: 41396 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatggatattagaggcctcacccagggggacacagccacctatttttgtgcccggcaaaaatactatgctggaggccagggctggtacttcgatctgtgggggcgcggaacacttatcgtggtttcttcc

SEQ ID NO: 41397 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagattgtctctggcgcggtgaactttgggagccctaatttcagacagcgggtttccctgacgcgcgatagagacctctttaccgctcacatggatatccggggactgacacaaggcgacaccgccacatacttctgtgcccgccagaaatttgaaagaggcgggcagggatggattttcgatctttggggccgggggaccctgatcgctgtgtctagc

SEQ ID NO: 41398 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttataaaggcgggcagggatggtacttcgacctgtggggccgcgggacacttatcgtggtcagctcc

SEQ ID NO: 41399 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgctagaggcgatcaggggtggttctttgacctgtggggacggggcacccttatcgtggtctcctct

SEQ ID NO: 41400 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacagggcgataccgccacatatttttgtgctagacagaaattcgaacggggcgggcaaggatggtactttgacctgtggggccgcgggaccctcatcgtggtctctagc

SEQ ID NO: 41401 - RNA, 375 nt, synthetic construct
  misc_feature 1..375: note = derived and/or modified sequence opt5 from anti-HIV-1_HeavyChain
  source 1..375: mol_type = other RNA
caggccagacccggcaccagcgggtccggagtgaagaaacctggcgcttctgtccgggttagctgctggtcctctgaggacatcttcgaacgcacagagctgattcactgggtgagacaagccccggggcagggactcgaatggatcggctgggtgaagacggtcaccggggcggtgaactttggaagcctggatttccggcagcgcgtttcccttacaagagaccgggatctgtttaccgctcatatggacattcgcggcctcacacagggcgataccgccacatacttctgtgccagacaaaaatttgagcgcgggggacagggctggatcttcgacctgtgggggcggggaacccttattgctgtgtctagc

SEQ ID NO: 41402 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacagaaggcgacaccgccacatacttctgtgcccgccagaaatttgagagaggcgggcaaggatggatcttcgatctgtggggccgggggacccttattgctgtgtcctct

SEQ ID NO: 41403 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcgatttctggcgctgtcaactacgggagccttgattttagacaccgggtgtccctgacgcgcgacagagatctcttcaccgcccatatggacatccggggactgacacaggatgacaccgccacatatttttgtgctcgccaaaaattcgccagaggcgatcagggctggtttttcgacctttgggggcggggaaccctgattgttgtgtctagc

SEQ ID NO: 41404 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaacagcgggtccccgaattttcgccacagagtttctcttacccgggatcgcgacctgttcacagctcatatggatattagaggactcacccagggcgacacagccacctacttttgtgcccggcaaaagttcgaacgcggcgggcagggatggtattttgatctgtggggcagagggacacttatcgtggtcagctcc

SEQ ID NO: 41405 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcgggccgaactcattcattgggtgcgccaggcgcctggccaggggctggagtggatcggatgggtgaagacagtctctggcgctgtgaactttgggagccttaatttcagacaccgggtttccctgacgcgcgatagagacctctttaccgcccatatggatattcggggactgacacagggcgacaccgccacatacttctgtgctcgccaaaaatttgccagaggcgatcaggggtggttctttgacctttggggacggggcaccctgatcgtggtctctagc

SEQ ID NO: 41406 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcgtgacagtcagctcc

SEQ ID NO: 41407 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttaatttcagacaccgggttagcctgacacgcgatagagacctctttaccgctcatatggatattcggggactgacacagggcgacaccgccacatacttctgtgcccgccaaaaatttgaaagaggcgggcagggatggtatttcgatctttggggccgggggaccctgatcgtggtctcctct

SEQ ID NO: 41408 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtccaccgctcatatggatattcggggactcacacaggacgataccgccacatacttttgtgcccgccaaaaattcgctagaggcgaccagggctggtttttcgatctgtgggggcggggaacccttatcgtggtctctagc

SEQ ID NO: 41409 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagaccgtgacaggagcggtcaactttggcagcccgaatttccgccatagagtgtcccttacccgggaccgcgatctgtttacagctcacatggacattagagggctcacccagggagatacagccacctatttctgtgcccggcaaaaatactatgctggcggccaggggtggtactttgacctgtggggacgcggcacgcttatcgttgtgtctagc

SEQ ID NO: 41410 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggcgtctggcgctgtcaactttgggagcccgaatttcagacaccgggtgtcccttacccgcgatagagacctgtttacagcccatatggatattcggggactcacccagggcgacacagccacctacttctgtgctcgccaaaaatttgaaagaggcgggcagggatggtatttcgatctgtggggccgggggacacttatcgttgtgtctagc

SEQ ID NO: 41411 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgaaagaggcggccaggggtggtactttgatctgtggggacggggcaccctcatcgtggtctctagc

SEQ ID NO: 41412 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcagcggagctgtgaactttggctccacggatttccgggaacgcgtttctcttaccagagaccgggatctgtttacagcccatatggacattcgcgggctcacccagggagatacagccacctatttctgtgctagacaaaagtttgagcggggcggccaggggtggtacttcgacctgtggggacgcggcacacttatcgtggtcagctcc

SEQ ID NO: 41413 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgtggttaactacgggagcctggattttagacaccgggtgtccctcacgcgcgacagagatctgtctaccgctcatatggacattcggggacttacacaggatgacaccgccacatatttctgtgcccgccaaaaatttgctagaggcgatcagggctggttctttgacctgtgggggcggggaaccctcatcgtcgtgagctcc

SEQ ID NO: 41414 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaagacggtgtctggcgcggttaactttgggagccctaatttcagacaccgggtgtcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtcgtgtctagc

SEQ ID NO: 41415 - RNA, 375 nt, synthetic construct
  misc_feature 1..375: note = derived and/or modified sequence opt5 from anti-HIV-1_HeavyChain
  source 1..375: mol_type = other RNA
caggcctacctggagcaaagcggctccatcatgaagaaacccggggcttctgtgagagtcagctgctggacctccgaagacattttcgatcggacagagctcatccactgggttcgccaggcccctggacagggcctggaatggattgggtgggtgaagacggtgaccggagcggtcaactttggctctagcgacttcagacagcgggtgtcccttacacgcgatagagacctgtttaccgctcatatggatatccgggggctcacacaaggagacaccgccacatatttctgtgcccgccagaaattttacgctggcggccaggggtggtatttcgatctgtggggaagaggcacccttattgttgtgtctagc

SEQ ID NO: 41416 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggctggcccctggccaggggcttgagtggatcggatgggtgaaaacagtcacgggcgcggtgaactttgggagctccgatttccgccagagagtttctctgacccgggaccgcgatctctttacagctcacatggacattagaggactgacccagggcgatacagccacctacttctgtgcccggcaaaagttttatgctggcgggcagggatggtacttcgacctttggggccgcgggacactgatcgtggtcagctcc

SEQ ID NO: 41417 - RNA, 375 nt, synthetic construct
  misc_feature 1..375: note = derived and/or modified sequence opt5 from anti-HIV-1_HeavyChain
  source 1..375: mol_type = other RNA
gaggcccacctggaacagagcggctccggggtgaagaaacccggagcttctgtcagagttagctgctggacctccgaggacatcttcgaacggacagagctcacgcattgggtgcgccaagcccctggccaggggctggaatggattggatgggtgaagaccgtcacaggcgcggtgaactttgggtctccgaatttcagacagcgggttagccttacccgcgatagagacctgtttacagctcacatggatatccggggactcacccagggcgacacagccacctacttctgtgcccgccaaaaatttgagagaggcgggcagggatggattttcgatctgtggggccgggggacgcttatcgctgtgtcctct

SEQ ID NO: 41418 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatctacgagcggacagaactcattcattgggtgcgccaggcccctggccaggggctggagtggatcggatgggtgaaggcggtctctggcgctgtgaactatgggagccttgatttcagacaccgggtttccctgacgcgcgacagagatctctttaccgcccatatggacattcggggactgacacaggatgacaccgccatctacttctgtgctcgccaaaaatttgccagaggcgatcagggctggttctttgacctttgggggcggggaacactgattgtggtctctagc

SEQ ID NO: 41419 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagcggacagaactcattcattgggtgcgccaggctcctggccaggggctggagtggatcggatgggtcaagacggtgaccggcgccgttaactttgggtctccgaatttcagacaccgggtgagccttacacgcgatagagacctgtttaccgcgcatatggatattcggggactcacacagggcgacaccgctacatacttctgtgcccgccaaaaatttgaaagaggcgggcagggatggtatttcgatctgtggggccgggggacccttatcgtcgtgtcctct

SEQ ID NO: 41420 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaaggcggtgtctggcgctgttaactacgggagccttgattttagacaccgggtgtccctgacgcgcgacagagatctctctaccgcccatatggacattcggggactgacacaggatgacaccgccacatatttctgtgctcgccaaaaatttgccagaggcgatcagggctggttctttgacctttgggggcggggaaccctgatcgtcgtgagctcc

SEQ ID NO: 41421 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggccgcccaatttcagacaccgggttagccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctcctct

SEQ ID NO: 41422 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagaggcggccaggggtggatcttcgatctgtggggacggggcaccctcattgccgtgagctcc

SEQ ID NO: 41423 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgagaaagcccggagcttctgtccgggttagctgctggacctccgaagacatcttcgagcgcacagaactcattcattgggtgagacaggcccctggccaggggctggagtggatcggatgggtgaaaacggtcaccggcgcggtgaactttgggtctagcgatttccggcagcgcgtttcccttacaagagaccgggatctgtttaccgctcacatggacattcgcggactcacacaaggcgataccgccacatacttctgtgccagacagaagttttatgctggcgggcagggatggtacttcgacctgtggggccgggggacccttatcgtggtctctagc

SEQ ID NO: 41424 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagccctaattttcggcaccgcgtttccctgacgagagatcgggacctcttcaccgcccatatggatattcgcggactgacacagggcgacaccgccacatatttttgtgctagacagaaattcgaacggggcgggcaaggatggtactttgatctttggggccgcgggaccctgatcgtggtctctagc

SEQ ID NO: 41425 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtccgggttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggcagaggggctcttatcgtggtctctagc

SEQ ID NO: 41426 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagcgcttacttccgccacagagtttcccttacccgggatcgcgacctgtttacagcccatatggatattagaggactcacccagggcgacacagccacctatttctgtgctcggcaaaagttttacaaaggcgggcagggatggtatttcgatctgtggggccgcgggacacttatcgtggtctctagc

SEQ ID NO: 41427 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcccttgatttccggcatcgcgtgtctctgacaagagaccgggatctcagcaccgcgcacatggacattcgcgggctgacacaggatgacaccgctacatatttttgtgccagacagaaattcgcccggggagatcaaggctggtttttcgacctttggggccgcgggaccctgatcgttgtgtccagc

SEQ ID NO: 41428 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatggatattagaggcctcacccaggacgatacagccacctatttttgtgcccggcaaaaattctacgctgggggacagggctggtattttgacctgtggggccgcgggacacttatcgtggtttcttcc

SEQ ID NO: 41429 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtcacgggcgctgtgaactttgggtctagcgatttcagacagcgggtttccctgacccgcgacagagatctctttacagcccacatggacattcggggactgacccaaggcgatacagccacctacttctgtgctcgccagaaattttatgccggcgggcagggatggtacttcgacctttggggcagagggacactgatcgtggtctctagc

SEQ ID NO: 41430 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggagcggtcaactttggctcctctgatttccggcagcgcgtgagccttaccagagaccgggatctgtttacagctcatatggacattcgcgggctcacccagggagatacagccacctatttctgtgccagacaaaaattttacgctggcggccaggggtggtatttcgacctgtggggacggggcacacttatcgttgtgtccagc

SEQ ID NO: 41431 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacgccgccacctacttctgtgctcgccaaaaatttgaaagaggcgggcagggatggtatttcgatctgtggggccgggggacacttatcgtggtctcctct

SEQ ID NO: 41432 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatatttttgtgctagacagaaattctacgccggcggccaagggtggtattttgatctgtggggacggggcaccctcatcgtggtctctagc

SEQ ID NO: 41433 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttgctgcccacatggatatccggggactcacccaaggcgacacagccacctacttctgtgctcgccagaaatttgaaagaggcgggcagggatggattttcgatctgtggggccgggggacacttatcgccgtgtctagc

SEQ ID NO: 41434 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcgcccagggcgacacagccacctacttctgtgctcgccaaaaatttgaaagaggcgggcagggatggtatttcgatctgtggggccgggggacacttatcgtggtctcctct

SEQ ID NO: 41435 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatggatattagaggcctcacccaggacgatacagccacctatttttgtgcccggcaaaaattcgagcgcgggggacagggctggtactttgacctgtggggcagagggacacttatcgtggtttcttcc

SEQ ID NO: 41436 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagagtgtctctgacacgggatcgcgacctctttaccgctcatatggatatcagaggcctgacacagggggacaccgccacatatttctgtgcccggcaaaaattttacgctggaggccagggctggtatttcgatctttgggggcgcggaaccctgattgttgtgagctcc

SEQ ID NO: 41437 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacaccgggtttcccttacgcgcgatagagacctgtttaccgctcatatggatatccggggactcacacagggcgacaccgccacatacttctgtgcccgccaaaaatttgaaagaggcgggcagggatggtatttcgatctgtggggccgggggacccttattgtggtctctagc

SEQ ID NO: 41438 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcgcgcccctggccaggggctggagtggatcggatgggtgaaaacagtcacgggcgcggtgaactttgggagctccgatttcagacagcgggtttctcttacccgcgacagagatctgtttacagctcacatggacattcggggactcacccagggcgatacagccacctacttctgtgcccgccaaaagttttatgctggcgggcagggatggtacttcgacctgtggggcagagggacacttatcgtggtcagctcc

SEQ ID NO: 41439 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacagcgggtttccctcacgcgcgacagagatctgttcaccgcccacatggacattcggggacttacacaaggcgataccgccacatatttttgtgctcgccagaaattcgaaagaggcgggcagggatggatctttgacctgtggggccgggggaccctcattgccgtgtctagc

SEQ ID NO: 41440 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaattttataagggcgggcagggatggtacttcgacctttggggcagagggacactgattgttgtgtctagc

SEQ ID NO: 41441 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagaagtctgaactcattcattgggtgcggcaggctcctggccaggggctggagtggatcggatgggtgaaaacggtcaccggcgccgtgaactttgggagctccgatttccgccagagagtttctcttacacgggaccgcgatctgtttaccgcgcacatggacattagaggactcacacaaggcgataccgctacatacttctgtgcccggcagaagttttatgccggcgggcagggatggtacttcgacctgtggggccgcgggacccttatcgtggtcagctcc

SEQ ID NO: 41442 - RNA, 375 nt, synthetic construct
  misc_feature 1..375: note = derived and/or modified sequence opt5 from anti-HIV-1_HeavyChain
  source 1..375: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattctacgctgggggacagggctggtattttgacctttggggccgcgggacactgatcgtggttagctct

SEQ ID NO: 41443 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacaggcctgattcattgggtgcgccaggcccccgggcagggacttgaatggatcggctgggtgaaggcggtctctggggctgtgaactacggaagcctggattttagacaccgggtttccctcacgcgcgacagagatctgttcaccgcccatatggacattcggggccttacacaggatgacaccgccacatatttttgtgctcgccaaaaattcgccagaggcgatcaggggtggtttttcgacctgtggggacggggcaccctcatcgtggtctctagc

SEQ ID NO: 41444 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacgtgttcgagcggacggaactcatccattgggtgcgccaggctcctggccaggggctggagtggattggatgggtcaagaccgtgatcggcgccgttaactttgggtctccgaatttcagacaccgggtgagccttacacgcgatagagacctgtttaccgcgcatatggatattcggggactcacacagggcgacaccgctacatacttctgtgcccgccaaaaatttgaaagaggcgggcagggatggtatttcgatctgtggggccgggggacccttatcgtcgtgtcctct

SEQ ID NO: 41445 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggcgctggggtgaagaaacccggagcctccgtcagagtttcttgctggaccagcgaagacatcttcaagacagagctcattcattgggtgcggcaggcgcctggccaggggctggaatggatcggatgggtgaaaattgtctccggcgctgtgaactttgggtctccgaatttccgccagagagttagccttacgcgggatcgcgacctgtttaccgcccacatggatatcagaggactcacacaaggcgacaccgccacatacttctgtgctcggcagaagtttgagcgcggcgggcagggatggattttcgatctgtggggcagagggacccttatcgccgtgtcctct

SEQ ID NO: 41446 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccggatttcagacaccgggtttcccttacccgcgacagagatctgtttacagctcatatggacattcggggactcacccagggcgatacagccacctacttctgtgcccgccaaaaatttgctagaggcgaccaggggtggttctttgatctgtggggacggggcacacttatcgtggtctctagc

SEQ ID NO: 41447 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtctctggcgcggtgaactttgggagccttaatttcagacaccggatttccctgacacgcgatagagacctctttaccgctcatatggatatccggggactgacacagggcgacaccgccacatacttctgtgcccgccaaaagtttgctagaggcgatcaggggtggttctttgacctttggggacggggcaccctgattgttgtgtctagc

SEQ ID NO: 41448 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccatctatttctgtgctcgccaaaaatttgccagaggcgatcagggctggttctttgacctgtgggggcggggaacactcattgtggtcagctcc

SEQ ID NO: 41449 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggacgggatgggtgaaggcggtctctggcgctgtgaactacgggagcctggattttagacaccgggtttccctcacccgcgacagagatctgtctacagcccatatggacatccggggacttacccaggatgacacagccacctatttctgtgctcgccaaaaatttgccagaggcgatcagggctggttctttgacctgtgggggcggggaacactcattgtggtcagctcc

SEQ ID NO: 41450 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacctacacaggatgacaccgccacatatttttgtgctcgccaaaaattcgccagaggcgatcagggctggtttttcgacctttgggggcggggaaccctgatcgtggtctctagc

SEQ ID NO: 41451 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacagggcgataccgccacatatttctgtgctcgccaaaaatttgaaagaggcgggcagggatggtacttcgacctgtggggccgggggaccctcatcgtggtcagctcc

SEQ ID NO: 41452 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagc

SEQ ID NO: 41453 - RNA, 375 nt, synthetic construct
  misc_feature 1..375: note = derived and/or modified sequence opt5 from anti-HIV-1_HeavyChain
  source 1..375: mol_type = other RNA
agacacacctggaacgagagcggctccggggtgaagaaacccggagcctctgtccgggttagctgctggacatccgaagacatcttcgagcgcacggaactgattcattgggtgagacaggctcctggccaagggctcgagtggatcggatgggtgaagaccgtcacaggcaccgtgaattttgggtctctgaacttccggcagcgcgttagccttacaagagatcgggacctgtttaccgcccacatggatattcgcggactcacacagggcgacaccgcgacgtacttctgtgctagacagaaattttatgccggcgggcaaggatggtacttcgatctgtggggccgggggacccttatcgtggtctcctct

SEQ ID NO: 41454 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagagacccggagcctccgtccgggtttcttgctggaccagcgaagacatcttcgagacaacggaactcattcattgggtgcgccaggcgcctggccaggggctggagtggatcggatgggtgaaaaccgtctccggcgctgtgaactttgggtctccgaatttcagacaccgggttagccttacacgcgatagagacctgtttaccgcccatatggatattcggggactcacacagggcgacaccgccacatacttctgtgctcgccaaaagtttgaaagaggcgggcagggatggtatttcgatctgtggggccgggggacccttatcgtggtctcctct

SEQ ID NO: 41455 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactttgggagcccgaatttcagacaccgggtttcccttacgcgcgatagagacctgtttaccgcccatatggatattcggggactcacacagggcgacaccgccacatacttctgtgctcgccaaaaatttgaaagaggcgggcagggatggtatttcgatctgtggggccgggggacccttatcgtggtctctagc

SEQ ID NO: 41456 - RNA, 375 nt, synthetic construct
  misc_feature 1..375: note = derived and/or modified sequence opt5 from anti-HIV-1_HeavyChain
  source 1..375: mol_type = other RNA
caggcccacctgggcaccatcctcgggctggagagcaagaaacccggagcttccgtgagagtctcttgctggacaagcgaagacattttcgagcggacggaacttatccattgggttcgccaagcccctggccaggggctggagtggattggatgggtgaagaccgtgacaggcgcgtccatcctcgctccgaactttagacaccgggtctctctgacccgcgatagagaccttttcacagcccatatggatattcgggggctgacccagggagacacagccacctacttttgtgctcgccagaaattcgaaagaggcggccaagggtggtattttgatctctggggacggggcacgctgatcgtggttagctcc

SEQ ID NO: 41457 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagctctgtttaccgcccatatggacattcggggactcacacagggcgataccgccacatacttctgtgctcgccaaaaatttgccagaggcgaccaggggtggttctttgatctgtggggacggggcacccttatcgtggtctcctct

SEQ ID NO: 41458 - RNA, 375 nt, synthetic construct
  misc_feature 1..375: note = derived and/or modified sequence opt5 from anti-HIV-1_HeavyChain
  source 1..375: mol_type = other RNA
agagtgcacctggagcagagcggctccggggtcaagaaacccggagcctctgttcgggtgagctgctggacctccgaagacatcttcgagcgcacagaactcattcattgggtgagacaagctcctggccaggggctggagtggatcggatgggtcaagacggtgaccggcgccgttaactttgggtctccgaatttccggcaccgcgtgagccttacaagagatcgggacctgtttaccgcgcatatggatattcgcggactcacacagggcgacaccgctacatacttctgtgccagacagaaatttgaacggggcgggcaaggatggtatttcgatctgtggggccgcgggacccttatcgtcgtgtcctct

SEQ ID NO: 41459 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtcaccggcgctgtgaactttgggtccccgaatttcagacagcgggtttctcttacacgcgatagagacctgagcaccgcccacatggatattcggggactcacacaagacgataccgccacatacttttgtgctcgccagaaattcgccagaggcgaccagggctggtttttcgatctgtgggggcggggaacccttatcgtggtctcctct

SEQ ID NO: 41460 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagagacccggggcttccgtgaaagtgtcttgctggaccagcgaagacatcttcgagcggacagaactcattcactgggtccgccaggcccctggacagggcctggagtggatcgggtgggtgaagacggtttccggagcggtgaactttggctctccgaatttcagacatcgggtcagccttacccgcgatagagacctgtttacagctcacatggatattcgggggctcacccaaggagacacagccacctacttctgtgcccgccagaaatttgaaagaggcggccaggggtggtatttcgatctgtggggacggggcacacttatcgtggtttcctct

SEQ ID NO: 41461 - RNA, 375 nt, synthetic construct
  misc_feature 1..375: note = derived and/or modified sequence opt5 from anti-HIV-1_HeavyChain
  source 1..375: mol_type = other RNA
agacacgacctggagcagagcggctccggggtgaagaaacccggagcctctgtccgggttagctgctggacctccgaagatatcttcgagcgcacagaactcattcattgggtgagacaagctcctggccaggggctggagtggatcggatgggtgaagattgtctctggcgccgtgaactttgggagcccgaatttccggcagcgcgtttcccttacgagagaccgggatctgtttaccgcgcacatggacatccgcggactcacacagggcgataccgctacatacttctgtgccagacaaaaatttgaacggggcgggcagggatggattttcgacctgtggggccgcgggacccttatcgccgtgtctagc

SEQ ID NO: 41462 - RNA, 375 nt, synthetic construct
  misc_feature 1..375: note = derived and/or modified sequence opt5 from anti-HIV-1_HeavyChain
  source 1..375: mol_type = other RNA
agacacacctgggaacaggtgtggagcggcgtcaagaaacccggggcctccgttcgggtgtcttgctggacaagcgaggacatcttcgagaagtccgaactgattcattgggtgcgccaagctcctggacagggcctcgagtggatcgggtgggtcaaaacggtgaccggagccgttaactttggctctagcgatttcagacagcgggtgtccctgacacgcgacagagatctttttaccgcgcacatggacattcgggggctgacacagggagataccgctacatacttctgtgcccgccaaaagttttatgccggcggccaggggtggtacttcgacctctggggaagaggcaccctgatcgtcgtgtctagc

SEQ ID NO: 41463 - RNA, 375 nt, synthetic construct
  misc_feature 1..375: note = derived and/or modified sequence opt5 from anti-HIV-1_HeavyChain
  source 1..375: mol_type = other RNA
agacacacctggaacaagagcggctccggggtgaaaaagcccggagcctctgtccgggttagctgctggacatccgaggacatcttcgaacgcacggagctgattcattgggtgagacaggctcctggccaagggctcgaatggatcggatgggtgaaagccgtctctggcgcggtgaattacgggagcctggattttcggcaccgcgtttcccttaccagagaccgggatctgtctacagctcatatggacattcgcggactcacccaggatgacacagccacctatttctgtgccagacagaagtttgctcggggcgatcagggctggttctttgacctgtgggggcgcggaacacttatcgtggtcagctcc

SEQ ID NO: 41464 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagaagtctgaactgattcattgggtgcgccaagctcctggccaggggctcgagtggatcggatgggtgaaaacggtcaccggcgccgtgaactttgggagctccgatttcagacagcgggtttctctgacacgcgacagagatctttttaccgcgcacatggacattcggggactgacacagggcgataccgctacatacttctgtgcccgccaaaagtttgaaagaggcgggcagggatggatcttcgacctctggggccgggggaccctgattgccgtgagctcc

SEQ ID NO: 41465 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaagcggtctctggcgctgtgaactacgggagccttgattttagacaccgggtttccctgacccgcgacagagatctctctacagcccatatggacattcggggactgacccaggatgacacagccacctatttctgtgctcgccaaaagtttgccagaggcgatcagggctggttctttgacctttgggggcggggaacactgatcgtggtcagctcc

SEQ ID NO: 41466 - RNA, 375 nt, synthetic construct
  misc_feature 1..375: note = derived and/or modified sequence opt5 from anti-HIV-1_HeavyChain
  source 1..375: mol_type = other RNA
agacacgacctggagcagagcggctccggggtgaagaaacccggagcctctgtccgggttagctgctggacctccgaagatatcttcgagcgcacagaactcattcattgggtgagacaagctcctggccaggggctggagtggatcggatgggtgaagacggtcaccggcgccgtgaactttgggtctccgaatttccggcaccgcgttagccttacaagagaccgggatctgtttaccgcgcatatggacattcgcggactcacacagggcgataccgctacatacttctgtgccagacagaaatttgaacggggcgggcaaggatggtatttcgacctgtggggccgcgggacccttatcgtggtctcctct

SEQ ID NO: 41467 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaactgggagcctctgtccgggttagctgctggacatccgaagacatcttcgagcgcacggaactcattcattgggtgagacaagctcccggccaggggctggagtggatcggatgggtgaaggccgtctctggcgcggtgaactacgggagccttgattttcggcaccgcgtttccctgaccagagaccgggatctctctacagctcatatggacattcgcggactgacccaggatgacacagccacctatttctgtgccagacagaaatttgctcggggcgatcaaggctggttctttgacctttgggggcgcggaacactgatcgtggtcagctcc

SEQ ID NO: 41468 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgcctcgcctccgaagacatcttcgagaagtctgaactgattcattgggtgcggcaggcgcctggccaggggcttgagtggatcggatgggtgaaaaccgtcacaggcgctgtgaactttgggagctccgatttccgccagagagtttctctgacgcgggaccgcgatctctttaccgcccacatggacattagaggactgacacaaggcgataccgccacatacttctgtgctcggcagaagttttatgccggcgggcagggatggtacttcgacctttggggccgcgggaccctgatcgtggtcagctcc

SEQ ID NO: 41469 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagaagtccgaactcattcattgggtgcggcaggcgcctggccaggggctggagtggatcggatgggtgaaaacagtcacgggcgctgtgaactttgggtctagcgatttccgccagagagtttcccttacccgggaccgcgatctgtttacagcccacatggacattagaggactcacccaaggcgatacagccacctacttctgtgctcggcagaagttttatgccggcgggcagggatggtacttcgacctgtggggccgcgggacacttatcgtggtctctagc

SEQ ID NO: 41470 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagaagtctgaactgattcattgggtgcgccaagctcctggccaggggctcgagtggatcggatgggtgaaaacggtcaccggcgccgtgaactttgggagctccgatttcagacagcgggtttctctgacacgcgacagagatctttttaccgcgcacatggacattcggggactgacacagggcgataccgctacatacttctgtgcccgccaaaagttttatgccggcgggcagggatggtacttcgacctctggggcagagggaccctgatcgtggtcagctcc

SEQ ID NO: 41471 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaactttgggtctccgaatttccggcaccgcgttagcctgaccagagatcgggacctttttacagcgcatatggatattcgcggactgacccacggcgacacagctacctacttctgtgccagacagaaatttgaacggggcgggcagggatggtatttcgatctctggggccgcgggacgctgatcgtggtctcctct

SEQ ID NO: 41472 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaactgggagcctctgtccgggttagctgctggacatccgaagacatcttcgagcgcacggaactcattcattgggtgagacaagctcccggccaggggctggagtggatcggatgggtgaaggccgtctctggcgcggtgaactacgggagccttgattttcggcaccgcgtttccctgaccagagaccgggatctcttcacagctcatatggacattcgcggactgacccagggcgatacagccacctatttttgtgccagacagaaattctacgctggcgggcaaggatggtattttgacctttggggccgggggacactgatcgtggtctctagc

SEQ ID NO: 41473 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaactcggagcctccgtcagagtttcttgctggaccagcgaagacatcttcgagcggacagaactgattcattgggtgcgccaggcgcccggccaggggcttgagtggatcggatgggtgaaggctgtctccggcgccgtgaactacgggtctctggattttagacaccgggttagcctcacgcgcgacagagatctgttcaccgcccatatggacattcggggacttacacaggatgacaccgctacatatttttgtgcccgccaaaaattcgctagaggcgatcagggctggtttttcgacctgtgggggcggggaaccctcatcgtggtctcctct

SEQ ID NO: 41474 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcgaagttagctgctggacctccgaggacatcttcgaaagaacagagctcattcattgggtgcggcaggcccctggccaggggctggaatggatcggatgggtgaagacggtctctggcgcggtgaactttgggagcccgaatttccgccacagagtttcccttacccgggatcgcgacctgtttacagctcatatggatattagaggactcacccagggcgacacagccacctacttctgtgcccggcaaaaatttgctcgcggcgatcaggggtggttctttgacctgtggggaagaggcacacttatcgtggtctctagc

SEQ ID NO: 41475 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggcgctggggtgaagaaactcggagcctccgtcagagtttcttgctggaccagcgaagacatcttcaagacagagctgattcattgggtgcggcaggcgcccggccaggggcttgaatggatcggatgggtgaaagctgtctccggcgccgtgaactacgggtctctggattttcgccacagagttagcctcacgcgggaccgcgatctgtccaccgcccatatggacattagaggacttacacaggatgacaccgctacatatttctgtgcccggcaaaagtttgctcgcggcgatcagggctggttctttgacctgtgggggagaggaaccctcatcgtggtctctagc

SEQ ID NO: 41476 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaactttgggtctccgaatttccggcaccgcgttagcctgaccagagatcgggacctttttacagcgcatatggatattcgcggactgacccagggcgacacagctacctacttctgtgccagacagaaattttatgccggcgggcaaggatggtacttcgatctctggggccgggggacgctgatcgtggtctcctct

SEQ ID NO: 41477 - RNA, 375 nt, synthetic construct
  misc_feature 1..375: note = derived and/or modified sequence opt5 from anti-HIV-1_HeavyChain
  source 1..375: mol_type = other RNA
agacacacctgggagcggatctggagcggcgtgaagaaacccggggcctccgtccgcgtttcttgctggacaagcgaagacattttcgagagaacggaactgatccattgggtgcggcaggctcctggacaaggcctcgagtggattgggtgggtgaagatcgtctccggagccgtgaactttggctctccgaatttccgccagagagttagcctgacccgggatcgcgacctttttacagcgcacatggatattagagggctgacccagggagacacagctacctacttctgtgcccggcagaaatttgaacgcggcggccaagggtggatcttcgatctctggggaagaggcacactgatcgccgtgtcctct

SEQ ID NO: 41478 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggcgccttacacaggatgacaccgccacatatttctgtgctagacaaaaatttgcccggggagatcagggctggttctttgacctgtggggccgcgggaccctcatcgtggtcagctcc

SEQ ID NO: 41479 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaacccggagcctctgttcgggtgagctgctggacatccgaagacatcttcgagcgcacggaactgattcattgggtgagacaagctcctggccaggggctcgagtggatcggatgggtcaagaccgtgacaggcgccgttaactttgggtctccgaatttccggcaccgcgtgagcctgaccagagatcgggacctttttacagcgcatatggatattcgcggactgacccagggcgacacagctacctacttctgtgccagacagaaatttgaacggggcgggcaaggatggtatttcgatctctggggccgcgggacgctgatcgtcgtgtcctct

SEQ ID NO: 41480 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttaccccggaccgggatctgtttacagctcacatggacattcgcggactcacccaaggcgatacagccacctacttctgtgccagacagaagttttatgctggcgggcagggatggtacttcgacctgtggggccgggggacacttatcgtggtcagctcc

SEQ ID NO: 41481 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaagttggagcctctgtgcgggtgagctgctggacatccgaagacatcttcgagcgcacggaactgattcattgggtcagacaagctcccggccaggggctcgagtggatcggatgggtgaaggccgtttctggcgcggtgaactacgggagcctggattttcggcaccgcgtctcccttaccagagaccgggatctgttcacagctcatatggacattcgcggactcacccaggatgacacagccatctatttttgtgccagacagaaattcgctcggggcgatcaaggctggtttttcgacctgtgggggcgcggaacccttattgtggtttctagc

SEQ ID NO: 41482 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctgggcctccgaagacatcttcgagcggaccgaactcattcattgggtgcgccaggcgcctggccaggggctggagtggatcggatgggtgaagacagtctctggcgctgtgaactttgggagcccgaatttcagacaccgggtttcccttacgcgcgatagagacctgtttaccgcccatatggatattcggggactcacacagggcgacaccgccacatacttctgtgctcgccaaaaatttgaaagaggcgggcagggatggtatttcgatctgtggggccgggggacccttatcgtggtctctagc

SEQ ID NO: 41483 - RNA, 375 nt, synthetic construct
  misc_feature 1..375: note = derived and/or modified sequence opt5 from anti-HIV-1_HeavyChain
  source 1..375: mol_type = other RNA
agacacacctgggaacaggtgtggagcggcgtcaagaaacccggggcctccgttcgggtgtcttgctggacaagcgaggacatcttcgagcgcacggaactgattcattgggtgagacaagctcctggacagggcctcgagtggatcgggtgggtcaagaccgtgacaggagccgttaactttggctccccgaatttccggcaccgcgtgtctctgaccagagatcgggacctttttacagcgcatatggatattcgcgggctgacccagggagacacagctacctacttctgtgccagacagaaatttgaacggggcggccaagggtggtatttcgatctctggggacgcggcacgctgatcgtcgtgagctcc

SEQ ID NO: 41484 - RNA, 375 nt, synthetic construct
  misc_feature 1..375: note = derived and/or modified sequence opt5 from anti-HIV-1_HeavyChain
  source 1..375: mol_type = other RNA
agacacacctggcggcagagcggctccggggtgaagaaactgggagcctctgtccgcgttagctgctggacatccgaggacatcttcgaaagaacggagctcattcattgggtgcggcaagctcccggccaggggctggaatggatcggatgggtgaaggccgtctctggcgtggttaactacgggagccttgattttcgccacagagtgtccctgacccgggaccgcgatctctctacagcgcatatggacattagaggactgacccaggatgacacagctacctatttctgtgcccggcagaaatttgcccgcggcgatcaaggctggttctttgacctttgggggagaggaacactgatcgtcgtgagctcc

SEQ ID NO: 41485 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccggcgacatcttcgaacggacagagctcattcattgggtgcgccaggcccctgggcagggactggaatggatcggctgggtgaagattgtctctggggcggtgaactttggaagcccgaatttcagacagcgggtttcccttacgcgcgatagagacctgtttaccgctcacatggatatccggggcctcacacaaggcgacaccgccacatacttctgtgcccgccagaaatttgagagagggggacagggctggattttcgatctgtgggggcggggaacccttatcgctgtgtctagc

SEQ ID NO: 41486 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaacccggagcctctgttcgggtgagctgctggacatccgaagacatcttcgagaagtctgaactgattcattgggtgcgccaagctcctggccaggggctcgagtggatcggatgggtcaaaacggtgaccggcgccgttaactttgggagctccgatttcagacagcgggtgtctctgacacgcgacagagatctttttaccgcgcacatggacattcggggactgacacagggcgataccgctacatacttctgtgcccgccaaaagttttatgccggcgggcagggatggtacttcgacctctggggcagagggaccctgatcgtcgtgagctcc

SEQ ID NO: 41487 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaaagatgggcttctgtccgggttagctgctggacctccgaagacatcttcgagcgcacagaactcattcattgggtgagacaggcccccggacagggcctggagtggatcgggtgggtgaaggcggtctctggagctgtgaactacggcagccttgattttcggcaccgcgtttccctgacgagagaccgggatctcttcaccgcccatatggacattcgcgggctgacacaggatgacaccgccacatatttttgtgctagacaaaaattcgcccggggagatcagggctggtttttcgacctttggggccgcgggaccctgatcgtggtctctagc

SEQ ID NO: 41488 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagcggcccggagcctctgttcgcgtgagctgctggacatccgaagacatcttcgagacgaccgaactgattcattgggtgagacaagctcctggccaggggctcgagtggatcggatgggtcaaaacagtgaccggcgccgttaactttgggtctagcgatttccggcagcgcgtgtccctgacaagagaccgggatctttttaccgcgcacatggacattcgcggactgacacagggcgataccgctacgtacttctgtgccagacaaaagttttatgccggcgggcagggatggtacttcgacctctggggccgggggaccctgatcgtcgtgtctagc

SEQ ID NO: 41489 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagaggactgttcaccgcccatatggatattcggggccttacacaggacgataccgccacatatttttgtgctcgccaaaaattcgccagaggcgaccaggggtggtttttcgatctgtggggacggggcaccctcatcgtggtctctagc

SEQ ID NO: 41490 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagaagtctgaactcattcattgggtgcggcaggctcctggccaggggctggagtggatcggatgggtcaaaacagtgacgggcgccgcgaactttgggagctccgatttccgccagagagtttctcttaccccggaccgggatctgtttacagctcacatggacattcgcggactcacccaaggcgatacagccacctacttctgtgccagacagaagttttataaaggcgggcagggatggtacttcgacctgtggggccgggggacacttatcgtggtcagctcc

SEQ ID NO: 41491 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgatacaacggagctcattcattgggtgcggcaggcgcctggccaggggctggaatggatcggatgggtgaagattgtctccggcgctgtgaactttgggtctccgaatttccgccagagagttagccttacccgggaccgcgatctgtttacagcccacatggacatcagaggactcacccaaggcgatacagccacctacttctgtgctcggcagaaatttgagcgcggcgggcagggatggattttcgacctgtggggcagagggacacttatcgccgtgtcctct

SEQ ID NO: 41492 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctcccgggacatcttcgaacgcacagagctgattcattgggtgagacaggcccccggccaggggcttgaatggatcggatgggtgaaggcggtctctggcgctgtgaactacgggagcctggattttcggcaccgcgtttccctcacgagagaccgggatctgtctaccgcccatatggacattcgcggacttacacaggatgacaccgccacatatttctgtgctagacaaaaatttgcccggggcgatcagggctggttctttgacctgtgggggcgcggaaccctcatcgtggtcagctcc

SEQ ID NO: 41493 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgcctggcctccgaagacatcttcgagcggaccgaacttattcattgggtgcgccaggcgcccggccaggggctggagtggatcggatgggtgaaggctgtctctggcgccgtgaactacgggagcctcgattttagacaccgggtttccctgacacgcgacagagatctttctacggcccatatggacattcggggactgacccaggatgacacagctacctatttctgtgcccgccaaaaatttgctagaggcgatcagggctggttctttgacctctgggggcggggaacactgatcgtggtcagctcc

SEQ ID NO: 41494 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggccttccgaagacatcttcgagcggaccgaactcattcattgggtgcgccaggccccgggccaggggctggagtggatcggatgggtgaagacagtcacgggcaccgtgaactttgggtctcttaatttcagacagcgggttagcctgacacgcgatagagacctctttaccgcgcacatggatattcggggactgacacaaggcgacaccgctacatacttctgtgcccgccagaaatttgaaagaggcgggcagggatggtatttcgatctttggggccgggggaccctgatcgtggtctcctct

SEQ ID NO: 41495 - RNA, 375 nt, synthetic construct
  misc_feature 1..375: note = derived and/or modified sequence opt5 from anti-HIV-1_HeavyChain
  source 1..375: mol_type = other RNA
agagcccacctggagcagagcggctccgaatggaagaaactcggggcttctgtgcgggtcagctgctggacctccggagacatcttcgagcgcacagaactgattcattgggttagacaagcccccggccaggggcttgagtggatcggatgggtgaaggcggtgtctggcgctgtcaactacgggagcctggattttcggcaccgcgtgtccctcacgagagaccgggatctgttcaccgcccatatggacattcgcggacttacacaggatgacaccgccacatatttttgtgctagacagaaattcgcccggggcgatcaaggctggtttttcgacctgtgggggcgcggaaccctcatcgttgtgtctagc

SEQ ID NO: 41496 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaactgggagcctctgttaacgtgagctgctggacatccgaagacatcttcgagcggacggaactcattcattgggtgcgccaagctcccggccaggggctggagtggatcggatgggtcaaggccgtgtctggcgcggttaattacgggagccttgattttagacaccgggtgtccctgacccgcgacagagatctcttcacagctcatatggacattcggggactgacccaggatgacacagccacctatttttgtgcccgccagaaattcgctagaggcgatcaaggctggtttttcgacctttgggggcggggaacactgatcgtcgtgtctagc

SEQ ID NO: 41497 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaccggtcacaggcgcggtgaactttgggagctccgatttccgccagagagtttctcttacgcgggaccgcgatctgtttaccgctcacatggacattagaggactcacacaaggcgataccgccacatacttctgtgcccggcagaagttttatgctggcgggcagggatggtacttcgacctgtggggccgcgggacccttatcgtggtcagctcc

SEQ ID NO: 41498 - RNA, 375 nt, synthetic construct
  misc_feature 1..375: note = derived and/or modified sequence opt5 from anti-HIV-1_HeavyChain
  source 1..375: mol_type = other RNA
agacacacctggaacaagagcggctccggggtgaaaaagcccggagcctctgtccgggttagctgctggacatccgaggacatcttcgaacgcacggagctgattcattgggtgagacaggctcctggccaagggctcgaatggatcggatgggtgaaaaccgtcacaggcgccgtgaattttgggtctccgaacttccggcaccgcgttagcctgaccagagatcgggacctttttacagcgcatatggatattcgcggactgacccagggcgacacagctacctacttctgtgccagacagaagtttgagcggggcgggcagggatggtatttcgatctctggggccgcgggacgctgatcgtggtctcctct

SEQ ID NO: 41499 - RNA, 375 nt, synthetic construct
  misc_feature 1..375: note = derived and/or modified sequence opt5 from anti-HIV-1_HeavyChain
  source 1..375: mol_type = other RNA
caggcccacagcgagcaatccggctctggggtgaagaaacccggagctagcgtcagagtttcctgctggacctctgaagacatcttcgagcggacagaactgattcattgggtgcgccaggcccctggccaggggctcgagtggatcggatgggtgaagattgtcagcggcgcggtgaactttgggtccccgaatttcagacagcgggtttctctgacgcgcgatagagacctttttaccgctcacatggatatccggggactgacacaaggcgacaccgccacatacttctgtgcccgccagaaatttgaaagaggcgggcagggatggattttcgatctctggggccgggggaccctgatcgctgtgagctcc

SEQ ID NO: 41500 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagagacccggagcctccgtccgggtttcttgctggaccagcgaagacatcttcgagacaacggaactcattcattgggtgcgccaggcgcctggccaggggctggagtggatcggatgggtgaaaaccgtcacaggcgctgtgaactttgggtccccgaatttcagacaccgggtttctcttacccgcgatagagacctgtttacagcccatatggatattcggggactcacccagggcgacacagccacctacttctgtgctcgccaaaagtttgaaagaggcgggcagggatggtatttcgatctgtggggccgggggacgcttatcgtggtcagctcc

SEQ ID NO: 41501 - RNA, 375 nt, synthetic construct
  misc_feature 1..375: note = derived and/or modified sequence opt5 from anti-HIV-1_HeavyChain
  source 1..375: mol_type = other RNA
ggccacacctgggagcagagcggggccggagtgaagaaactgggcgcttccgtcagagtttcttgctggacaagcgaagacatcttcgagcggacggaactcattcattgggtgcgccaagcccccgggcagggactggagtggatcggctgggtgaaggcggtctccggggctgtgaactacggatctcttgattttagacaccgggttagcctgacccgcgacagagatctcttcacagcccatatggacattcggggcctgacccaggatgacacagccatctatttttgtgctcgccagaaattcgccagaggcgatcaagggtggtttttcgacctttggggacggggcaccctgattgtggtctcctct

SEQ ID NO: 41502 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccggatctggcgtgaagaaactgggggccagcgtcagagtttcctgctggacatctgaagacatcttcgagcggacggaactcattcactgggtgcgccaggctcctggacaaggcctggagtggatcgggtgggtgaaggccgtcagcggagcggtgaactacggctcccttgattttagacatcgggtttctctgacccgcgacagagatctcagcacagctcacatggacattcggggcctgacccaggatgacacagccacctatttctgtgcccgccagaaatttgctagaggggatcagggatggttctttgacctttggggccgggggacactgatcgtggtctccagc

SEQ ID NO: 41503 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccggatctggcgtgaagatgcctggggccagcgtcagagtttcctgctggacatctgaagacatcttcgagcggacggaactgattcactgggtgcgccaggctccgggacaaggcctcgagtggatcgggtgggtgaaaaccgtcagcggagccgtgaactttggctcccccaatttcagacatcgggtttctctgacacgcgatagagacctttttaccgcgcacatggatattcggggcctgacacagggggacaccgctacatacttctgtgcccgccagaagtttgaaagaggaggccaggggtggtatttcgatctctggggacggggcaccctgatcgtggtcagctcc

SEQ ID NO: 41504 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggcgccggggtgaagaaacccggagcttccgtccgggtttcttgctggacaagcgaagacatcttcgagcgcacggaactgattcattgggtgagacaagcccctggccaggggctcgagtggatcggatgggtgaagaccgtctccggcgcggtgaactttgggtctccgaatttccggcaccgcgttagcctgacaagagatcgggacctttttaccgctcatatggatattcgcggactgacacagggcgacaccgccacatacttctgtgccagacagaaatttgaacggggcgggcaaggatggtatttcgatctctggggccgcgggaccctgatcgtggtctcctct

SEQ ID NO: 41505 - RNA, 375 nt, synthetic construct
  misc_feature 1..375: note = derived and/or modified sequence opt5 from anti-HIV-1_HeavyChain
  source 1..375: mol_type = other RNA
ggcacccccgggaacaagagcggatccggcgtgaaaaagcctggggcctctgtcagagttagctgctggacatccgaggacatcttcgaaaaatctgagctgattcactgggtgcggcaggctccgggacaaggcctcgaatggatcgggtgggtgaagacggtcaccggagccgtgaattttggcagctccgatttccgccagagagtttctctgacacgggaccgcgatctttttaccgcgcatatggacattagaggcctgacacagggggataccgctacatacttctgtgcccggcagaaattttatgccggaggccaagggtggtacttcgacctctggggacgcggcaccctgatcgtggtcagctcc

SEQ ID NO: 41506 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggagctccgaagacatcttcgagcggaccgaactcattcattgggtgcgccaggcgcctggccaggggctggagtggatcggatgggtgaagacagtcacgggcgctgtgaactttgggtctccgaatttcagacaccgggttagccttacccgcgatagagacctgtttacagcccatatggatattcggggactcacccagggcgacacagccacctacttctgtgctcgccaaaaatttgaaagaggcgggcagggatggtatttcgatctgtggggccgggggacacttatcgtggtctcctct

SEQ ID NO: 41507 - RNA, 375 nt, synthetic construct
  misc_feature 1..375: note = derived and/or modified sequence opt5 from anti-HIV-1_HeavyChain
  source 1..375: mol_type = other RNA
ggcacccccgggaacaagagcggatccggcgtgaaaaagcctggggcctctgtcagagttagctgctggacatccgaggacatcttcgaacggacggagctgattcactgggtgcgccaggctccgggacaaggcctcgaatggatcgggtgggtgaaaaccgtcacaggagccgtgaattttggctctcccaacttcagacatcgggttagcctgacccgcgatagagacctttttacagcgcacatggatattcggggcctgacccagggggacacagctacctacttctgtgcccgccagaagtttgagagaggaggccaggggtggatcttcgatctctggggacggggcacgctgattgccgtgtcctct

SEQ ID NO: 41508 - RNA, 375 nt, synthetic construct
  misc_feature 1..375: note = derived and/or modified sequence opt5 from anti-HIV-1_HeavyChain
  source 1..375: mol_type = other RNA
ggcacccccgggaacaagagcggatccggcgtgaaaaagcctggggcctctgtcagagttagctgctggtcctctgaggacatcttcgaacggacagagctgattcactgggtgcgccaggctccgggacaaggcctcgaatggatcgggtgggtgaaaacggtcaccggagccgtgaattttggcagcctggatttcagacatcggatttcccttacacgcgacagagatctgtttaccgcgcacatggacatccggggcctcacacagggggataccgctacatacttctgtgcccgccagaagtttgagagaggaggccaggggtggattttcgacctgtggggacggggcacccttatcgccgtttctagc

SEQ ID NO: 41509 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccgggggatgggtccgggtttcttgctggaccagcgaagacatcttcgagcgctccgaactcatttactgggtgagacaggcccctggccaggggctggagtggatcggatgggtgaaaacagtcacgggcgcggtgaactttgggtctccgaatttccggcatcgcgttagccttaccagagatcgggacctgtttacagctcacatggatattcgcggactcacccagggcgacacagccacctatttctgtgccagacaaaagtttgaacggggcgggcagggatggtacttcgatctgtggggccgcgggacacttatcgtggtctcctct

SEQ ID NO: 41510 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacgtctagcggcgcggtcaactttgggtccccgaatttcagaacccgggtgtctcttacacgcgatagagacctgtttaccgctcacatggatattcggggactcacacagggcgacaccgccacatacttctgtgcccgccaaaaatttgaaagaggcgggcagggatggtatttcgatctgtggggccgggggacccttatcgttgtgagctcc

SEQ ID NO: 41511 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtctccggcgctgtgaactttgggtctccgaatttcagacaccgggttagccttacccgcgatagagacctgtttacagcccatatggatattcggggactcacccagggcgacacagccacctacttctgtgctcgccaaaaatttgaaagaggcgggcagggatggtatttcgatctgtggggccgggggacacttatcgtggtctcctct

SEQ ID NO: 41512 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaactttgggtctccgaatttccggcaccgcgttagcctgaccagagatcgggacctttttacagcgcatatggatattcgcggactgacccagggcgacacagctacctacttctgtgccagacagaaatttgaacggggcgggcaaggatggtatttcgatctctggggccgcgggacgctgatcgtggtctcctct

SEQ ID NO: 41513 - RNA, 375 nt, synthetic construct
  misc_feature 1..375: note = derived and/or modified sequence opt5 from anti-HIV-1_HeavyChain
  source 1..375: mol_type = other RNA
ggcaccacatggaacaagagcgggtccggagtgaaaaagcccggcgcctctgtcagagttagctgctggacgtccgaggacatcttcgaacggaccgagctgattcactgggtgcgccaggctcctgggcaaggactcgaatggatcggctgggtgaaaacagtcaccggggccgtgaattttggatctccgaacttcagacatcgggttagcctgacacgcgatagagacctttttaccgcgcacatggatattcggggcctgacacagggcgacaccgctacgtacttctgtgcccgccagaagtttgagagagggggacagggctggtatttcgatctctgggggcggggaaccctgatcgtggtctcctct

SEQ ID NO: 41514 - RNA, 375 nt, synthetic construct
  misc_feature 1..375: note = derived and/or modified sequence opt5 from anti-HIV-1_HeavyChain
  source 1..375: mol_type = other RNA
agacacacctggaacgagagcggctccggggtgaagaaacccggagcctctgtccgggttagctgctggacatccgaagacatcttcgagaagtctgaactgattcattgggtgcgccaggctcctggccaagggctcgagtggatcggatgggtgaaaacggtcaccggcgccgtgaattttgggagctccgatttcagacagcgggtttctctgacacgcgacagagatctttttaccgcgcacatggacattcggggactgacacagggcgataccgctacatacttctgtgcccgccagaagttttatgccggcgggcaaggatggtacttcgacctctggggcagagggaccctgatcgtggtcagctcc

SEQ ID NO: 41515 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccggcaacatcttcgaacggacagagctgattcattgggtgcgccaggcccccgggcagggacttgaatggatcggctgggtgaaggcggtctctggggctgtgaattacggaagcctggactttagacaccgggtttccctcacgcgcgatagagacctgtctaccgcccatatggatattcggggccttacacaggacgataccgccacatatttctgtgctcgccaaaaatttgccagaggcgaccaggggtggttctttgatctgtggggacggggcaccctcatcgtggtcagctcc

SEQ ID NO: 41516 - RNA, 378 nt, synthetic construct
  misc_feature 1..378: note = derived and/or modified sequence opt5 from anti-HIV-1_HeavyChain
  source 1..378: mol_type = other RNA
agatgcagcatggagcagcccggctggtccgaaaagcctggggcctctgtgaccctgagctgtaaaacagctgacgaggatgtcttcgacgccgcgtacatgcactgggttcggcaagctccgggacagacgtttgaatggctcggctggatgaagcccgtgaccggggccgtgtcctatgcccgcaaattccagggaagagtctctttttacatgacacgggagctgggcatggcttatatggatcttcgcaacctgagattcgacgataccgccgtgtacttttgcgctcggaagacagccggggacgttagcggagataatcgcggctatttctttgacctctggggcagagggtcccgggtgatcgtctctagc

SEQ ID NO: 41517 - RNA, 375 nt, synthetic construct
  misc_feature 1..375: note = derived and/or modified sequence opt5 from anti-HIV-1_HeavyChain
  source 1..375: mol_type = other RNA
agacacaccagcgagcagtccggctctggggtgaagaaacccggagccagcgtccgggtttcctgctggacatctgaagacatcttcgagcgcagcgaactgattcattgggtgagacaagctcctggccaggggctcgagtggatcggatgggtgaagacggtcaccggcgccgtgaactttgggtccccgaatttccggcaccgcgtttctctgacaagagatcgggacctttttaccgcgcatatggatattcgcggactgacacagggcgacaccgctacatacttctgtgccagacagaaatattacgccggcgggcaaggatggtattttgatctctggggccgggggaccctgatcgtggtcagctcc

SEQ ID NO: 41518 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggcgccggggtcaagaaacccggagcttccgttcgggtgtcttgctggacaagcgaagacatcttcgagcgcacggaactgattcattgggtgagacaagcccctggccaggggctcgagtggatcggatgggtcaagaccgtgtccggcgcggttaactttgggtctccgaatttccggcaccgcgtgagcctgacaagagatcgggacctttttaccgctcatatggatattcgcggactgacacagggcgacaccgccacatacttctgtgccagacagaaatttgaacggggcgggcaaggatggtatttcgatctctggggccgcgggaccctgatcgtcgtgtcctct

SEQ ID NO: 41519 - RNA, 375 nt, synthetic construct
  misc_feature 1..375: note = derived and/or modified sequence opt5 from anti-HIV-1_HeavyChain
  source 1..375: mol_type = other RNA
ggcaccccctggaacgagagcgggtccggagtgaagaaacctggcgcctctgtcagagttagctgctggacatccgaagacatcttcgagaagtctgaactgattcactgggtgcggcaggctccggggcaaggactcgagtggatcggctgggtgaaaacggtcaccggggccgtgaattttggaagccccaacttccgccatagagtttccctgacacgggatcgcgacctttttaccgcgcacatggatattagaggcctgacacagggcgacaccgctacatacttctgtgcccggcagaagtttgaacgcgggggacagggctggtatttcgatctctgggggagaggaaccctgatcgtggtctctagc

SEQ ID NO: 41520 - RNA, 375 nt, synthetic construct
  misc_feature 1..375: note = derived and/or modified sequence opt5 from anti-HIV-1_HeavyChain
  source 1..375: mol_type = other RNA
agacacgacctggagcccagcggctccggggtgaagaaacctggagcctctgtccgggttagctgctggacctccgaagatatcttcgagcgcacagaactcattcattgggtgagacaggctccgggccaagggctggagtggatcggatgggtgaagacggtcaccggcgccgtgaactttgggtctcttgacttccggcaccgcattagcctgacaagagatcgggacctctttaccgcgcatatggatatccgcggactgacacagggcgacaccgctacatacttctgtgccagacagaaatttgaatcccggtataccggcgggcagggatggtacttcgatctttggggccgcgggacgcacattgtt

SEQ ID NO: 41521 - RNA, 375 nt, synthetic construct
  misc_feature 1..375: note = derived and/or modified sequence opt5 from anti-HIV-1_HeavyChain
  source 1..375: mol_type = other RNA
agacacaccgtggagcagagcggctccggggtcaagaaactgggagcctctgttcgggtgagctgcctcgcttccgaagacatcttcgagcgcacagaactgattcattgggtgagacaagcccccggccaggggcttgagtggatcggatgggtcaaggcggtgtctggcgctgttaactacgggagcctggattttcggcaccgcgtgtccctcacgagagaccgggatctgtctaccgcccatatggacattcgcggacttacacaggatgacaccgccacatatttctgtgctagacagaaatttgcccggggcgatcaaggctggttctttgacctgtgggggcgcggaaccctcatcgtcgtgagctcc

SEQ ID NO: 41522 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccgaatctaagaaacccggggctagcgtgagagtctcctgctggacctctgaggacatcttcgaaaagagcgagctcattcattgggttcggcaggcccctggacagggcctggaatggatcgggtgggtgaaaacagtgacgggagcggtcaactttggctcctctgatttccgccagagagtgagccttacccgggaccgcgatctgtttacagctcacatggacattagagggctcacccaaggagatacagccacctacttctgtgcccggcagaagttttatgctggcggccaggggtggtacttcgacctgtggggacgcggcacacttatcgttgtgtccagc

SEQ ID NO: 41523 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccgcctctggagtgagacggcctggcgctagcgtccgcgtttcctgctggacatctgaagacatcttcgagagaagcgaactgatttactgggtgcggcaggccccggggcgcggactcgagtggatcggctggattaagctggtgtccggggcggtcaactttggatctgtggatttcagagaccgggttagccttacgcgcgatagagacctgtttaccgctcacatggatatccggggcctcacacaaggcgacaccgccacatatttctgtgcccgccagaaatttgaaagagggggacagggctggtacttcgatctgtgggggcggggaacccttattgtggtctccagc

SEQ ID NO: 41524 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaacccggagcctctgttagagtgagctgctggacctccgaagacatcttcgagaagtctgaactcattcagtgggtgcggcaggctcctggccaggggctggagtggatcggatgggtcaaaacagtgacgggcgccgttaactttgggagctccgatttccgccaaagagtgtctcttacccgggaccgcgatctgtttacagcgcatatggacattagaggactcacccagggcgatacagctacctacttctgtgcccggcagaagttttatgccggcgggcagggatggtacttcgacctgtggggccgcgggacacttatcgtcgtgagctcc

SEQ ID NO: 41525 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccggatctggcgtgaagaaagtcggggccagcgttagagtgtcctgctggacatctgaagacatcttcgagcggacggaactgattcactgggtgcgccaggctcctggacaaggcctcgagtggatcgggtgggtcaaggccgtgagcggagcggttaactacggctccctggattttagacatcgggtgtctcttacccgcgacagagatctgttcacagctcggatggacattcgcggcctcacccaggatgacacagccatctatttttgtgccagacagaaattcgctcgcggggatcagggatggtttttcgacctgtggggccgggggacccttattgtcgtgagctcc

SEQ ID NO: 41526 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccggatctggcgtgaagagacctggggccagcgtccgggtttcctgctggacatctgaagacatcttcgagacgaccgaactgattcactgggtgcgccaggctccgggacaaggcctcgagtggatcgggtgggtgaaaacagtcagcggagccgtgaactttggctccctgaatttcagacatcgggtttctcttacccgcgatagagacctgagcacagcgcacatggatattcggggcctcacccaggacgatacagctacctacttttgtgcccgccagaagttcgccagaggggaccagggatggtttttcgatctgtggggccgggggacgcttatcgtggtctccagc

SEQ ID NO: 41527 - RNA, 372 nt, synthetic construct
  misc_feature 1..372: note = derived and/or modified sequence opt5 from anti-HIV-1_HeavyChain
  source 1..372: mol_type = other RNA
agagcccacctggagcagagcggcgctggggtgaagaaacccggaggctgggtccgggtttcctgctggacctctgaagacatcttcaagacagagctcattcattgggtgcgccaagcccctgggcagggactggaatggatcggctgggtgaaaacggtcaccggggcggtgaactttggaagcccgaatttcagacaccgggtttcccttacacgcgatagagacctgtttaccgctcatatggatattcggggcctcacacagggcgacaccgccacatacttctgtgcccgccagaagtttgagagagggggacaaggctggtatttcgatctgtgggggcggggaacccttatcgtggtctctagc

SEQ ID NO: 41528 - RNA, 378 nt, synthetic construct
  misc_feature 1..378: note = derived and/or modified sequence opt5 from anti-HIV-1_HeavyChain
  source 1..378: mol_type = other RNA
caggtgcaactgatgcagagcggcgccgaggtcaagagacccggggcttccgttaaaatctcttgcaccgccagcggattcacactcacggaccactacatgcattgggtgcggcaggcgcctggccagacctttgaatggctggggtggatgaagccggtgacaggagctgtcaactatgcccgcaaattccaaggcagagtgtccttttaccggacccgcgagcttgggattgcctatatggatctgagaaatctccggttcgacgatacagctgtttacttttgtgcccgcaagaccgctggagacgtgtctggcgataaaagaggcttctttttcgacctgtgggggcggggaagccgcgtcatcgtgtcctct

SEQ ID NO: 41529 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagaaacccggggcttccgtgaaggtgtcttgcaaagccagcggatacaacttcaccggctattacctccactgggtcagacaggcgcctgggcagacatttgaatggctgggatggatgaagccggtgacgggcgctgtttcctatgcccggaaattccaagggcgcgtgtctttttacatgaccagagagcttggaatggcctatatggacctgcggaatctccgcttcgatgacacagctgtctacttttgtgccagaaagaccgctggcgatgtgagcggcgacaaccgggggtatttctttgatctgtggggacgcggctccagagttatcgtgtctagc

SEQ ID NO: 41530 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcaagtccggatctggcgtgaaaaagcctggggccagcgtcagagtttcctgctggacatctgaggacatcttcgaacggacggagctgattcactgggtgcgccaggctccgggacaaggcctcgaatggatcgggtgggtgaaaaccgtcacaggagccgtgaactttggcagccccaatttcagacatcgggtttccctgacccgcgatagagacctttttacagcgcacatggatattcggggcctgacccagggggacacagctacctacttctgtgcccgccagaagtttgagagaggaggccaggggtggtatttcgatctctggggacggggcacgctgatcgtggtctctagc

SEQ ID NO: 41531 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgagctcaagaaacccggggcttccgttaaggtgtcttgcgaagccagcggatactccttcaccgaccaccatatccactgggtgagacaggcgcctggccaggggctggagtggcttggatggatgaacccgaataacggcgatacagcttatgcccaaacgtttctggggcgggtcaccatgacacgcgacacctctattaatacagcctacatggaactcagcagactgacctccgatgacacagctgtgtatttctgtgcccggaaaaccgctggagatgtttctggcgacaagcgcggctttttctttgatctttgggggagaggaagccgggtgatcgtctccagc

SEQ ID NO: 41532 - RNA, 378 nt, synthetic construct
  misc_feature 1..378: note = derived and/or modified sequence opt5 from anti-HIV-1_HeavyChain
  source 1..378: mol_type = other RNA
caggtgtacatgagctccagaggcgggatgaagaaacccggagcctctatgaccgtcagctgcaagacagctgacgaggatatcttcgacgccgcgtatatgcactgggttcggcaagctcctggccagacgtttgaatggctggggtggatgaaaccggtgaccggagccgtgaactacgcccgccagttccagggcagagtctccttttatcggacacgcgagctcgggattgcttacatggatctgagagaccttaagttcgatgacaccgccgtgtatttttgtgctcggaaaacaaagggagatgtttctggcgacgatcgcggcttctttttcgacctgtgggggagaggaacccgggtgatcgtcagctcc

SEQ ID NO: 41533 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagaaacccggggcttccgtgaaggtgtcttgcaaagccagcggatacaccttcacagcgtattacatgcactggctcagacaggctcctggccaggggctggaatggatgggatggatcaacccgcattccggcgggacgaattttgcccaaaagttccagggacgggtcaccatgacacgcgacacctctattacaaccgcctatatggagcttagcagactgcggtccgatgacacagctacctacttttgtgcccgccagaaattcgcttctagatatagcggcgatcagggctcctactttgacctctgggggcggggaacgctgatcgtggttagctct

SEQ ID NO: 41534 - RNA, 375 nt, synthetic construct
  misc_feature 1..375: note = derived and/or modified sequence opt5 from anti-HIV-1_HeavyChain
  source 1..375: mol_type = other RNA
agagcccacctggagcagagcggcgctggggtgaagaaactcggagcctccgtccgggtttcttgctggaccagcgaagacatcttcgagcgcacagaactgattcattgggtgagacaagcgcccggccaggggcttgagtggatcggatgggtgaaggctgtctccggcgccgtgaactacgggtctctggattttcggcaccgcgttagcctcacgagagaccgggatctgttcaccgcccatatggacattcgcggacttacacaggatgacaccgctacatatttttgtgccagacagaaattcgctcggggcgatcaaggctggtttttcgacctgtgggggcgcggaaccctcatcgtggtctcctct

SEQ ID NO: 41535 - RNA, 378 nt, synthetic construct
  misc_feature 1..378: note = derived and/or modified sequence opt5 from anti-HIV-1_HeavyChain
  source 1..378: mol_type = other RNA
caggtgagactggtccaaagcggcgccgacgttaagcagcccggggcttccgtgaaagtgtcttgcaaggccagcggatacaccttcacagattattacatgcactgggtccggcaggcgcctggccagacgtttgagtggctcgggtggatgaaaccggtgaccggagctgtttcctatgcccgcaagttccaaggcagagtgtctttttacatgacacgggaactggggatggcctatatggaccttcgcaacctgagattcgatgacaccgctgtctacttttgtgcccggaaaacagctggagatgtgagcggcgacaatcgcggctatttctttgatctctgggggagaggatcccgggttatcgtgtctagc

SEQ ID NO: 41536 - RNA, 378 nt, synthetic construct
  misc_feature 1..378: note = derived and/or modified sequence opt5 from anti-HIV-1_HeavyChain
  source 1..378: mol_type = other RNA
caggcccacctgggcaacaagagcgggtccggagtgaaaaagcccggcgcttctgtcagagttagctgctggacctccgaggacatcttcgaaaaatctgagctcattcattgggtgcggcaagcccctgggcagggactggaatggatcggctgggtgaagacagtcacgggggcggtgaattttggaagctccgatttccgccagagagtttctcttacccgggaccgcgatctgtttacagctcacatggacattagaggcctcacccagggcgatacagccacctacttctgtgcccggcaaaaattttatgctgggggacagggctggtacttcgacctgtgggggcgcggaacacttatcgtggtcagctcc

SEQ ID NO: 41537 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaaagcggcgggggagtcaagaaacccggcgcctccgttaccctgtcttgcaagacagctgacgaagatgtgttcgacgccgcgtatatgcactgggtgagacaggctcctgggcagacgtttgagtggctcggatggatgaaaccggtcaccggcgccgtgaactacgcccggaagttccaggggcgcgttagcttttatagaacacgggaactgggaatcgcttacatggatcttcgcaatctgagattcgacgataccgccgtgtatttttgtacacggaaaaccgctggcgacgtctccggcgataagcgcgggttctttttcgacctctggggaagaggctctcgggtgattgttagctcc

SEQ ID NO: 41538 - RNA, 381 nt, synthetic construct
  misc_feature 1..381: note = derived and/or modified sequence opt5 from anti-HIV-1_HeavyChain
  source 1..381: mol_type = other RNA
caggtgtacgtcgagcaacccggcgggggagttaagaaacctggcgccagcgtgaccctgtcctgcaagacagctgacgaagatgtgttcgacgccacgtatatgcactgggtcagacaggcgccggggcagacctttgagtggctcggatggatgaaacccgtgacaggcgctgttaactacgcccggaagttccaggggcgcgtgtctttttatagaacccgggaactgggaatcgcctacatggatcttcgcaatctgagattcgacgatacagctgtctatttttgtgcccggaaaaccgctggcgacgtgagcggcgataagcgcgggttctttttcgacctctggggaagaggctcccgggttattgtgtctagc

SEQ ID NO: 41539 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgtcgaagttgagaagcccggggctagcgtgaccctgtcctgcaaaacagccgacgaagatgtgttcgacgcggcttatatgcactgggtcagacaggcccctggacagacgtttgagtggctcggctggatgaagccggtgaccggggccgtttcttacgctcggaaattccagggacgcgtgagcttttatatgacaagagaactgggcatggcctacatggatcttcggaacctgcgcttcgacgataccgctgtctatttttgtgccagaaagacagcgggggacgtgtccggagataatcggggctacttctttgacctctggggccgcgggtctagagttatcgtgagctcc

SEQ ID NO: 41540 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactggggatggcttacatggatcttcggaacctgcgcttcgacgataccgccgtgtatttttgtgcgagaaaaacagccggagacgtctccggcgataatcggggctacttctttgacctctgggggcgcggatctagagtgatcgttagctcc

SEQ ID NO: 41541 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgctggggtcaagaaacccggagccagcgttaccctgtcctgcaagacagcggacgaagatgtgttcgacgctgcctacatgcattgggtgagacaggcccctggccagacgtttgagtggctcgggtggatgaaaccggtcaccggagctgtgaactatgcccggaagttccagggccgcgtttctttttacagaacacgggaactggggatcgcttatatggatcttcgcaatctgagattcgacgataccgccgtgtacttttgtgcgcggaaaacagccggagacgtcagcggcgataagcgcggcttctttttcgacctctgggggagaggatcccgggtgattgtttctagc

SEQ ID NO: 41542 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctgaagtcaagaaacccggggccagcgttaccctgtcctgcgagacagcggacgaagatgtgttcgacgctgcctatatgcactgggtgagacaggcccctggacagacgtttgagtggctcggctggatgaagccggtcaccggggctgtgaactacgcccggaaattccagggacgcgtttctttttatagaacacgggaactgggcatcgcttacatggatcttcgcaatctgagattcgacgataccgccgtgtatttttgtgcgcggaagacagccggggacgtcagcggagataaacgcggcttctttttcgacctctggggcagagggtcccgggtgattgtttctagc

SEQ ID NO: 41543 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaacccggcgggggagtcaagaaacctggcgccagcgttaccctgtcctgcaagacagctgacgaagatgtgttcgacgccgcgtatatgcactgggtgagacaggctccggggcagacgtttgagtggctcggatggatgaaacccgtcaccggcgccgtgaactacgcccggaagttccaggggcgcgtttctttttatagaacacgggaactgggaatcgcttacatggatcttcgcaatctgagattcgacgataccgccgtgtatttttgtgctcggaaaacagccggcgacgtcagcggcgataagcgcgggttctttttcgacctctggggaagaggctcccgggtgattgtttctagc

SEQ ID NO: 41544 - RNA, 372 nt, synthetic construct
  misc_feature 1..372: note = derived and/or modified sequence opt5 from anti-HIV-1_HeavyChain
  source 1..372: mol_type = other RNA
gccaccccctggaacaagagcggctccggggtgaaaaagcctggagcttctgtcagagttagctgctggacatccgaggacatcttcgaacggacggagctgtctctcgtgcgccaggccccgggccaagggctggaatggattggatggatgaaaaccgtgacaggcgcggtcaattttgggagccccaacttcagacacggagtgtcccttacccgggatcgcgacctgtttacagctcatatggatatcagaggcctcacccagggcgacacagccacctacttctgtgcccggcagaagtttgagcgcgggggacagggctggtatttcgatctgtgggggagaggaacgcttattgttgtgtctagc

SEQ ID NO: 41545 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctgggatgaagaaacccggagccagcatgaccgcgtcctgcaagacagctgacgaagatatcttcgacgccgcctatatgcactgggtcagacaggctcctggccagacgtttgagtggctggggtggatgaaaccggttaccggagccgtgaactacgctcggcagttccaaggccgcgtgtctttttatagaacacgggaactcgggattgcctacatggatctgcgcgaccttaagttcgatgacaccgcggtctatttttgtgccagaaaaacaaagggagatgtgagcggcgacgatcggggcttctttttcgacctgtgggggcgcggaaccagagttatcgtgtcctct

SEQ ID NO: 41546 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagacgtttgaatggctcggatggatgaagccggtgaccggcgctgttaactatgcccggcaattccaggggcgcgtgtccttttacagaacacgggagctgggaatcgcctatatggaccttcgcgatctgaaattcgacgataccgctgtctacttttgtgccagaaagacaaaggctgacgtgtctggcgatgaccggggcttctttttcgatctctgggggcgcggaaccagagttattgtgagctcc

SEQ ID NO: 41547 - RNA, 381 nt, synthetic construct
  misc_feature 1..381: note = derived and/or modified sequence opt5 from anti-HIV-1_HeavyChain
  source 1..381: mol_type = other RNA
agagtgtacatggagcaggccggcgctggggtcaagaaacccggagccagcgttaccctgtcctgcaagacagcggacgaagatgtgttcgacgctgcctatatgcactgggtgcggcaagcccctggccagacgtttgagtggctcgggtggatgaaaccggtcaccggagctgtgtcttacgcccgcaagttccagggcagagttagctttacaatgacccgggaactggggatggcttatatggatcttcgcaacctgagattcgacgatacagccgtgtacttttgtgcgcggaaaaccgccggagacgtctccggcgataatcgcggctatttctttgacctctgggggagaggatctcgggtgatcgttagctcc

SEQ ID NO: 41548 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaaagcggcgggggagtcaagaaacccggcccttccgttaccctgtcttgcaagacagccgacgaagatgtgttcgacgctgcctatatgcactgggtgagacaggcgccggggcagacgtttgagtggctcggatggatgaaacccgtcaccggcgctgtgaactacgcccggaagttccaggggcgcgttagcttttatagaacacgggaactgggaatcgcctacatggatcttcgcaatctgagattcgacgataccgctgtgtatttttgtgcccggaaaacagctggcgacgtctccggcgataagcgcgggttctttttcgacctctggggaagaggctctcgggtgattgttagctcc

SEQ ID NO: 41549 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgaggttaagaaaccgggggcttccgtgaaggtgtcttgcaaagccagcggatacaccttcacaggctattacatccactggatgagacaggcgcctgggcagggactcgaatggatgggctggattaaccccaattccggggctgtctcttatgcccggaagtttcaaggacgcgtgagcttcctgcatgaccagggcatcagaatggcctacatggatcttcggaacctgcgctttgacgatacggctgtttatttctgtgccagaaaaaccgctggcgacgtgtccggggataatcggggatactttttcgacctctggggccgcgggtctagagtcattgtgagctcc

SEQ ID NO: 41550 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgtcgaagttgagaagcccggggctagcgtgaccctgtcctgcaaaacagccgacgaagatgtgttcgacgcggcttacatgcattgggtcagacaggcccctggacagacgtttgagtggctcggctggatgaagccggtgaccggggccgttaactatgctcggaaattccagggacgcgtgtctttttacagaacacgggaactgggcatcgcctatatggatcttcgcaatctgagattcgacgataccgctgtctacttttgtgcccggaagacagcgggggacgtgagcggagataaacgcggcttctttttcgacctctggggcagagggtcccgggttattgtgtctagc

SEQ ID NO: 41551 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctggggtcaagaaacccggagccagcgcgaccctgtcctgcaagacagctgacgaagatgttttcgacgccgcctatatgcactgggtgagacaggctcctggccagacgtttgagtggctcgggtggatgaaaccggtgaccggagccgtctcttacgctcggaagttccagggccgcgtgagcttttatatgacaagagaactggggatggcctacatggatcttcggaacctgcgcttcgacgataccgcggtttatttttgtgccagaaaaacagctggagacgtgtccggcgataatcggggctacttctttgacctctgggggcgcggatctagagtcatcgtgagctcc

SEQ ID NO: 41552 - RNA, 375 nt, synthetic construct
  misc_feature 1..375: note = derived and/or modified sequence opt5 from anti-HIV-1_HeavyChain
  source 1..375: mol_type = other RNA
ggccacgacctggagcagagcgggtccggagtgaagaaacccggcgcctctgtcagagttagctgctggacctccgaagatatcttcgagaagtctgaactcattcattgggtgcggcaagctcctgggcagggactggagtggatcggctgggtgaaagccgtcagcggggcggtgaactacggatcccttgactttcgccacagagtttctctgacacgggatcgcgacctcttcacggctcatatggatattagaggcctgacccaggacgatacagccatctatttttgtgcccggcagaagttcgctcgcggcgaccaagggtggtttttcgatctttggggaagaggcaccctgattgtggtcagctcc

SEQ ID NO: 41553 - RNA, 378 nt, synthetic construct
  misc_feature 1..378: note = derived and/or modified sequence opt5 from anti-HIV-1_HeavyChain
  source 1..378: mol_type = other RNA
caggcccacagaggcaccatctgggggctggaggtgaagaaacccggaggctgggtccgggttagctgctggacatccgaagacattttcgagcgcacggaactcatccattgggtgagacaagctcctgggcagggactggagtggattggctgggtgaagaccgtcacaggggccgtgaactttggatctccgaatttccggcaccgcgttagccttaccagagatcgggacctgtttacagcgcatatggatatccgcggcctcacccagggcgacacagctacctacttctgtgccagacagaaatttgaacgcgggggacaaggctggtatttcgatctgtgggggcggggaacgcttattgtggtctcctct

SEQ ID NO: 41554 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgctggggtcgaaaagcccggagccagcgttaccctgtcctgcaaaacagcggacgaggatgtgttcgacgctgcctacatgcattgggtgagacaggcccctggccagacgtttgaatggctcgggtggatgaagccggtcaccggagctgtgtcttatgcccggaaattccagggccgcgttagcttttacatgacaagagagctggggatggcttatatggatcttcggaacctgcgcttcgacgataccgccgtgtacttttgtgcgagaaagacagccggagacgtctccggcgataatcggggctatttctttgacctctgggggcgcggatctagagtgatcgttagctcc

SEQ ID NO: 41555 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaaagcggcgggggagtcaagaaacccggcgcctccgttaccctgtcttgcaagacagctgacgaagatgtgttcgacgccgcgtatatgcactgggtgagacaggctcctgggcagacgtttgagtggctcggatggatgaaaccggtcaccggcgccgtgagctacgcccggaagttccaggggcgcgtttccttttatatgacaagagaactgggaatggcttacatggatcttcggaacctgcgcttcgacgataccgccgtgtatttttgtgctagaaaaacagccggcgacgtctctggcgataatcgggggtacttctttgacctctggggacgcggcagcagagtgatcgtttcctct

SEQ ID NO: 41556 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaaagcggcgggggagtcaagaaacccggcgcctccgttaccctgtcttgcaagacagctgacgaagatgtgttcgacgccgcgtatatgcactgggtgagacaggctcctgggcagacgtttgagtggctcggatggatgaaaccggtcaccggcgccgtgaactacgcccggaagttccaggggcgcgttagcttttatagaacacgggaactgggaatcgcttacatggatcttcgcaatctgagattcgacgataccgccgtgtatttttgtgctcggaaaacagccggcgacgtctccggcgataagcgcgggttctttttcgacctctggggaagaggctctcgggtgattgttagctcc

SEQ ID NO: 41557 - RNA, 381 nt, synthetic construct
  misc_feature 1..381: note = derived and/or modified sequence opt5 from anti-HIV-1_HeavyChain
  source 1..381: mol_type = other RNA
gaggtgtacatggaacagagcggcgggggagtcaagaaacccggcgcctccgttaccctgtcttgcaagacagctagcgaggacgtgttcgatgccgcgtatatgcactgggtgagacaagctcctgggcagacgtttgaatggctcggatggatgaaaccggtcaccggcgccgtgaactacgcccggaagttccaggggcgcgtttccttttatagaacacgggagctgggaatcgcttacatggaccttcgcaatctgagattcgatgacaccgccgtgtatttttgtgctcggaaaacagccggcgatgtctctggcgacaagcgcgggttctttttcgatctctggggaagaggcagccgggtgattgtttcctct

SEQ ID NO: 41558 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaccctctcttgcaagacagccgacgaagatgtgttcgacgcggcttacatgcactgggtcagacaggcccctggacagacgtttgagtggctgggctggatgaaaccggtgaccggggccgttagctatgctcggaagttccaaggacgcgtgtccttttacatgacaagagaacttggcatggcctatatggatctgcggaacctccgcttcgacgataccgctgtctacttttgtgccagaaaaacagcgggggacgtgtctggagataatcggggctatttctttgacctgtggggccgcgggagcagagttatcgtgtcctct

SEQ ID NO: 41559 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaaagcggcgggggaatgaagaaacccggcgcctccatgaccgtctcttgcaagacagctgacgaagatgtttttgacgccgcgtatatgcactgggtgagacaggctcctgggcagacgttcgagtggctgggatggatgaaaccggtgaccggcgccgtcagctatgcccggaagtttcaggggcgcgtgtccttctacatgacaagagaactcggaatggcttatatggatctgcggaaccttcgctttgacgataccgccgtttacttctgtgctagaaaaacagccggcgacgtgtctggcgataatcgggggtactttttcgacctgtggggacgcggcagcagagtcatcgtgtcctct

SEQ ID NO: 41560 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcgcttccaggggagagtctctttttatcggacacgcgaactcggaattgcctacatggatctgagagaccttaagttcgatgacaccgctgtgtatttttgtgcccggaaaacaaagggcgatgttagcggcgacgatcgcgggttctttttcgacctgtggggaagaggcacccgggtgatcgtctcctct

SEQ ID NO: 41561 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctggggtcaagaaacccggagccagcgttaccctgtcctgcaaggcggctgacgaagatgtgttcgacgccgcctatatgcactgggtgagacaggctcctggccagacatttgagtggctcgggtggatgaaaccggtcacgggagccgtgtcttacgctcggaagttccagggccgcgttagcttttatatgaccagagaactggggatggcctacatggatcttcggaacctgcgcttcgacgatacagcggtgtatttttgtgccagaaaaaccgctggagacgtctccggcgataatcggggctacttctttgacctctgggggcgcggatctagagtgatcgttagctcc

SEQ ID NO: 41562 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcgctgggatgaagaaacccggagccagcatgaccgtctcctgcaagacagcggacgaagatatctttgacgctgcctacatgcactgggttagacaggcccctggccagacgttcgagtggctggggtggatgaaaccggtgaccggagctgtgaactatgcccggcagtttcaaggccgcgtctctttctacagaacacgggaactcgggattgcttatatggatctgcgcgaccttaagtttgatgacaccgccgtgtacttctgtgcgagaaaaacaaagggagatgttagcggcgacgatcggggctttttctttgacctgtgggggcgcggaaccagagtgatcgtctcctct

SEQ ID NO: 41563 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaacccggcggggaagtcaagaaacctggagccagcgttaccctgtcctgcaagacagctgacgaggatgtgttcgacgccgcgtatatgcactgggtgagacaggctccgggccagacgtttgaatggctcgggtggatgaaacccgtcaccggagccgtgaactacgcccggaagttccagggccgcgtttctttttatatgacaagagagctggggatggcttacatggatcttcggaatctgcgcttcgacgataccgccgtgtatttttgtgctagaaaaacagccggagacgtcagcggcgataaccggggctacttctttgacctctgggggcgcggatccagagtgatcgtttctagc

SEQ ID NO: 41564 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgctggggtcaagaaacccggagccagcgttaccctgtcctgcaagacagcggacgaagatgtgttcgacgctgcctacatgcattgggtgagacaggcccctggccagacgtttgagtggctcgggtggatgaaaccggtcaccggagctgtgtcttatgcccggaagttccagggccgcgttagcttttacatgacaagagaactggggatggcttatatggatcttcggaacctgcgcttcgacgataccgccgtgtacttttgtgcgagaaaaacagccggagacgtctccggcgataatcggggctatttctttgacctctgggggcgcggatctagagtgatcgttagctcc

SEQ ID NO: 41565 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggcccccgggtgattgtttcctct

SEQ ID NO: 41566 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggacacaccttcacaaactacgacatcaattgggtcagacaggcgcctggccaggggctcgaatggattggatgggtgaagatcgtttccggcacggtgaactttgcttctctggatttccggaatcgcattagcctttccagagaccgggatctgtctaccgcctatatggacatccgcgggctcacacaagatgacaccgccacatacttttgtgctagacagaaattcgccagccggtattccggagatcagggcagctactttgacctgtggggccgcgggacccttattgtcgtgtcttcc

SEQ ID NO: 41567 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcagttccaagggcgcgtctctttttatagaacacgggaactcggaattgcctacaccgatctgcgcgaccttaagttcgatgacacagctgtgtatttttgtgccagaaaaaccaagggcgatgttagcggcgacgatcgggggttctttttcgacctgtggggacgcggcacaagagtgatcgtctcctct

SEQ ID NO: 41568 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggcagttccaagggcgcgtttctttttatagaacacgggaactgggaatcgcctacatggatcttcgcgacctgaagttcgatgacaccgctgtgtatttttgtgccagaaaaacaaagggcgatgtcagcggcgacgatcgggggttctttttcgacctctggggacgcggcaccagagtgattgtttcctct

SEQ ID NO: 41569 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggccgggatggatgaaacccgtcaccggcgccgtgaactacgctcggaagttccaggggcgcgtttctttttatagaacacgggaactcggaatcgcctacatggatctgcgcaatcttagattcgacgataccgctgtgtatttttgtgcccggaaaacagcgggcgacgtcagcggcgataagcgcgggttctttttcgacctgtggggaagaggctcccgggtgattgtttctagc

SEQ ID NO: 41570 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgccaccctgtcctgcaagacagcggacgaagatgttttcgacgctgcctatatgcactgggtgagacaggcccctgggcagacgtttgagtggctcggatggatgaaaccggtgaccggcgctgtctcttacgcccggaagttccaggggcgcgtgagcttttatatgacaagagaactgggaatggcttacatggatcttcggaacctgcgcttcgacgataccgccgtttatttttgtgcgagaaaaacagccggcgacgtgtccggcgataatcgggggtacttctttgacctctggggacgcggctctagagtcatcgtgagctcc

SEQ ID NO: 41571 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgagatgggtgcggcaggcccctgggcagacgtttgagtggctcggatggatgaaaccggtcaccggcgccgtgaactacgctcgcaagttccaggggagagtttctttttatcggacacgcgaactgggaatcgcctacatggatcttagaaatctgcggttcgacgataccgctgtgtatttttgtgcccgcaaaacagcgggcgacgtcagcggcgataagagagggttctttttcgacctctggggacggggctcccgcgtgattgtttctagc

SEQ ID NO: 41572 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcagagccagcggatacaccttcggcaaccacgcgatctcctgggtccggcaggctcctgggcagggactcgaatggatgggctggattcgcccgaaaacaggggccagaaatcaagcccggcagtttcagccccgcatctctctgacgagagaccgggctcttagcaccgcctatctggatctcaactccctgacatctgctgacagcggaacctacttctgtgcccgccagacatttaagcctgatttctattttgcggaccaaggctggtccttcaatctttggggcagaggggcccattttattgtgagctct

SEQ ID NO: 41573 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacccggctctcgcgtgatcgttagctcc

SEQ ID NO: 41574 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgaactacgcccggaagttccagggccgcgtttctttttatagaacacgggaactggggatcgcttacatggatcttcgcaatctgagattcgacgataccgccgtgtatttttgtgcgcggaaaacagccggagacgtcagcggcgataagcgcggcttctttttcgacctctgggggagaggatcccgggtgattgtttctagc

SEQ ID NO: 41575 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgggggagtcaagaaacccggcgctagcgttaccctgtcctgcaagacagccgacgaagatgtgttcgacgcggcttacatgcattgggtgagacaggcccctgggcagacgtttgagtggctcggatggatgaaaccggtcaccggcgccgtgaactatgctcggaagttccaggggcgcgtttctttttacagaacacgggaactgggaatcgcctatatggatcttcgcaatctgagattcgacgataccgctgtgtacttttgtgcccggaaaacagcgggcgacgtcagcggcgataagcgcgggttctttttcgacctctggggaagaggctcccgggtgattgtttctagc

SEQ ID NO: 41576 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgacgggatgaagaaacccggagctagcatgaccgtctcctgcaagacagccgatgaagacatcttcgatgcggcttatatgcactgggttagacaggcccctggccagacgtttgagtggctggggtggatgaaaccggtgaccggagccgtgaactacgctcggcagttccaaggccgcgtctctttttatagaacacgggaactcgggattgcctacatggacctgcgcgatcttaagttcgacgataccgctgtgtatttttgtgccagaaaaacaaagggagacgttagcggcgatgaccggggcttctttttcgatctgtgggggcgcggaaccagagtgatcgtctcctct

SEQ ID NO: 41577 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaccctctcttgcaagacagccgacgaagatgtgttcgacgcggcttacatgcactgggtcagacaggcccagggacaaacgtttgagtggctgggctggatgaaacctgtgaccggggccgttaactatgctcggaagttccagggacgcgtgagcttttacagaacacgggaacttggcatcgcctatatggatctgcgcaatctcagattcgacgataccgctgtctacttttgtgcccggaaaacagcgggggacgtgtccggagataagcgcggcttctttttcgacctgtggggcagagggtctcgggttattgtgagctcc

SEQ ID NO: 41578 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccaagtgattgtttctagc

SEQ ID NO: 41579 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttagaaagcccggggcttccgtgaaagtgtcttgcaaggccagcggatacaccttcacaaactattacatgcactgggtccggcaggcgcctggccaggggctcgaatggatcggatgggtgaaaattgtttccggcacggtgaattttgcttctctggacttccgcaacagaatcagcctttcccgggatcgcgacctgtctaccgcctatatggatattagagggctcacacaagacgataccgccacatacttttgtgctcggcagaagttcgccagccgctattccggagaccagggcagctactttgatctgtggggcagagggacccttatcgtcgtgtcttcc

SEQ ID NO: 41580 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactacgcgagaaaatttcaggggcgggtttctttctatcgcaccagagaacttggaattgcttacatggatctgcggaatctccgctttgacgatacagccgtgtatttctgtgccagaaagaccgctggcgacgtcagcggcgataaacgggggtttttctttgacctgtggggacgcggctccagagtgatcgtttctagc

SEQ ID NO: 41581 - RNA, 381 nt, synthetic construct
  misc_feature 1..381: note = derived and/or modified sequence opt5 from anti-HIV-1_HeavyChain
  source 1..381: mol_type = other RNA
ctgatccacctcgcccagagcggcgctgaggtgaagaaacccggggcctccgtcaccctgtcttgcaagacagcggacgaagatgttttcgacgctgcctacatgcattgggtgagacaagcccctggacagacgtttgagtggcttggctggatgaaaccggtgaccggggctgtcagctatgcccggaagttccagggacgcgtgtccttttacatgacaagagaactgggcatggcttatatggatctccggaacctgcgcttcgacgataccgccgtttacttttgtgcgagaaaaacagccggggacgtgtctggagataatcggggctatttctttgacctttggggccgcgggagcagagtcattgtgtcctct

SEQ ID NO: 41582 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccatgaccgtgtcttgcaagacagccgacgaagatatcttcgacgcggcttacatgcactgggtgagacaggcccctggacagacgtttgagtggctcggctggatgaaaccggtcaccggggccgtgaactatgctcggcaattccagggacgcgttagcttttacagaacacgggaactgggcattgcctatatggatcttcgcgacctgaagttcgatgacaccgctgtgtacttttgtgccagaaaaacaaagggggatgtctccggagacgatcggggcttctttttcgacctctggggccgcgggaccagagtgatcgtttctagc

SEQ ID NO: 41583 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaaggcagagggggagtcaagaaacccggcgccagcgttaccctgtcctgcaagacagctgacgaagatgtgttcgacgccgcgtatatgcactgggtgcggcaggctcctgggcagacgtttgagtggctcggatggatgaaaccggtcaccggcgccgtgaactacgcccgcaagttccaggggagagtttctttttatcggacacgcgaactgggaatcgcttacatggatcttagaaatctgcggttcgacgataccgccgtgtatttttgtgctcgcaaaacagccggcgacgtcagcggcgataagagagggttctttttcgacctctggggacggggctcccgcgtgattgtttctagc

SEQ ID NO: 41584 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatgttttcgacgcggcttatatgcactgggtgagacaggcccctgggcagacgtttgagtggctgggatggatgaaaccggtgaccggcgccgtcaactacgctcggcagttccaagggcgcgtgtctttttatagaacacgggaactcggaatcgcctacatggatctgcgcgaccttaagagcgatgacaccgctgtttatttctgtgccagaaaaacagcgggcgatgtgtccggcgacaagcgggggtttttctttgatctgtggggacgcggctctagagtcattgtgagctcc

SEQ ID NO: 41585 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccgggtcctctatcaaggtgagctgcaaggcttccggagacaccatttctagatacgccatcaactgggtgcggcaggcgcctggccaggggctcgaatggattggatgggtcaaaacagtgacgggcgctgttaatttcgggagcctggattttcgccacagaatctcccttacccgggaccgcgatctgttcacagcccatatgggaattagaggcctcacccaaggcgacacagccacctatttttgtgctcggcagaaattcgagtctcgctacacagggggacagggctggtattttgatctgtgggggagaggaacccacatcgtggtcagctcc

SEQ ID NO: 41586 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatatcttcgacgcggcttatatgcactgggtgagacaggcccctgggcagacgtttgagtggctcggatggatgaaaccggtgaccggcgccgtcaactacgctcggaagttccaggggcgcgtgtctttttatagaacacgggaactgggaattgcctacatggatcttcgcaatctgagattcgacgataccgctgtttatttttgtgcccggaaaacagcgggcgacgtgagcggcgataagcgcgggttctttttcgacctctggggaagaggctcccgggtcatcgtgtctagc

SEQ ID NO: 41587 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaatttccaggggcgcgtttctttttatagaacacgggaactgggaatcgcctacatggatcttcgcaacctgagattcgacgataccgctgtgtatttttgtgcccggcaaaagttcgagagccgctactccggcgaccagggctcttattttgatctctgggggagaggaacactgattatcgtcagctcc

SEQ ID NO: 41588 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagagacccggcgctagcgttaccctgtcctgcaaaacagccgacgaagatgtgttcgacgcggcttatatgcactgggtgcggcaggcccctgggcagacgtttgagtggctcggatggatgaagccggtcaccggcgccgtgaactacgctcgcaaattccaggggagagtttctttttatcggacacgcgaactgggaatcgcctacatggatcttagaaatctgcggttcgacgataccgctgtgtatttttgtgcccgcaagacagcgggcgacgtcagcggcgataaaagagggttctttttcgacctctggggacggggctcccgcgtgattgtttctagc

SEQ ID NO: 41589 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgacgaggttaagaaacccggggcctccgtgaccctctcttgcaagacagctgatgaagacgtgttcgatgccgcgtacatgcactgggtcagacaggctcctggacagacgtttgagtggctgggctggatgaaaccggtgaccggggccgttaactatgcccggaagttccaaggacgcgtgagcttttacagaacacgggaacttggcatcgcttatatggacctgcgcaatctcagattcgatgacaccgccgtctacttttgtgctcggaaaacagccggggatgtgtccggagacaagcgcggcttctttttcgatctgtggggcagagggtctcgggttattgtgagctcc

SEQ ID NO: 41590 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccggggttaagaaacccggatcctctgtgaaggtgagctgcaaggcttccggcgggaccttctctagctacgccatcaactggctcagacaggtccctggacagcggccggagtggatgggctggattcgccccaaaacaggggcgagaaatcaagctcggcagtttcagcctcgcatctccctgacgagagaccgggccctttctaccgcctatctggatctcaacagcctgacatccgctgacagcggaacctacttctgtgcccgccagacatttaaacccgatttctattttgctgaccaaggctggtctttcaatctttggggcagaggggcccactttattgtgtccagc

SEQ ID NO: 41591 - RNA, 381 nt, synthetic construct
  misc_feature 1..381: note = derived and/or modified sequence opt5 from anti-HIV-1_HeavyChain
  source 1..381: mol_type = other RNA
caggtgtacatggagagagccggcgggggagtcaagaaacccggcgctagcgttaccctgtcctgcgaaacagccgacgaggatgtgttcgacgcggcttatatgcactgggtgcggcaagcccctgggcagacgtttgaatggctcggatggatgaagccggtcaccggcgccgtgaactacgctcgcaaattccaggggagagtttctttttatcggacacgcgagctgggaatcgcctacatggatcttagaaatctgcggttcgacgataccgctgtgtatttttgtgcccgcaagacagcgggcgacgtcagcggcgataaaagagggttctttttcgacctctggggacggggctcccgcgtgattgtttctagc

SEQ ID NO: 41592 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctgggatgaagaaacccggagccagcatgaccgtctcctgcaagacagcggacgaagatatcttcgacgctgcctatatgcactgggttagacaggcccctggccagacgtttgagtggctggggtggatgaaaccggtgaccggagctgtgaactacgcccggcagttccaaggccgcgtctcttttctccaggatcaggggattagaatcgcttatatggacctgcgggatcttaagttcgacgatacagccgtgtacttttgtgcgcgcaaaaccaagggagacgttagcggcgatgacagaggcttctttttcgatctgtgggggcggggaacacgcgtgattgtctcctct

SEQ ID NO: 41593 - RNA, 381 nt, synthetic construct
  misc_feature 1..381: note = derived and/or modified sequence opt5 from anti-HIV-1_HeavyChain
  source 1..381: mol_type = other RNA
caggtgtacatgggcgccgggagaggaggcgtcaagaaacccggggctagcgttaccctgtcctgcaagacagccgacgaggatgtgttcgacgcggcttatatgcactgggtgcggcaagcccctggacagacgtttgaatggctcggctggatgaaaccggtcaccggggccgtgaactacgctcgcaagttccagggaagagtttctttttatcggacacgcgagctgggcatcgcctacatggatcttagaaatctgcggttcgacgataccgctgtgtatttttgtgcccgcaaaacagcgggcgacgtcagcggggataagagaggattctttttcgacctctggggccgggggtcccgcgtgattgtttctagc

SEQ ID NO: 41594 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagccgtttgagtggctcgggtggatgaaacccgtcacgggagctgtgtcttacgcccggaagttccagggccgcgttagcttttatatgaccagagaactggggatggcttacatggatcttcggaacctgcgcttcgacgatacagccgtgtatttttgtgcgagaaaaaccgccggagacgtctccggcgataatcggggctacttctttgacctctgggggcgcggatctagagtgatcgttagctcc

SEQ ID NO: 41595 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaagatctcttgcaaagccagcggatacaccttcattagacacggcatccattggctccgccaggtgcctgggcagcggccggaatggatgggatggattagacccaagacaggcgcgcggaaccaagctcgccagtttcagcctagaatctccctggcccgggaccgcgccctttctacggcttatctggatctcaatagcctgacctccgccgactctgggacatacttctgtgctagacagacctttaaacccgatttctattttgccgaccaaggatggagcttcaacctttggggccggggcgcgcactttattgtctccagc

SEQ ID NO: 41596 - RNA, 381 nt, synthetic construct
  misc_feature 1..381: note = derived and/or modified sequence opt5 from anti-HIV-1_HeavyChain
  source 1..381: mol_type = other RNA
caggtgctgctcgtccaaagcggcgccgaggttaagaaacccgggtcctctgtgaaggtgagctgcaaggcttccggagactctctgaccaaatacgccttcagctgggtcagacaggcgcctggccaggggccggaatggatgggatggatccggcccaaaacaggcgctcgcaacagagcccggcagtttcaacctcgcatttcccttacgagagatcgggccctgtctaccgcttatctcgacctgaatagccttacatccgccgatagcgggacctacttctgtgctcgccagacatttaagcccgacttctattttgccgatcagggatggtctttcaacctgtggggcagaggcgcgcactttatcgtgtccagc

SEQ ID NO: 41597 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccgggggcagacgtttgagtggctcggatggatgaaacctgtcaccggcgccgtgaactacgctcgcaagttccaggggagagtttctttttatcggacacgcgaactgggaatcgcctacatggatcttagaaatctgcggttcgacgataccgctgtgtatttttgtgcccgcaaaacagcgggcgacgtcagcggcgataagagagggttctttttcgacctctggggacggggctcccgcgtgattgtttctagc

SEQ ID NO: 41598 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataaccgcgggtacttctttgacctctggggaagaggctcccgggtgattgtttctagc

SEQ ID NO: 41599 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggacccggctccagagtgattgtttctagc

SEQ ID NO: 41600 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgagatgggttcggcaggcccctgggcagacgtttgagtggctgggatggatgaaaccggtgaccggcgccgtgaactacgctcgccagttccaagggagagtctctttttatcggacacgcgaactcggaattgcctacatggatctgagagaccttaagttcgatgacaccgctgtgtatttttgtgcccggaaaacaaagggcgatgttagcggcgacgatcgcgggttctttttcgacctgtggggaagaggcacccgggtgatcgtctcctct

SEQ ID NO: 41601 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctaccttgatctgcggaacctccgcttcgacgataccgctgtgtatttttgtgccagaaaaacagcgggcgacgtctccggcgataatcgggggtacttctttgacctgtggggacgcggctctagagtgatcgttagctcc

SEQ ID NO: 41602 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagggactcgaatggatcggctgggtgaagacggttaccggggctgtgaactttggatccctggacttccggcatcgcatttctcttacaagagatcgggacctgtttaccgcccacatggatatccgcggcctcacacaaggcgacaccgccacatatttctgtgctagacagaaatttgagagccggtacaccgggggacagggctggtatttcgatctgtgggggcgcggaacgcatattgtcgtgtcctct

SEQ ID NO: 41603 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatcaaaccggtcaccggcgccgtgaactacgctcggaagttccaggggcgcgtttctttttatagaacacgggaactgggaattgcctacatggatcttcgcaatctgagattcgacgataccgctgtgtatttttgtgcccggaaaacagcgggcgacgtcagcggcgataagcgcgggttctttttcgacctctggggaagaggctcccgggtgatcgtttctagc

SEQ ID NO: 41604 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcgtcaccgtttcctgcaagacagccgacgaagatatcttcgacgcggcttatatgcactgggtgagacaggcccctgggcagacgtttgagtggctgggatggatgaaaccggtgaccggcgccgtcaactacgctcggcagttccaagggcgcgtgtctttttatagaacacgggaactcggaattgcctacatggatctgcgcgaccttaagttcgatgacaccgctgtttatttttgtgccagaaaaacaaagggcgatgtgagcggcgacgatcgggggttctttttcgacctgtggggacgcggcaccagagtcatcgtgtcctct

SEQ ID NO: 41605 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaacccggagcttctgtcagagttagctgctggtcctctgaagacatcagcaaggccgagctcattcattgggtgcggcaggcgcctggccaggggctggaatggatcggatgggtgaaaaccgtcacaggcgctgtgaacttcgggtcccttgattttcgccacagaatttctctgacgcgggaccgcgatctcttcaccgcccatatggacatcagaggactgacacagggcgataccgccacatacttttgtgctcggcaaaagttcgagagccgctataccggcgggcagggatggtactttgacctttggggcagagggacacacattgttgtgtccagc

SEQ ID NO: 41606 - RNA, 381 nt, synthetic construct
  misc_feature 1..381: note = derived and/or modified sequence opt5 from anti-HIV-1_HeavyChain
  source 1..381: mol_type = other RNA
caggtgtacatggaggccggcagagggggagtcaagaaacccggcgctagcgccaccctgtcctgcaagacagcggacgaagatgttttcgacgctgcctatatgcactgggtgcggcaagcccctgggcagacgtttgagtggctcggatggatgaaaccggtgaccggcgctgtctcttacgcccgcaagttccaggggagagtgagcttttatatgacacgggaactgggaatggcttacatggatcttcgcaacctgagattcgacgataccgccgtttatttttgtgcgcggaaaacagccggcgacgtgtccggcgataatcgcgggtacttctttgacctctggggaagaggctctcgggtcatcgtgagctcc

SEQ ID NO: 41607 - RNA, 381 nt, synthetic construct
  misc_feature 1..381: note = derived and/or modified sequence opt5 from anti-HIV-1_HeavyChain
  source 1..381: mol_type = other RNA
agatgcatctggcggcaggccggcgggggagtgaagaaacccggcgctagcgtcaccctgtcctgtaagacagccgacgaggatgttttcgacgcggcttacatgcactgggtgcgccaagcccctgggcagacgtttgaatggctcggatggatgaaaccggtgaccggcgccgtctcttatgctagaaagttccaggggcgggtgagcttttacatgacacgcgagctgggaatggcctatatggatcttagaaacctgcggttcgacgataccgctgtttacttttgcgcccgcaaaacagcgggcgacgtgtccggcgataatagagggtatttctttgacctctggggacggggctctcgcgtcattgtgagctcc

SEQ ID NO: 41608 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatcaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctctagagtgattgttagctcc

SEQ ID NO: 41609 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgaagtcctcttgctggaccagcgaagacatcttcgatacaacggagctcatttactgggtcagacaggcccctggacagggcctggaatggatcgggtgggttaaaattgtgtccggaaccgtgaactttgcgtctcttgacttccggaatcgcatcagcctgtccagagatcgggacctcagcacagcttatatggatattcgcggcctgacccaggacgatacagccacctacttttgtgccagacaaaagttcgcttctcggtattccggggaccagggaagctactttgatctttggggccgcggcacactgatcgtcgtgtcttcc

SEQ ID NO: 41610 - RNA, 381 nt, synthetic construct
  misc_feature 1..381: note = derived and/or modified sequence opt5 from anti-HIV-1_HeavyChain
  source 1..381: mol_type = other RNA
agatgcctgtggcggcaggccggcgggggaatgaagaaacccggcgctagcatgaccgtgtcctgtaagacagccgacgaggatgtcttcgacgcggcttacatgcactgggttcgccaagcccctgggcagacgtttgaatggctcggatggatgaaaccggtgaccggcgccgtgaactatgctagaaagttccaggggcgggtctctttttaccgcacaagagagctgggaatcgcctatatggatcttcggaatctgcgcttcgacgataccgctgtgtacttttgcgccagaaaaacagcgggcgacgttagcggcgataagcgggggttctttttcgacctctggggacgcggctccagagtgattgtctctagc

SEQ ID NO: 41611 - RNA, 381 nt, synthetic construct
  misc_feature 1..381: note = derived and/or modified sequence opt5 from anti-HIV-1_HeavyChain
  source 1..381: mol_type = other RNA
agatgcatctgggagcgggccggcgggggaatgaagaaacccggcgctagcatgaccgtgtcctgtaagacagccgacgaagatattttcgacgcggcttacatgcactgggtccgccaggcccctgggcaaacgtttgagtggctgggatggatgaaaccggttaccggcgccgtgaactatgctagacagttccaggggcgggtgtctttttaccgcacaagagaactcggaatcgcctatatggatctgcgggaccttaagttcgatgacaccgctgtctacttttgcgcccgcaaaacaaagggcgatgtgagcggcgacgatagagggttctttttcgacctgtggggacggggcacccgcgttattgtgtcctct

SEQ ID NO: 41612 - RNA, 381 nt, synthetic construct
  misc_feature 1..381: note = derived and/or modified sequence opt5 from anti-HIV-1_HeavyChain
  source 1..381: mol_type = other RNA
caggtgcaactggagcaggccggcgggggagtcaagaaacccggcgctagcgttaccctctcctgcaagacagccgacgaagatgtgttcgacgcggcttacatgcactgggtgagacaggcccctgggcagacgtttgagtggctgggatggatgaaaccggtcaccggcgccgtgaactatgctcggaagttccaagggcgcgtttctttttacagaacacgggaacttggaatcgcctatatggatctgcgcaatctcagattcgacgataccgctgtgtacttttgtgcccggaaaacagcgggcgacgtcagcggcgataagcgcgggttctttttcgacctgtggggaagaggctcccgggtgattgtttctagc

SEQ ID NO: 41613 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatgttttcgacgcggcttatatgcactgggtgagacaggcccctgggcagacgtttgagtggctgggatggatgaaaccggtgaccggcgccgtcaactacgctcggaagttccaggggcgcgtgtctttttatagaacacgggaactcggaatcgcctacatggatctgcgcaatcttagattcgacgataccgctgtttatttttgtgcccggaaaacagcgggcgacgtgagcggcgataagcgcgggttctttttcgacctgtggggaagaggctcccgggtcattgtgtctagc

SEQ ID NO: 41614 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgagatgggtgcggcaggcccctgggcagacgtttgagtggctcggatggatgaaaccggtcaccggcgccgtgtcttacgctcgcaagttccaggggagagttagcttttatatgacacgggaactgggaatggcctacatggatcttcgcaacctgagattcgacgataccgctgtgtatttttgtgcccggaaaacagcgggcgacgtctccggcgataatcgcgggtacttctttgacctctggggaagaggctctcgggtgatcgttagctcc

SEQ ID NO: 41615 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaacccggcgggggagtcaagaaacctggcgccagcgttaccctgtcctgcaagacagctgacgaagatgtgttcgacgccgcgtatatgcactgggtgagacaggctccggggcagacgtttgagtggctcggatggatgaaacccgtcaccggcgccgtgtcttacgcccggaagttccaggggcgcgttagcttttatatgacaagagaactgggaatggcttacatggatcttcggaacctgcgcttcgacgataccgccgtgtatttttgtgctagaaaaacagccggcgacgtctccggcgataatcgggggtacttctttgacctctggggacgcggctctagagtgatcgttagctcc

SEQ ID NO: 41616 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcggggaagtcaagaaacccggagctagcgttaccctgtcctgcaagacagccgacgaggatgtgttcgacgcggcttatatgcactgggtgagacaggcccctggccagacgtttgaatggctcgggtggatgaaaccggtcaccggagccgtgtcttacgctcggaagttccagggccgcgttagcttttatatgacaagagagctggggatggcctacatggatcttcggaacctgcgcttcgacgataccgctgtgtatttttgtgccagaaaaacagcgggagacgtctccggcgataatcggggctacttctttgacctctgggggcgcggatctagagtgatcgttagctcc

SEQ ID NO: 41617 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgagagtgtcttgccaggccagcggatacatcttcaccggctattttgtcaactggctccggcagctgcctgggcaacgcccggaatggatgggatggattagacccaagtccggcgcgcggaatcaggctcgccagttccagcctagaatctctcttacacgggaccgcgccctgagcacggcctacctcgattccaactctctgaccagcgctgactccgggacatatttttgtgccagacaaaccttcaaacccgatttttacttcgctgaccagggatggagctttaatctttggggccggggcgcccacttcattgtgtcttcc

SEQ ID NO: 41618 - RNA, 381 nt, synthetic construct
  misc_feature 1..381: note = derived and/or modified sequence opt5 from anti-HIV-1_HeavyChain
  source 1..381: mol_type = other RNA
ggctgcatctggacccaggccgggggaggcgtgaagaaacccggggctagcgtcacactgtcctgtaagacggccgacgaggatgttttcgacgcggcttacatgcactgggtgagacaagcccctggacagacctttgaatggctcggctggatgaaaccggtgacaggggccgtctcttatgctcggaagttccagggacgcgtgagcttttacatgaccagagagctgggcatggcctatatggatcttcggaacctgcgcttcgacgatacagctgtttacttttgcgccagaaaaaccgcgggcgacgtgtccggggataatcggggatatttctttgacctctggggccgcgggtctagagtcattgtgagctcc

SEQ ID NO: 41619 - RNA, 381 nt, synthetic construct
  misc_feature 1..381: note = derived and/or modified sequence opt5 from anti-HIV-1_HeavyChain
  source 1..381: mol_type = other RNA
agatgcatctggcggcaggccggcgggggaatgaagaaacccggcgctagcatgaccgtgtcctgtaagacagccgacgaggatattttcgacgcggcttacatgcactgggtccgccaagcccctgggcagacgtttgaatggctgggatggatgaaaccggttaccggcgccgtgaactatgctagacagttccaggggcgggtgtctttttaccgcacaagagagctcggaatcgcctatatggatctgcgggaccttaagttcgatgacaccgctgtctacttttgcgcccgcaaaacaaagggcgatgtgagcggcgacgatagagggttctttttcgacctgtggggacggggcacccgcgttattgtgtcctct

SEQ ID NO: 41620 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtgggtcggatggatgaaaccggtgaccggcgccgtttcttacgctcggaagttccaggggcgcgtgagcttttatatgacaagagaactcggaatggcctacatggatctgcggaaccttcgcttcgacgataccgctgtctatttttgtgccagaaaaacagcgggcgacgtgtccggcgataatcgggggtacttctttgacctgtggggacgcggctctagagttatcgtgagctcc

SEQ ID NO: 41621 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaaggaacccggcgctagcgttaccctgtcctgcaaaacagccgacgaggatgtgttcgacgcggcttatatgcactgggtgagacaggcccctgggcagacgtttgaatggctcggatggatgaagccggtcaccggcgccgtgaactacgctcggaaattccaggggcgcgtttctttttatagaacacgggagctgggaatcgcctacatggatcttcgcaatctgagattcgacgataccgctgtgtatttttgtgcccggaagacagcgggcgacgtcagcggcgataaacgcgggttctttttcgacctctggggaagaggctcccgggtgattgtttctagc

SEQ ID NO: 41622 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaacccggagcttctgtcagagttagctgctggtcctctgaagacatcttcaagaccgagctcattcattgggtgcggcaggcccctggccaggggctggaatggatcggatgggtgaaaacagtcacgggcgcggtgaactttgggagccttgatttccgccacagaatttccctgacccgggaccgcgatctctttacagctcatatggacatcagaggactgacccagggcgatacagccacctacttctgtgcccggcaaaagtttgagtctcgctatacaggcgggcagggatggtacttcgacctttggggcagagggacccacattgttgtgagctcc

SEQ ID NO: 41623 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatggatgaagacagtgacgggcgcggtcaactttgggagccttgatttcagacaccggatttccctgacccgcgacagagatctctttacagctcatatggacatccggggactggcccagggcgataccgccacatacttctgtgctcgccaaaaatttgaatctagatataccggcgggcagggatggtacttcgacctttggggccgggggacacacattgtggttagctcc

SEQ ID NO: 41624 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgcacattgttgtgtctagc

SEQ ID NO: 41625 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcgtggttagctct

SEQ ID NO: 41626 - RNA, 384 nt, synthetic construct
  misc_feature 1..384: note = derived and/or modified sequence opt5 from anti-HIV-1_HeavyChain
  source 1..384: mol_type = other RNA
agccacacctggaacaatagaggctccgccatgaagaaacccggggcttctgtgcgggtcagctgctggacatccgaggacatcttcgatacgaccgaactgatttactgggttcgccaggcccctggacaaggcctcgagtggatcgggtgggtgaagattgtgtctggaacagtcaactttgcgagcctggacttcagaaatcggatctccctttctcgcgatagagacctgagcaccgcttatatggatattcggggcctcacacaggacgataccgccacatacttttgtgcccgccagaaattcgcttccagatatagcggggaccagggatcttactttgatctgtggggccggggcacccttatcgtggtttccagc

SEQ ID NO: 41627 - RNA, 381 nt, synthetic construct
  misc_feature 1..381: note = derived and/or modified sequence opt5 from anti-HIV-1_HeavyChain
  source 1..381: mol_type = other RNA
cagagccacctggagcaatccggctctgccatgaagaaacccggggctagcgtgagagtctcctgctggacctctgaagacatcttccataacgagctcatttactgggttcggcaggcccctggacagggcctggaatggatcgggtgggtgaagattgtgagcggaacagtcaattttgcgtcccttgatttccgcaacagaatctctctgagccgggaccgcgatctctccacggcttatatggacattagaggcctgacccaggatgacacagccacctacttttgtgcccggcaaaaattcgctagccgctattctggggatcagggatcctactttgacctttggggcagaggcacactgatcgtggttagctct

SEQ ID NO: 41628 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatggatgaagacggtgaccggcgcggtcaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgcacattgtggtttctagc

SEQ ID NO: 41629 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcggggaagtcaagaaacccggagctagcatgaccgtttcctgcaagacagccgacgaggatgtgtttgacgcggcttacatgcactgggtgagacaggcccctggccagacgttcgaatggctggggtggatgaaaccggtcaccggagccgtgaactatgctcggcagtttcaaggccgcgtttctttctacagaacacgggagctcgggatcgcctatatggatctgcgcgaccttaagtttgatgacaccgctgtgtacttctgtgccagaaaaacaaagggagatgtcagcggcgacgatcggggctttttctttgacctgtgggggcgcggaaccagagtgattgtttcctct

SEQ ID NO: 41630 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaactcggagcttctgtcagagttagctgctggacctccgaagacatcttcgaggatgaactgattcattgggtgcggcaggcccccggccaggggcttgagtggatcggatgggtgaagattgtctctggcacagtgaactttgcgagcctggacttccgcaatagaatctccctctctcgggatcgcgacctgagcacggcttacatggatattagagggcttacccaggacgatacagccacctatttttgtgcccggcaaaaattcgcttcccgctacagcggagaccagggctcttattttgatctgtggggcagagggacactcatcgttgtgtccagc

SEQ ID NO: 41631 - RNA, 381 nt, synthetic construct
  misc_feature 1..381: note = derived and/or modified sequence opt5 from anti-HIV-1_HeavyChain
  source 1..381: mol_type = other RNA
cagagccacctggagcaatccggctctgccatgaagaaacccggggctagcgtgagagtctcctgctggacctctgaagacatcctcaaggccgagctgatttactgggttcggcaggcgcctggacgcggccttgaatggatcgggtgggtgaaaacagtgagcggaacggtcaacttcggctcctctgattttagaaatcggattagcctgacccgcgacagagatctctccacagctcatatggacatccgggggctgacccaggatgacacagccacctatttctgtgcccgccagaagtttgagagcctttactctgatgaccaaggatcctatttcgatctgtggggcagaggcacactcattatcgtgagctct

SEQ ID NO: 41632 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggatactccttcaccgactattacatccactggctcagacaggtccagggccaacggcctgaatggatggggtggattcgcccgagaacaggagcgcggaaccaggctcgccagtttcagcccagaatctctctgacgcgggatcgcgcccttagcaccgcctatctggacctcaattccctgacatctgctgatagcggcacctacttctgtgccagacaaacatttaagcctgacttctattttgctgatcaggggtggtccttcaacctttggggacggggcgcccattttattgtgagctct

SEQ ID NO: 41633 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcggggaagtcaagaaacccggagctagcatgaccgtttcctgcaagacagccgacgaggatgtgtttgacgcggcttacatgcactgggtgagacaggcccctggccagacgttcgaatggctggggtggatgaaaccggtcaccggagccgtgaactatgctcggaagtttcagggccgcgtttctttctacagaacacgggagctcgggatcgcctatatggatctgcgcgaccttaaatttgatgacaccgctgtgtacttctgtgccagaaagacaaagggagatgtcagcggcgacgatcggggctttttctttgacctgtgggggcgcggaaccagagtgattgtttcctct

SEQ ID NO: 41634 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtcaccggcgctgtgaactttgggtcccttgatttcagacaccggatttctctgacacgcgacagagatctctttaccgcccatatggacatccggggactgacacagggcgataccgccacatacttctgtgctcgccaaaaatttgaaagcagatataccggcgggcagggatggtacttcgacctttggggccgggggacgcacattgttgtgtcctct

SEQ ID NO: 41635 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggcgctggggtgaagaaacccggagcctccgtcagagtttcttgctggagctccgaagacatcttcgagcggaccgaactcattcattgggtgcgccaggcgcctggccaggggctggagtggatcggatgggtgaagacagtcacgggcgctgtgaactttgggtctcttgatttcagacaccggattagcctgacccgcgacagagatctctttacagcccatatggacatccggggactgacccagggcgatacagccacctacttctgtgctcgccaaaaatttgaatccagatatacaggcgggcagggatggtacttcgacctttggggccgggggacccacattgttgtgtctagc

SEQ ID NO: 41636 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctgggcctctgaagacatcttcgataccacagagctcatttactgggttcggcaggcgcctggacagggcctggaatggatcgggtgggtgaagattgtgagcggaacggtcaactttgcttcccttgacttccgcaatagaatctctctgagccgggatcgcgacctctccaccgcctatatggatattagaggcctgacacaggacgataccgccacatacttttgtgctcggcaaaaattcgccagccgctattctggggaccagggatcctactttgatctttggggcagaggcaccctgatcgtggttagctct

SEQ ID NO: 41637 - RNA, 381 nt, synthetic construct
  misc_feature 1..381: note = derived and/or modified sequence opt5 from anti-HIV-1_HeavyChain
  source 1..381: mol_type = other RNA
agatgccggctggtgcagagcggcgccgaggtcaagaaacccggggcttccgttcgcgtgtcttgtcaagccagcggatacaccttctccgcgtatggcgtgaactgggtcagacaggctcctgggcaggaactcgagtggatcggatgggtgaagacagttacgggcgccgtgaattttgggtctccgaacttccggcaccgcattagcctgaccagagaccgggatctttttacagcccatatggacatccgcggactgacccagggcgatacagctacctacttctgcgccagacaaaaatttgaatcccggtatacaggcgggcagggatggtacttcgacctctggggccgcgggacccacattgtcgtgtctagc

SEQ ID NO: 41638 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgtgtcaggcccctggccaggggctggagtggatcggatgggtgaagacagtcacgggcgcggtgaactttgggagccttgatttccgccacagaatttccctgacccgggaccgcgatctctttacagctcatatggacatcagaggactgacccagggcgatacagccacctacttctgcgcccggcaaaaatttgaatctcgctatacaggcgggcagggatggtacttcgacctttggggcagagggacccacattgttgtgagctcc

SEQ ID NO: 41639 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagattgtcacaggcgcggtgaactttgggagccttgatttcagacaccggatctccctgacgcgcgacagagatctctttaccgctcatatggacattcggggactgacacagggcgataccgccacatacttctgtgcccgccaaaaatttgaatctagatataccggcgggcagggatggtacttcgacctttggggccgggggacacacatcgttgtgagctcc

SEQ ID NO: 41640 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggcctcgaggttaagaaacccggggcctccgtgagagtgtcttgctggaccagcgaagacatcttcgatacaacggagctgatttactgggtccggcaggctcctggacagggccttgaatggatcgggtgggtgaagattgtttccggaaccgtgaactttgcctctctggacttccgcaatagaatcagcctctcccgggatcgcgacctgtctacagcgcacatggatattagaggccttacccaagacgatacagctacctatttttgtgcccggcagaaattcgccagccgctactccggggaccagggaagctattttgatctgtggggcagaggcacactcatcatcgtctcttcc

SEQ ID NO: 41641 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgcggcaggacgataccgccacatatttttgtgcccgccaaaaattcgagagcagatactctggggaccagggatcctattttgatctttggggccggggcaccctgatcatcgtgagctct

SEQ ID NO: 41642 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgctagccgctattccggcgaccaggggagctacttcgatctgtggggaagaggcacacttatcgtggtctcttcc

SEQ ID NO: 41643 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaatccagatataccggcgggcagggatggtacttcgatctgtggggccgggggacgcacatcgtggtctctagc

SEQ ID NO: 41644 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagaagtctgaactgattcattgggtgcgccaagctcctggccaggggctcgagtggatcggatgggtgaaaacggtcaccggcgccgtgaactttgggagctccgatttcagacagcgggtttctctgacacgcgacagagatcttagcaccgcgtacatggacattcggggactgacacaggatgacaccgctacatatttttgtgcccgccaaaagttcgcctccagatacagcggcgatcagggctcttattttgacctctgggggcggggaaccctgatcgtggtctccagc

SEQ ID NO: 41645 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgagagccgctatacagggggacagggctggtactttgacctttggggcagagggacccatatcgtggtttcttcc

SEQ ID NO: 41646 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagctcacatggatattagaggcctgacccaagacgatacagccacctatttttgtgcccggcagaaattcgagagccgctacacagggggacagggctggtattttgacctttggggcagagggacccatatcgtcgtgtccagc

SEQ ID NO: 41647 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccagggggacacagccacctacttttgtgcccggcaaaaattcgagagccgctatacaggaggccagggctggtactttgatctttgggggagaggaacccatatcgtggtttcttcc

SEQ ID NO: 41648 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccggatttcagacaccggatttccctttctcgcgacagagatctgagcaccgctcatatggacatccggggactcacacaggatgacaccgccacatacttttgtgcccgccaaaaattcgcttccagatatagcggcgatcagggctcttactttgacctgtgggggcggggaacccttattatcgtttccagc

SEQ ID NO: 41649 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggcagagggctggagtggatcggatgggtgaagacggtctctggcaccgtgaactttgggagctccgatttccggaatcgcgtttctcttacaagagaccgggatctgagcaccgcgcacatggacattcgcggactcacacaggatgacaccgctacatacttttgtgccagacagaaattcgaatccctgtatagcgatgaccaaggctcttactttgatctttggggccgggggaccctgatcattgtgtccagc

SEQ ID NO: 41650 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagaaaccggattagccttacacgcgatagagacctgtccaccgctcacatggatatccggggactcacacaggacgataccgccacatacttttgtgcccgccaaaaattcgaatctctgtatagcgacgatcagggctcctactttgacctttggggcagagggaccctgattatcgttagctct

SEQ ID NO: 41651 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagagacccggggctagcgtgcgggtctcctgctggacctctgaagacatcttcgatacaacggagctcatttactgggttcgccaggcccctggacagggcctggaatggatcgggtgggtgaaaattgtgagcggaaccgtcaactttgcgtcccttgacttcagaaatcggatctctctgagccgcgatagagacctctccacagcttatatggatattcggggcctgacccaggacgatacagccacctacttttgtgcccgccaaaagttcgctagcagatattctggggaccagggatcctactttgatctttggggccggggcacactgatcgtggttagctct

SEQ ID NO: 41652 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagaaatcggatttccctctctcgcgacagagatctgagcacggcctatatggacatccggggacttacccaggatgacacagccacctacttctgtgctcgccaaaaatttgcctccagatatagcggcgatcagggctcttacttcgacctgtgggggcggggaacactcattgttgtgtccagc

SEQ ID NO: 41653 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagactttttcaccgctcatatggatatccggggactcacacagggcgataccgccacatacttttgtgcccgccaaaaattcgaatccagatataccggcgggcagggatggtactttgacctgtggggccgggggacgcacattgttgtgtctagc

SEQ ID NO: 41654 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaacccggagcttctgtcagagttagctgctggtcctctgaagacatcttccggaccgagctcattcattgggtgcgccaggcccctggccaggggctggaatggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgagtctagatatacaggcgggcagggatggtacttcgacctttggggccgggggacccacattgttgtgagctcc

SEQ ID NO: 41655 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaatccctgtattctgatgaccagggcagctacttcgatctttgggggagaggaaccctgatcattgtgtccagc

SEQ ID NO: 41656 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctct

SEQ ID NO: 41657 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatggatattagaggcctcacccaggacgatacagccacctatttttgtgcccggcaaaaattcgcttctcgctactccggggaccagggaagctattttgatctgtggggcagaggcacacttatcgtggtttcttcc

SEQ ID NO: 41658 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcatttactgggtgcgccaggcccctggcagagggctggagtggatcggatgggtgaagacggtctctggcaccgtgaactttgggagctccgatttccggaatcgcatttctcttacaagagaccgggatctgagcaccgcgcatatggacatccgcggactcacacaggatgacaccgctacatatttttgtgccagacagaaattcgaatccctgtacagcgatgaccaaggctcttattttgatctttggggccgggggaccctgattatcgtttccagc

SEQ ID NO: 41659 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcattcattgggttcggcaggcccctggacagggcctggaatggatcgggtgggtgaagaccgtgacaggagcggtcaactttggcagccttgacttccgccacagaatttccctgacccgggatcgcgacctctttacagctcatatggatatcagagggctgacccagggagacacagccacctacttctgtgcccggcaaaaatttgagtctcgctatacgggcggccaggggtggtacttcgatctttggggaagaggcacccacattgtggttagctcc

SEQ ID NO: 41660 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcggaacaacggagctcatttactgggttcggcaggcccctggccaggggctggaatggatcggatgggtgaagattgtgagcggcaccgtcaactttgcgtcccttgatttccgcaatagaatctctctgagccgggaccgcgatctctccacagcttatatggacattagagggctgacccaggatgacacagccacctacttttgtgcccggcaaaaattcgctagccgctattctggagatcagggctcctactttgacctttggggcagagggacactgatcgtggttagctct

SEQ ID NO: 41661 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggctccgccatgaagaaacccggggcttctgttagagtgagctgctggacctccgaggacatcttcgatacaacggaactcatttactgggtgcggcaggcccctggacagggcctggagtggatcgggtgggtcaagattgtgtctggaaccgttaactttgcgagccttgacttccgcaatagaatctccctgtctcgggatcgcgacctcagcacagcttatatggatattagaggcctgacccaagacgatacagccacctacttttgtgcccggcagaaattcgcttcccgctatagcggggaccagggatcttactttgatctttggggcagaggcacactgatcgtggtctccagc

SEQ ID NO: 41662 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaaggcatcttcgagcggacagaactcattcattgggtgcgccaggcccctgggcagggactggagtggatcggctgggtgaagacggtcaccggggcggtgaactttggatctcttgacttcagacaccggattagcctgacacgcgatagagacctctttaccgctcatatggatatccggggcctgacacagggcgacaccgccacatacttctgtgcccgccaaaaatttgaatccagatataccgggggacagggctggtacttcgatctttgggggcggggaacgcacattgttgtgtctagc

SEQ ID NO: 41663 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggcccgccaggcgcctggccaggggctggagtggatcggatgggtgaagacggtgaccggcgctgtcaactttgggtctccgaatttcagacaccgggccagccttacacgcgatagagacctgtttaccgcccatatggatattcggggactcacagaaggcgacaccgctacatacttctgtgcccgccagaaatttgcttccagatattctggcgatcaagggagctacttcgacctgtggggacggggcacccttatcattgtgtccagc

SEQ ID NO: 41664 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacagccgagctcatttactgggttcggcaggcgcctggacagggcctggaatggatcgggtgggtgaagattgtgagcggaacggtcaactttgcttcccttgacttccgcaatagaatctctctgagccgggatcgcgacctctccaccgcccatatggatattagaggcctgcggcaggacgatacagccacctatttttgtgctcgccaaaaattcgagagcagatactctggggaccagggatcctattttgatctttggggccggggcacactgatcatcgtgagctct

SEQ ID NO: 41665 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcgaatgggtgaaggcggtctctggagctgtgaactacggcagcctggattttagacaccgggtttccctcacgcgcgacagagatctgttcaccgcccatatggacattcgggggcttacacaggatgacaccgccacatatttttgtgctcgccaaaaattcgagtctagatacaccggaggccagggctggtattttgatctgtgggggcggggaacacacatcgtggtcagctcc

SEQ ID NO: 41666 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactggactgcgtgagctct

SEQ ID NO: 41667 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggagcggtcaactttgcttcccttgacttccgcaatagaatctctctgagccgggatcgcgacctctccaccgcccatatggatattagaggcctgacacaggacgataccgccacatatttttgtgctcggcaaaaattcgccagccgctactctggggaccagggatcctattttgatctttggggcagaggcaccctgatcatcgtgagctct

SEQ ID NO: 41668 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacagggcgataccgccacatatttctgtgctcgccaaaaatttgaaagcagatacaccggcgggcagggatggtatttcgacctgtggggccgggggacacacatcgtggtctccagc

SEQ ID NO: 41669 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgagcacagctcacatggacattagaggactcacccaagatgacacagccacctacttttgtgcccggcagaagttcgaatccctgtatagcgatgaccagggctcttactttgatctttggggccgcgggacactgatcattgtgtccagc

SEQ ID NO: 41670 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacaccggattagcctgacccgcgatagagacctctttacagcgcatatggatatccggggactgacccagggcgacacagctacctacttctgtgcccgccaaaaatttgaatccagatatacgggcgggcagggatggtacttcgatctttggggccgggggacccacattgttgtgtctagc

SEQ ID NO: 41671 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagattgtgagcggaacggtcaactttgcgtcccttgatttccggaatcgcatctctctgagcagagaccgggatctctccaccgctcatatggacattcgcggcctgacacaggatgacaccgccacatatttttgtgccagacagaaattcgctagccggtactctggggatcaaggatcctattttgacctttggggccgcggcaccctgatcatcgtgagctct

SEQ ID NO: 41672 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcatcgtgagctct

SEQ ID NO: 41673 - RNA, 384 nt, synthetic construct
  misc_feature 1..384: note = derived and/or modified sequence opt5 from anti-HIV-1_HeavyChain
  source 1..384: mol_type = other RNA
caggccagactggagcaaagcggctccggggtgaagaaactcggagcttctgtccgggttagctgctggacctccgaagacatcttcgagcgcacagaactgattcactgggtgagacaggcccccggccaggggcttgagtggatcggatgggtgaaggcggtctctggcgctgtgaactacgggagcctggattttcggaatcgcatttccctctctagagaccgggatctgagcacggcctatatggacatccgcggacttacccaggatgacacagccacctacttctgtgctagacaaaaatttgcctcccggtatagcggcgatcagggctcttacttcgacctgtgggggcgcggaacactcattgttgtgtccagc

SEQ ID NO: 41674 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccgctatgaagaaacccggggcctctgtgagagtcagctgctggacctccgaagacatcttcgatacaacggagctcatttactgggttcggcaggcgcctggacagggcctggaatggatcgggtgggtgaagattgtgtctggaaccgtcaactttgctagccttgacttccgcaatagaatctccctgtctcgggatcgcgacctcagcacagcccatatggatattagaggcctgacccaggacgatacagccacctatttttgtgctcggcaaaaattcgcctcccgctacagcggggaccagggatcttattttgatctttggggcagaggcacactgatcatcgtgtccagc

SEQ ID NO: 41675 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctctacagcttacatggacatccggggactgacccaggatgacacagccacctatttttgtgcccgccaaaaattcgctagcagatactccggcgatcagggcagctattttgacctttgggggcggggaacactgattgttgtgtcttcc

SEQ ID NO: 41676 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggctaactttgggagccttgatttcagacaccggatttccctgacccgcgacagagatctctttacagcccatatggacatccggggactgacccagggcgatacagccacctacttctgtgctcgccaaaaatttgaatctagatatacaggcgggcagggatggtacttcgacctttggggccgggggacccacattgtggttagctcc

SEQ ID NO: 41677 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctcc

SEQ ID NO: 41678 - RNA, 381 nt, synthetic construct
  misc_feature 1..381: note = derived and/or modified sequence opt5 from anti-HIV-1_HeavyChain
  source 1..381: mol_type = other RNA
agatgcatctggcggcaggccggcgggggagtgaagaaacccggcgctagcgtcaccctgtcctgtaagacagccgacgaggatgttttcgacgcggcttacatgcactgggtgcgccaagcccctgggcagacgtttgaatggctcggatggatgaaaccggtgaccggcgccgtctcttatgctagaaagttccaggggcgggtgagcttttacatgacacgcggaattagaatggcctatatggatctgcggaaccttcgcttcgacgataccgctgtttacttttgcgccagaaaaacagcgggcgacgtgtccggcgataatcgggggtatttctttgacctgtggggacgcggctctagagtcatcgtgagctcc

SEQ ID NO: 41679 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagattgtgagcggaacggtcaactttgcgtcccttgatttccggaatcgcatctctctgagcagagaccgggatctctccaccgcttatatggacattcgcggcctgacacaggatgacaccgccacatacttttgtgccagacagaaattcgctagccggtattctggggatcaaggatcctactttgacctttggggccgcggcaccctgatcgtggttagctct

SEQ ID NO: 41680 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcattcattgggttcgccaggcccctggacagggcctggagtggatcgggtgggtgaagacggtgaccggagcggtcaactttggcagccttgatttcagacaccggatttccctgacacgcgacagagatctctttaccgctcatatggacatccgggggctgacacagggagataccgccacatacttctgtgcccgccaaaaatttgaatctagatataccggcggccaggggtggtacttcgacctttggggacggggcacgcacattgtggttagctcc

SEQ ID NO: 41681 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccgctgcccatatggatattagaggcctgacacaggacgataccgccacatatttttgtgctcggcaaaaattcgccagccgctactctggggaccagggatcctattttgatctttggggcagaggcaccctgatcatcgtgagctct

SEQ ID NO: 41682 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgcttctagatatagcggcgatcaggggtcctacttcgacctgtggggacggggcacccttattgtggtcagctct

SEQ ID NO: 41683 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtacacgccaaaaatttgaatctagatataccggcgggcagggatggtacttcgacctttggggccgggggacgcacattgttgtgagctcc

SEQ ID NO: 41684 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggccggagtggatcggatgggtgaagacagtcacgggcgcggtgaactttgggagcctggatttcagacaccggatttcccttacccgcgacagagatctgtttacagctcatatggacatccggggactcacccagggcgatacagccacctacttctgtgcccgccaaaaatttgaatctagatatacaggcgggcagggatggtacttcgacctgtggggccgggggacccacattgttgtgagctcc

SEQ ID NO: 41685 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggccgcttgatttcagacaccggattagcctgacccgcgacagagatctctttacagctcatatggacatccggggactgacccagggcgatacagccacctacttctgtgcccgccaaaaatttgaatccagatatacaggcgggcagggatggtacttcgacctttggggccgggggacccacattgttgtgtctagc

SEQ ID NO: 41686 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggccccgccatgaagaaacctggggcttctgtgagagtcagctgctggacctccgaagacatcttcgagcggacagaactcatttactgggttcgccaggccccgggaagaggcctggagtggatcgggtgggtgaagacggtgtctggaaccgtcaactttggcagctccgatttccggaatcgcatttctcttacaagagaccgggatctgagcaccgcgcatatggacatccgcgggctcacacaggatgacaccgctacatatttttgtgccagacagaaattcgaatccctgtacagcgatgaccaaggatcttattttgatctttggggccggggcaccctgattatcgtgtccagc

SEQ ID NO: 41687 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcggcctctccacagctcatatggacattagagggctgacccaggatgacacagccacctatttttgtgcccggcaaaaattcgctagccgctactctggagatcagggctcctattttgacctttggggcagagggacactgatcatcgtgagctct

SEQ ID NO: 41688 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgcttctagatatagcggcgatcaggggtcctacttcgacctgtggggacggggcacacttatcattgtgagctct

SEQ ID NO: 41689 - RNA, 384 nt, synthetic construct
  misc_feature 1..384: note = derived and/or modified sequence opt5 from anti-HIV-1_HeavyChain
  source 1..384: mol_type = other RNA
cagagccacctggagcattccggctctgccatgaagaaacccggggctagcgtgagagtctcctgctggacctctgaagacatcttcgatacaacggagctcatttactgggttcggcaagcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcagaaattcgctagccgctattctggggaccaaggatcctactttgatctttggggcagaggcacactgatcgtggttagctct

SEQ ID NO: 41690 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaatctctgtatagcgatgaccagggctcctacttcgatctttgggggagaggaaccctgattatcgtgagctct

SEQ ID NO: 41691 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccggatttcccttacccgcgatagagacctgtttacagctcatatggatatccggggactcacccagggcgacacagccacctacttctgtgcccgccaaaaatttgaatctagatatacaggcgggcagggatggtacttcgatctgtggggccgggggacccacattgttgtgagctcc

SEQ ID NO: 41692 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaaacttgtgagcggagctgtcaactttggctccgtggatttcagaaatcggatctctctgagccgcgacagagatctctccacagcccatatggacattcgggggctgcgccaggatgacacggccacctatttttgtgctagacagaagttcgaaagccggtactctggagatcaaggctcctattttgacctttggggccgcgggacactgatcatcgttagctct

SEQ ID NO: 41693 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgaagagacccggggcctctgtccgggttagctgctggacctccgaagacatcttcgagcgcacagaactcatttactgggtgagacaggcgcctggacagggcctggagtggatcgggtgggtgaaaacggtctctggagctgtgaactttggcagccaggatttccgggaccgcttttcccttaccagagatcgggacctgtctacagcccatatggatattcgcgggctcacccaagacgatacagccacctatttctgtgctagacagaagtttgccagccggtactccggagaccagggcagctatttcgatctgtggggccgcgggacacttatcattgtttcttcc

SEQ ID NO: 41694 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagccttgatttccgccacagaatttccctgacccgggaccgcgatctctttacagctcatatggacatcagaggactgacccagggcgatacagccacctacttctgtgcccggcaaaagtttgaatctcgctatacaggcgggcagggatggtacttcgacctttggggcagagggacccacattgttgtgagctcc

SEQ ID NO: 41695 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccaggacgatacagccacctacttctgtgcccgccaaaaatttgaatctctgtatagcgacgatcagggctcctacttcgacctttggggcagagggacactgatcattgtgagctct

SEQ ID NO: 41696 - RNA, 384 nt, synthetic construct
  misc_feature 1..384: note = derived and/or modified sequence opt5 from anti-HIV-1_HeavyChain
  source 1..384: mol_type = other RNA
cagagccacctgaagcaatccggctctgccatgaaaaagcccggggctagcgtgagagtctcctgctggacctctgaggacatcttcgaacggacagagctcatttactgggttcgccaggcccctggaagaggcctggaatggatcgggtgggtgaaaacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaagttcgagagcctgtactctgatgaccaaggatcctattttgatctttggggccggggcaccctgattatcgtgagctct

SEQ ID NO: 41697 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctctacagctcatatggacatccggggactgacccaggatgacacagccacctacttttgtgcccgccaaaaattcgctagcagatattccggcgatcagggcagctactttgacctttgggggcggggaacactgattatcgtttcttcc

SEQ ID NO: 41698 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgaatctagatacaccggcggccaggggtggtattttgatctgtggggacggggcacacacatcgtggtcagctcc

SEQ ID NO: 41699 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacaggacgataccgccacatacttctgtgcccgccaaaaatttgaatccctgtattctgacgatcagggcagctacttcgacctttggggcagagggaccctgatcattgtgtccagc

SEQ ID NO: 41700 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcctcgagcggacagaactgatttactgggttcgccaggcccctggaagaggccttgagtggatcgggtgggtgaagacggtgagcggaaccgtcaacttcggctcctctgattttcggaatcgcattagcctgacaagagaccgggatctctccaccgcgcatatggacatccgcgggctgacacaggatgacaccgctacatatttctgtgccagacagaaatttgaaagcctttactctgatgaccaaggatcctatttcgatctgtggggccggggcaccctcattatcgtgagctct

SEQ ID NO: 41701 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaatttgcttccagatattctggcgatcaggggagctacttcgacctgtggggacggggcacccttatcgtggtctccagc

SEQ ID NO: 41702 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccggattagccttacacgcgatagagacctgtttaccgctcatatggatatccggggactcacacagggcgacaccgccacatacttctgtgcccgccaaaaatttgaatccagatataccggcgggcagggatggtacttcgatctgtggggccgggggacgcacattgttgtgtctagc

SEQ ID NO: 41703 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgacgatatcttcgaacggacagagctcattcattgggtgcgccaggcccctggccaggggctggaatggatcggatgggtgaagacggtcaccggcgcggtgaactttgggtctccgaatttcagacagcgggttagccttacacgcgacagagatctgtttaccgctcacatggacattcggggactcacacaaggcgataccgccacatacttctgtgcccgccagaaatttgagtccagatataccggcgggcagggatggtacttcgacctgtggggccgggggacgcatatcgtggtctctagc

SEQ ID NO: 41704 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcgtggttagctct

SEQ ID NO: 41705 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagaaaccggattagcctttcccgcgatagagacctgtctacagctcacatggatatccggggactcacccaggacgatacagccacctacttttgtgcccgccaaaaattcgctagcagatattccggcgaccagggcagctactttgatctgtgggggcggggaacacttattatcgtttcttcc

SEQ ID NO: 41706 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgaagagacccggggcctctgtccgggttagctgctggacctccgaagacatcttcgagcgcacagaactcatttactgggtgagacaggcgcctggacagggcctggagtggatcgggtgggtgaaaacggtcaccggagctgtgaactttggctctcttgatttccggcatcgcattagcctgacaagagaccgggatctctttaccgcccacatggacatccgcgggctgacacagggagataccgccacatatttctgtgctagacaaaagtttgaatcccggtacaccggcggccaggggtggtatttcgacctttggggacgcggcacgcatattgttgtgtctagc

SEQ ID NO: 41707 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaaacttgtgagcggagctgtcaactttggctccgtggatttcagagaccgggtttctctgacacgcgatagagacctctttacggcccatatggatatccgggggctgacccaggacgatacagccacctatttctgtgctcgccagaagtttgccagcagatactccggagaccaaggcagctatttcgatctttggggccgggggacactgattatcgtgtcttcc

SEQ ID NO: 41708 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcaccgtgaactttgcgagccttgatttcagaaatcggatttccctgtctcgcgacagagatctcagcacagcttacatggacatccgggggctgacccaggatgacacagccacctatttttgtgcccgccaaaaattcgcttccagatacagcggagatcagggctcttattttgacctttggggccgggggacactgattgttgtgtccagc

SEQ ID NO: 41709 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccggatttccctttctcgcgatagagacctgagcaccgcttacatggatatccggggactcacacaggacgataccgccacatatttttgtgcccgccaaaaattcgcttccagatacagcggcgaccagggctcttattttgatctgtgggggcggggaacccttattgttgtgtccagc

SEQ ID NO: 41710 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccccgacccgcgacagagatctgtttacagctcatatggacatccggggactcacccagggcgatacagccacctacttctgtgcccgccaaaaatttgaatctagatatacaggcgggcagggatggtacttcgacctgtggggccgggggacccttattgttgtgagctcc

SEQ ID NO: 41711 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctcccgacagcttatatggatattagaggcctgacccaggacgatacagccacctacttttgtgcccggcaaaaattcgcttcccgctatagcggggaccagggatcttactttgatctttggggcagaggcacactgatcgtggtttccagc

SEQ ID NO: 41712 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgcgagcggaaccgtgaactttgcttcccttgacttccgcaatagaatctctctgagccgggatcgcgacctctccacagcccatatggatattagaggcctgacccaggacgatacagccacctatttttgtgctcggcaaaaattcgccagccgctactctggggaccagggatcctattttgatctttggggcagaggcacactgatcgtcgtgagctct

SEQ ID NO: 41713 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagaccgtgacaggagcggtcaactttggcagccttgacttccgccatagaatttccctgacccgggatcgcgacctctttacagctcacatggatatcagagggctgacccagggagacacagccacctatttctgtgcccggcaaaaatttgagtctcgctacacgggcggccaggggtggtatttcgatctttggggaagaggcacccatattgtggttagctcc

SEQ ID NO: 41714 - RNA, 384 nt, synthetic construct
  misc_feature 1..384: note = derived and/or modified sequence opt5 from anti-HIV-1_HeavyChain
  source 1..384: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagctcacatggatattagaggcctgcggcaagacgataccgccacatatttttgtgcccgccagaaattcgagagcagatactccggggaccagggaagctattttgatctttggggccggggcaccctgatcatcgtctcttcc

SEQ ID NO: 41715 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgccatagaatctctctgacacgggatcgcgacctctttaccgctcacatggatattagaggcctgacacagggggacaccgccacatatttctgtgcccggcaaaaatttgagagccgctacaccggaggccagggctggtatttcgatctttgggggagaggaacgcatatcgtggtttccagc

SEQ ID NO: 41716 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcacgggagctgtgaactttggcagccttgatttccggcatcgcatttccctgaccagagaccgggatctctttacagcccacatggacatccgcgggctgacccagggagatacagccacctatttctgtgctagacaaaagtttgaatctcggtacacaggcggccaggggtggtatttcgacctttggggacgcggcacccatattgttgtgagctcc

SEQ ID NO: 41717 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagcctgtattccgacgatcagggcagctacttcgacctttgggggcgcggaacactgatcattgtgtcttcc

SEQ ID NO: 41718 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattgtggttagctct

SEQ ID NO: 41719 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattcgaatctagatacaccggcgggcagggatggtattttgacctgtggggccgggggacacacatcgtggtcagctcc

SEQ ID NO: 41720 - RNA, 381 nt, synthetic construct
  misc_feature 1..381: note = derived and/or modified sequence opt5 from anti-HIV-1_HeavyChain
  source 1..381: mol_type = other RNA
caggcccacctggagcaaagcggctccggggtgaagaaacccggagcttctgtcagagttagctgctggacctccgaagacatcctccggaagtctgagctgattcattgggtgcgccaggcccctggccaggggcttgaatggatcggatgggtgaaaacagtcacgggcgcggtgaacttcgggcaccagattagcgatagagtttccctgacccgggaccgcgatctctctacagctcatatggacatcagaggactgacccaagatgacacagccacctacttttgtgcccggcagaagttcgagagcctttattccgatgaccagggcagctactttgatctgtggggccgcgggacactcattatcgtgtcttcc

SEQ ID NO: 41721 - RNA, 384 nt, synthetic construct
  misc_feature 1..384: note = derived and/or modified sequence opt5 from anti-HIV-1_HeavyChain
  source 1..384: mol_type = other RNA
cccgcccacctggagcagagcggctccggggtgaagaaacctggagcttctgtcagagttagctgctgggcctccgaagacatcttcgagcggaccgaactcattcattgggtgcgccaagcgccgggccaggggctggagtggatcggatgggtgaagacagtcacgggcgctgtgaactttgggtctcttgatttcagacaccggattagcctgacccgcgacagagatctctttacagcccatatggacatccggggactgacccagggcgatacagccacctacttctgtgctcgccagaaatttgaatccagatatacaggcgggcaaggatggtacttcgacctttggggccgggggacccacattgttgtgtctagc

SEQ ID NO: 41722 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcagcggagctgtgaactttggctccacggatttccgggaacgcatttctcttagcagagaccgggatctgtccaccgcctatatggacatccgcgggctcacacaggatgacgccgctacctacttttgtgccagacaaaagttcgctagccggtattctggagatcagggctcctactttgacctgtggggccgcgggacacttattgttgtgagctct

SEQ ID NO: 41723 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatctgagacaccggatttccctcacccgcgacagagatctgttcacagctcatatggacatccggggacttacccagggcgatacagccacctacttttgtgcccgccaaaaattcgaatctagatatacaggcgggcagggatggtactttgacctgtggggccgggggacccacattgttgtgagctcc

SEQ ID NO: 41724 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgctgattgttgtgtctagc

SEQ ID NO: 41725 - RNA, 384 nt, synthetic construct
  misc_feature 1..384: note = derived and/or modified sequence opt5 from anti-HIV-1_HeavyChain
  source 1..384: mol_type = other RNA
agccacgacctggagcagtccggctctgccatgaagaaacccggggctagcgtgagagtctcctgctggacctctgaagatatcttcgacacaacggagctcatttactgggttcggcaagcccctggacagggcctggaatggatcgggtgggtgaagattgtgagcggaaccgtcaactttgcgtcccttgatttccgcaatagaatctctctgagccgggaccgcgatctctccacagcttatatggacattagaggcctgacccaggatgacacagccacctacttttgtgcccggcagaaattcgctagccgctattctggggatcaaggatcctactttgacctttggggcagaggcacactgatcgtggttagctct

SEQ ID NO: 41726 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtcacgggcgctgtgaactttgggtctctggatttcagacaccggattagcctcacccgcgacagagatctgtttacagcccatatggacatccggggacttacccagggcgatacagccacctacttctgtgctcgccaaaaatttgaatccagatatacaggcgggcagggatggtacttcgacctgtggggccgggggacccacattgttgtgtctagc

SEQ ID NO: 41727 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgcttccagatattctggcgatcaggggagctacttcgacctgtggggacggggcacccttatcgtggtctccagc

SEQ ID NO: 41728 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagctcatatgggcattagagggctccggcaggatgacaccgccacatatttttgtgcccgccaaaaattcgagtctagatactccggagatcagggcagctattttgacctgtggggccgggggacccttatcatcgtgtcttcc

SEQ ID NO: 41729 - RNA, 384 nt, synthetic construct
  misc_feature 1..384: note = derived and/or modified sequence opt5 from anti-HIV-1_HeavyChain
  source 1..384: mol_type = other RNA
gaggtgcagctggtccaaagcggcgccgacgttaagaaacccggggcttccgtgagagtgtcttgctggaccagcgaagatatcttcgacacaacggagctcatttactgggtccggcaggcccctggacagggcctggaatggatcgggtgggtgaagattgtttccggaaccgtgaactttgcgtctcttgatttccgcaatagaatcagcctgtcccgggaccgcgatctctctacagcttatatggacattagaggcctgacccaggatgacacagccacctacttttgtgcccggcaaaaattcgctagccgctattccggggatcagggaagctactttgacctttggggcagaggcacactgatcgtcgtgtcttcc

SEQ ID NO: 41730 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcaccaggcccctggccaggggctggagtggatcggatgggtgaagacagtcacgggcgcggtgaactttgggagccttgatttccgccatagaatttccctgacccgggaccgcgatctctttacagctcacatggacatcagaggactgacccagggcgatacagccacctacttctgtgcccggcaaaaatttgaatctcgctatacaggcgggcagggatggtacttcgacctttggggcagagggacccatattgttgtgagctcc

SEQ ID NO: 41731 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgctctctccacagcccatatggacattagaggcctgacccaggatgacacagccacctatttttgtgctcggcaaaaattcgccagccgctactctggggatcagggatcctattttgacctttggggcagaggcacactgatcatcgtgagctct

SEQ ID NO: 41732 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgctagccttgatttcagaaatcggatttccctgtctcgcgacagagatctcagcaccgcctacatggacatccgggggctgacacaggatgacaccgccacatatttttgtgctcgccaaaaattcgcctccagatacagcggagatcagggctcttattttgacctttggggccgggggaccctgattgttgtgtccagc

SEQ ID NO: 41733 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaaacttgtgagcggagctgtcaactttgcctccctggatttcagaaatcggatctctctcagccgcgacagagatctgtccacagcctatatggacattcggggccttacgcaggatgacaccgctacatacttttgtgcccgccagaagttcgctagcagatattctggggatcaaggatcctactttgacctgtggggccggggcaccctcatcgtggttagctct

SEQ ID NO: 41734 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccaggatgacacagccacctacttctgtgcccgccaaaaatttgcttctagatatagcggcgatcagggctcctacttcgacctttgggggcggggaacactgattatcgttagctct

SEQ ID NO: 41735 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggggtggatcggatgggtgaagattgtgagcggcaccgtcaactttgcgtcccttgacttccgctctagaatcagcctgtcccgggatcgcgacctcagcacagcttatatggatattagagggctgacccaggacgatacagccacctacttttgtgcccggcaaaaattcgcttctcgctattccggagaccagggcagctactttgatctttggggcagagggacactgatcgtggtttcttcc

SEQ ID NO: 41736 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggcgaagacggtgaccggcgctgtcaactttgggtctcttgatttcagacaccggattagcctgacacgcgacagagatctctttaccgcccatatggacatccggggactgacacagggcgataccgccacatacttctgtgctcgccaaaaatttgaatccagatataccggcgggcagggatggtacttcgacctttggggccgggggacgcacattgtggtttctagc

SEQ ID NO: 41737 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccgctatgaagaaacccggggcctctgtgagagtcagctgctggacctccgaagacatcttcgagcggacagaactcatttactgggttcgccaggcgcctggaagaggcctggagtggatcgggtgggtgaagacggtgtctggaaccgtcaactttggcagctccgatttccggaatcgcatttctcttacaagagaccgggatctgagcaccgctcatatggacatccgcgggctcacacaggatgacaccgccacatatttttgtgccagacagaaattcgaatccctgtacagcgatgaccaaggatcttattttgatctttggggccggggcaccctgattatcgtgtccagc

SEQ ID NO: 41738 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttggctcccttgacttccgccatagaatctctctgacacgggatcgcgacctctttaccgcgcacatggatattagagggctgacacagggagacaccgctacatatttctgtgcccggcaaaaatttgagagccgctacaccggcggccaggggtggtatttcgatctttggggaagaggcacgcatatcgtggtttccagc

SEQ ID NO: 41739 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgatacaacggagctgatttactgggtgcggcaggcccccggccaggggcttgaatggatcggatgggtgaagattgtctctggcaccgtgaactttgcgagcctggacttccgcaatagaatctccctctctcgggatcgcgacctgagcacagcttatatggatattagagggcttacccaggacgatacagccacctacttttgtgcccggcaaaaattcgcttcccgctatagcggagaccagggctcttactttgatctgtggggcagagggacactcatcgttgtgtccagc

SEQ ID NO: 41740 - RNA, 384 nt, synthetic construct
  misc_feature 1..384: note = derived and/or modified sequence opt5 from anti-HIV-1_HeavyChain
  source 1..384: mol_type = other RNA
agccacaacctggagcagtccggctctgccatgaagaaacccggggctagcgtgagagtctcctgctggacctctgaagacatcttcgatacaacggagctcatttactgggttcggcaagcccctggacagggcctggaatggatcgggtgggtgaagattgtgagcggaaccgtcaattttgcgtcccttgacttccgcaacagaatctctctgagccgggatcgcgacctctccacagcttatatggatattagaggcctgacccaggacgatacagccacctacttttgtgcccggcagaaattcgctagccgctattctggggaccaaggatcctactttgatctttggggcagaggcacactgatcgtggttagctct

SEQ ID NO: 41741 - RNA, 384 nt, synthetic construct
  misc_feature 1..384: note = derived and/or modified sequence opt5 from anti-HIV-1_HeavyChain
  source 1..384: mol_type = other RNA
agccacacctggaacaatagaggctccgccatgaagaaacccggggcttctgtgcgggtcagctgctggacatccgaggacatcttcgaacgcacggagctgatttactgggttagacaggcccctggacggggcctcgaatggatcgggtgggtgaagaccgtgtctggaacagtcaactttggcagctccgatttccgcaatagaatttctctgagccgggaccgcgatctttccaccgcgcatatggacatcagagggctgacacaagatgacaccgctacatatttttgtgcccggcagaaattcgccagccgctactctggagatcagggctcctattttgacctctggggcagagggaccctgattatcgtgagctct

SEQ ID NO: 41742 - RNA, 384 nt, synthetic construct
  misc_feature 1..384: note = derived and/or modified sequence opt5 from anti-HIV-1_HeavyChain
  source 1..384: mol_type = other RNA
agccacacctggaacgagtccggctctgccatgaagaaacccggggctagcgtgagagtctcctgctggacatctgaagacatcttcgagcggacggaactgatttactgggttcgccaggcccctggaagaggcctcgagtggatcgggtgggtgaagattgtgagcggaaccgtcaattttgcgtccctggatttccggaaccgcatctctcttagcagagaccgggatctgtccacagcttatatggacattcgcggcctcacccaagatgacacagccacctacttttgtgccagacagaaattcgctagccggtattctggggatcagggatcctactttgacctgtggggccgcggcacacttatcgtggttagctct

SEQ ID NO: 41743 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaactacgggtctctgaattttcggagccgcatttcccttaccagagatcgggacctgttcacagcgcacatggatatccgcggactcacccagggcgacacagctacctatttttgtgccagacagaaattcgaatctcggtacacgggcgggcaaggatggtattttgatctgtggggccgcgggacccatattgttgtgagctcc

SEQ ID NO: 41744 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcaaggttagctgctggacctccgaagacatcttcgagagaacagaactcattcattgggtgcggcaggcccctggccaggggctggagtggatcggatgggtgaaaacggtcaccggcgcggtgaactttgggtctcttgatttccgccacagaattagcctgacacgggaccgcgatctctttaccgctcatatggacatcagaggactgacacagggcgataccgccacatacttctgtgcccggcaaaagtttgaatcccgctataccggcgggcagggatggtacttcgacctttggggcagagggacgcacattgttgtgtctagc

SEQ ID NO: 41745 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtctacagcctatatggatattagaggcctcacccaggacgatacagccacctacttttgtgctcggcaaaaattcgccagccgctattccggcgaccaggggagctactttgatctgtggggaagaggcacacttatcgtggtctcttcc

SEQ ID NO: 41746 - RNA, 384 nt, synthetic construct
  misc_feature 1..384: note = derived and/or modified sequence opt5 from anti-HIV-1_HeavyChain
  source 1..384: mol_type = other RNA
ggccacgacctggagcagagcgggtccggagtgaagaaacccggcgcctctgtcagagttagctgctggacctccgaagatatcttcgaggggtctgaactcattcattgggtgcggcaagctcctggacagggcctggagtggatcgggtgggtgaagacagtcacgggagccgtgaactttggcagcgcgtacttccgccacagaatttccctttctcgggaccgcgatctgagcaccgcttatatggacatcagaggcctcacacaggatgacaccgccacatacttttgtgcccggcagaaattcgcttcccgctatagcggggatcaaggatcttactttgacctgtggggcagagggacccttattgttgtgtccagc

SEQ ID NO: 41747 - RNA, 384 nt, synthetic construct
  misc_feature 1..384: note = derived and/or modified sequence opt5 from anti-HIV-1_HeavyChain
  source 1..384: mol_type = other RNA
agccacacctggaacaatagaggctccgccatgaagaaacccggggcttctgtgcgggtcagctgctggacatccgaggacatcttcgatacgaccgaactgatttactgggttcgccaggcccctggacaaggcctcgagtggatcgggtgggtgaagacagtgtctggaaccgtcaactttggcagctccgacttcagaaatcggatttctctgacacgcgatagagaccttagcaccgcgcatatggatatccgggggctgacacaggacgataccgctacgtatttttgtgcccgccagaaattcgaatccctctacagcgacgatcagggatcttattttgacctgtggggcagaggcacccttattatcgtgtccagc

SEQ ID NO: 41748 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtctctggcgccgtgaactttgggagcccgaatttccggcaccgcgtttccctgacaagagatcgggacctttttaccgcgcatatggatattcgcggactgacacagggcgacaccgctacatacttctgtgccagacagaaatttgaatctcggtataccggcgggcaaggatggtacttcgatctctggggccgcgggacgcacatcgtggtcagctcc

SEQ ID NO: 41749 - RNA, 384 nt, synthetic construct
  misc_feature 1..384: note = derived and/or modified sequence opt5 from anti-HIV-1_HeavyChain
  source 1..384: mol_type = other RNA
agccacacctggaacaatagaggctccgccatgaagaaacccggggcttctgtgcgggtcagctgctggacatccgaggacatcttcgaacgcacggagctgatttactgggttagacaggcccctggacggggcctcgaatggatcgggtgggtgaagaccgtgtctggaacagtcaactttggcagctccgatttccgcaatagaatttctctgacccgggaccgcgatcttagcacagcgcatatggacatcagagggctgacccaagatgacacagctacctatttttgtgcccggcagaaattcgagtccctctacagcgatgaccagggatcttattttgatctgtggggccgcggcacgcttattatcgtgtccagc

SEQ ID NO: 41750 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgcctcgcctctgaagacatcttcgataccacagagctgatttactgggttcggcaggcgcctggacagggccttgaatggatcgggtgggtgaagattgtgagcggaacggtcaactttgcttccctggacttccgcaatagaatctctctcagccgggatcgcgacctgtccaccgcctatatggatattagaggccttacacaggacgataccgccacatacttttgtgctcggcaaaaattcgccagccgctattctggggaccagggatcctactttgatctgtggggcagaggcaccctcatcgtggttagctct

SEQ ID NO: 41751 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggcgccgctatgaagaaacccggggcctctgtgagagtcagctgctggacctccgaagacatcttcgatacaacggagctcatttactgggttcggcaggcgcctggacagggcctggaatggatcgggtgggtgaagattgtgtctggaaccgtcaactttgctagccttgacttccgcaatagaatctccctgtctcgggatcgcgacctcagcacagcccatatggatattagaggcctgcggcaggacgataccgccacatatttttgtgctcgccaaaaattcgagtccagatacagcggggaccagggatcttattttgatctttggggccggggcaccctgatcatcgtgtccagc

SEQ ID NO: 41752 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagaagtctgaactgattcattgggtgcgccaagctcctggccaggggctcgagtggatcggatgggtgaaaacggtcaccggcgccgtgaactttgggagctccgatttcagacagcgggtttctctgacacgcgacagagatctttttaccgcgcacatggacattcggggactgacacagggcgataccgctacatacttctgtgcccgccaaaagtttgaaagcagatataccggcgggcagggatggtacttcgacctctggggccgggggacgcatatcgtggtctccagc

SEQ ID NO: 41753 - RNA, 384 nt, synthetic construct
  misc_feature 1..384: note = derived and/or modified sequence opt5 from anti-HIV-1_HeavyChain
  source 1..384: mol_type = other RNA
agccacacctggaacgagtccggctctgccatgaagaaacccggggctagcgtgagagtctcctgctggacatctgaagacatcttcgatacgaccgagctgatttactgggttcggcaggcccctggacaaggcctcgaatggatcgggtgggtgaagattgtgagcggaacagtcaattttgcgtccctggacttccgcaacagaatctctcttagccgggatcgcgacctgtccaccgcttatatggatattagaggcctcacacaggacgataccgccacatacttttgtgcccggcagaaattcgctagccgctattctggggaccagggatcctactttgatctgtggggcagaggcacccttatcgtggttagctct

SEQ ID NO: 41754 - RNA, 384 nt, synthetic construct
  misc_feature 1..384: note = derived and/or modified sequence opt5 from anti-HIV-1_HeavyChain
  source 1..384: mol_type = other RNA
agacacacctggaacgagagcggctccggggtgaagaaacccggagcctctgtccgggttagctgctggtcctctgaagacatcttcgagcgcacagaactgattcattgggtgagacaggctcctggccgggggctcgagtggatcggatgggtgaagacggtcagcggcaccgtgaattttgggtcctctgatttccgcaacagaattagcctgacacgggaccgcgatctttccaccgcccacatggacatcagaggactgacacaagatgacaccgcgacatacttttgtgctcggcagaaattcgaaagcctctattctgatgaccagggctcctactttgatctgtggggccgcgggacccttattatcgttagctct

SEQ ID NO: 41755 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgaaatgaagaaacccggggccagcgtgagagtctcctgctggacctctgaggacatcttcgatacaacggaactcatttactgggttcggcaggctcctggacagggcctggagtggatcgggtgggtgaagattgtgagcggaaccgtcaactttgcctcccttgacttccgcaatagaatctctctgagccgggatcgcgacctctccacagcgtatatggatattagaggcctgacccaggacgatacagctacctacttttgtgcccggcaaaaattcgccagccgctattctggggaccagggatcctactttgatctttggggcagaggcacactgatcgtggttagctct

SEQ ID NO: 41756 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcaccgtgaactttgggtctctgaatttccggcagcgcgttagccttacaagagatcgggacctgtttaccgcccacatggatattcgcggactcacacagggcgacaccgcgacgtacttctgtgctagacaaaaatttgaatccctgtattctgatgaccagggcagctacttcgatctttgggggcggggaaccctgatcattgtgtccagc

SEQ ID NO: 41757 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagccagattttcagacaccggatctcccttacccgcgatagagacctgtttacagctcatatggatattcggggactcacccaaggcgacacagccacctacttctgtgcccgccagaaatttgaatctagatatacaggcgggcagggatggtacttcgatctgtggggccgggggacccacatcgttgtgagctcc

SEQ ID NO: 41758 - RNA, 384 nt, synthetic construct
  misc_feature 1..384: note = derived and/or modified sequence opt5 from anti-HIV-1_HeavyChain
  source 1..384: mol_type = other RNA
agccacacctggaacaagtccggctctgccatgaaaaagcccggggctagcgtgagagtctcctgctggacatctgaggacatcttcgaacggacggagctgatttactgggttcgccaggcccctggaagaggcctcgaatggatcgggtgggtgaaaaccgtgagcggaacagtcaattttggctcctctgatttccggaaccgcattagcctgaccagagaccgggatctttccacagcgcatatggacatccgcgggctgacccaagatgacacagctacctatttttgtgccagacagaagttcgagagcctctactctgatgaccagggatcctattttgatctgtggggccggggcacgcttattatcgtgagctct

SEQ ID NO: 41759 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccagattttcagacaccggatctcccttacccgcgatagagacctgtttacagctcatatggatattcggggactcacccaaggcgacacagccacctacttctgtgcccgccagaaatttgaatctagatatacaggcgggcagggatggtacttcgatctgtggggccgggggccgaccctttttgttagctcc

SEQ ID NO: 41760 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaagacatgtagcggagctgtgaactttggctccgtcgatttcagagaccgggtgtctcttacgcgcgatagagacctgtttaccgcccatatggatatccgggggctcacacagggagacaccgccacatatttctgcgctcgccagaaatttgaaagcagatacaccggcggccaagggtggtatttcgatctgtggggacggggcacacacattgttgtgtccagc

SEQ ID NO: 41761 - RNA, 384 nt, synthetic construct
  misc_feature 1..384: note = derived and/or modified sequence opt5 from anti-HIV-1_HeavyChain
  source 1..384: mol_type = other RNA
agccacaccgtggagcagtccggctctgccatgaagaaacccggggctagcgtcagagtttcctgctggacatctgaagacatcttcgatacgaccgagctgatttactgggtgcggcaagcccctggacagggcctcgaatggatcgggtgggtgaagattgtcagcggaacagtgaactttgcgtccctggacttccgcaatagaatctctcttagccgggatcgcgacctgtccaccgcttatatggatattagaggcctcacacaggacgataccgccacatacttttgtgcccggcagaaattcgctagccgctattctggggaccaaggatcctactttgatctgtggggcagaggcacccttatcgttgtgagctct

SEQ ID NO: 41762 - RNA, 384 nt, synthetic construct
  misc_feature 1..384: note = derived and/or modified sequence opt5 from anti-HIV-1_HeavyChain
  source 1..384: mol_type = other RNA
agacacacctggaacaagagcggctccggggtgaaaaagcccggagcctctgtccgggttagctgctggtcctctgaggacatcttcgaacgcacagagctgattcattgggtgagacaggctcctggccaagggctcgaatggatcggatgggtgaaaacggtcaccggcgccgtgaattttgggagcctggatttccggcaccgcatttcccttacaagagaccgggatctgtttaccgcgcatatggacatccgcggactcacacagggcgataccgctacatacttctgtgccagacagaagtttgagtctcggtataccggcgggcagggatggtacttcgacctgtggggccgcgggacgcacattgttgtgagctcc

SEQ ID NO: 41763 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccagagactggagtggatcgggtgggtgaagacggtcaccggagcggtgaactttggctctccgaatttccggcaccgcgttagccttacaagagatcgggacctgtccaccgcttacatggatattcgcgggctcacacaggacgataccgccacatatttttgtgccagacaaaaattcgcttctcggtacagcggagaccagggctcctattttgatctgtggggccgcgggacccttatcgtggtcagctct

SEQ ID NO: 41764 - RNA, 384 nt, synthetic construct
  misc_feature 1..384: note = derived and/or modified sequence opt5 from anti-HIV-1_HeavyChain
  source 1..384: mol_type = other RNA
agccacgacctggagcagtccggctctgccatgaagaaacccggggctagcgtgagagtctcctgctggacctctgaagatatcttcgacacaacggagctcatttactgggttcggcaagcccctggacagggcctggaatggatcgggtgggtgaagattgtgagcggaaccgtcaactttgcgtcccttgatttccgcaatagaatctctctgagccgggaccgcgatctctccacagctcatatggacattagaggcctgcggcaggatgacaccgccacatatttttgtgcccgccagaaattcgagagcagatactctggggatcaaggatcctattttgacctttggggccggggcaccctgatcatcgtgagctct

SEQ ID NO: 41765 - RNA, 384 nt, synthetic construct
  misc_feature 1..384: note = derived and/or modified sequence opt5 from anti-HIV-1_HeavyChain
  source 1..384: mol_type = other RNA
agacacacctggaacgagagcggctccggggtgaagaaacccggagcctctgtccgggttagctgctggtcctctgaagacatcttcgagcgcacagaactgattcattgggtgagacaggctcctggccaagggctcgagtggatcggatgggtgaagacggtcaccggcgccgtgaattttgggagcctggatttccggcaccgcatttcccttacaagagaccgggatctgtttaccgcgcatatggacatccgcggactcacacagggcgataccacaacctacttctgtgctagacagaaatttgaatctcggtatacgggcgggcagggatggtacttcgacctgtggggccgcgggacccacattgttgtgagctcc

SEQ ID NO: 41766 - RNA, 384 nt, synthetic construct
  misc_feature 1..384: note = derived and/or modified sequence opt5 from anti-HIV-1_HeavyChain
  source 1..384: mol_type = other RNA
agacacacctgggaacaggtgtggagcggcgtcaagaaacccggggcctccgttcgggtgtcttgctggagctccgaggacatcttcgagcgcacagaactgattcattgggtgagacaagctcctggacagggcctcgagtggatcgggtgggtcaagacggtgaccggagccgttaactttggctctctggatttccggcaccgcattagccttacaagagaccgggatctgtttaccgcgcatatggacatccgcgggctcacacagggagataccgctacatacttctgtgccagacagaaatttgaatcccggtataccggcggccaagggtggtacttcgacctgtggggacgcggcacgcacattgtggtctctagc

SEQ ID NO: 41767 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgaccgtctcctgctggacatctgaagacatcttcgatacgaccgagctcatttactgggttagacaggcccctggacagggcctggaatggatcgggtgggtgaagattgtgagcggaacagtcaactttgcgtcccttgacttccggaatcgcatctctctgagcagagatcgggacctctccaccgcttatatggatattcgcggcctgacacaggacgataccgccacatacttttgtgccagacaaaaattcgctagccggtattctggggaccagggatcctactttgatctttggggccgcggcaccctgatcgtggttagctct

SEQ ID NO: 41768 - RNA, 384 nt, synthetic construct
  misc_feature 1..384: note = derived and/or modified sequence opt5 from anti-HIV-1_HeavyChain
  source 1..384: mol_type = other RNA
agacacgacctggagcagagcggctccggggtgaagaaacccggagcctctgtccgggttagctgctggtcctctgaagatatcttcgagcgcaccgaactcattcattgggtgagacaagctcctggccaggggctggagtggatcggatgggtgaagacagtcacgggcgccgtgaactttgggagccttgacttccggcaccgcatttccctgaccagagatcgggacctctttacagcgcatatggatatccgcggactgacccagggcgacacagctacctacttctgtgccagacagaaatttgaatctcggtatacaggcgggcaaggatggtacttcgatctttggggccgcgggacccacattgttgtgagctcc

SEQ ID NO: 41769 - RNA, 384 nt, synthetic construct
  misc_feature 1..384: note = derived and/or modified sequence opt5 from anti-HIV-1_HeavyChain
  source 1..384: mol_type = other RNA
gtgaccacatggaacaagagcggctccgccatgaaaaagcccggggcttctgtcagagttagctgctggacgtccgaggacatcttcgataccacagaactgatttactgggtgcggcaggcccctggacgcggcctcgagtggatcgggtgggtgaaaaccgtctctggaacagtgaattttggcagctccgacttcagaaaccggatttctctgacccgcgatagagaccttagcacagcgcacatggatatccgggggctgacccaagacgatacggctacctatttttgtgcccgccagaagttcgaatccctctacagcgacgatcagggatcttattttgacctgtggggcagaggcacacttattatcgtttccagc

SEQ ID NO: 41770 - RNA, 384 nt, synthetic construct
  misc_feature 1..384: note = derived and/or modified sequence opt5 from anti-HIV-1_HeavyChain
  source 1..384: mol_type = other RNA
agacacacctggaacaatacaggcagcggggtgaagaaacccggagcctccgtccgggtttcttgcctggctagcgaggacatcttcgaacgcacggagctcattcattgggtgagacaggcccctggccaagggctggaatggatcggatgggtgaagaccgtcacaggcgcggtgaactttgggtcccttgatttccggcaccgcatttctctgaccagagaccgggatctctttacagctcatatggacatccgcggactgacccagggcgatacagccacctacttctgtgccagacagaaatttgagagccggtatacgggcgggcagggatggtacttcgacctttggggccgcgggacccacattgttgtgtcctct

SEQ ID NO: 41771 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgcctcgcctctgaagacatcttcgagcggaccgaactgatttactgggttcgccaggcgcctggaagaggcccggagtggatcgggtgggtgaagacagtgagcggaacggtcaactttggctcctctgatttccggaatcgcattagccttaccagagaccgggatctgtccacagctcatatggacatccgcgggctcacccaggatgacacagccacctatttttgtgccagacagaaattcgaaagcctgtactctgatgaccaaggatcctattttgatctttggggccggggcacactgattatcgtgagctct

SEQ ID NO: 41772 - RNA, 384 nt, synthetic construct
  misc_feature 1..384: note = derived and/or modified sequence opt5 from anti-HIV-1_HeavyChain
  source 1..384: mol_type = other RNA
agacacacctggaacaatacaggcagcggggtgaagaaacccggagcctccgtccgggtttcttgctggacgagcgacgatatcttcgagcgcaccgaactgattcattgggtgagacaggctcctggccaagggctcgagtggatcggatgggtgaagacagtctccggcaccgtgaactttgcctctctggacttccggaatcgcattagcctttccagagatcgggacctgtctacagcgtacatggatatccgcgggctcacccaggacgatacagctacctatttttgtgccagacagaaattcgccagccggtactccggagaccagggcagctattttgatctgtggggccgcgggacgcttattgttgtgtcttcc

SEQ ID NO: 41773 - RNA, 384 nt, synthetic construct
  misc_feature 1..384: note = derived and/or modified sequence opt5 from anti-HIV-1_HeavyChain
  source 1..384: mol_type = other RNA
ggcacccccgggaacaagagcggatccggcgtgaaaaagcctggggcctctgtcagagttagctgctggtcctctgaggacatcttcgaacggacagagctgattcactgggtgcgccaggctccgggacaaggcctcgaatggatcgggtgggtgaaaacggtcaccggagccgtgaattttggcagcctggatttcagacatcggatttcccttacacgcgacagagatctgtttaccgcgcacatggacatccggggcctcacacagggggataccgctacatacttctgtgcccgccagaagtttgagtctagatataccggaggccaggggtggtacttcgacctgtggggacggggcacgcatattgttgtgagctcc

SEQ ID NO: 41774 - RNA, 384 nt, synthetic construct
  misc_feature 1..384: note = derived and/or modified sequence opt5 from anti-HIV-1_HeavyChain
  source 1..384: mol_type = other RNA
ggcacccccgggagcgagtccggatctggcgtgaagagacctggggccagcgtccgggtttcctgctggacatctgaagacatcttcgagacgaccgaactgattcactgggtgcgccaggctccgggacaaggcctcgagtggatcgggtgggtgaaaacagtcagcggagccgtgaactttggctccctgaatttcagacatcgggtttctcttacccgcgatagagacctgtttacagcgcacatggatattcggggcctcacccagggggacacagctacctacttctgtgcccgccagaagtttgaaagcagatatacgggaggccaggggtggtacttcgatctgtggggacggggcacccatatcgtggtctccagc

SEQ ID NO: 41775 - RNA, 384 nt, synthetic construct
  misc_feature 1..384: note = derived and/or modified sequence opt5 from anti-HIV-1_HeavyChain
  source 1..384: mol_type = other RNA
gtgacccccggcacaaacctggggctcagaatgaagaaacctggagccagcgtccgggtttcctgctggacgtctgaggacatcttcgataccacagaactgatttactgggtgcgccaggctccgggccaagggcttgagtggatcggatgggtgaagattgtcagcggcaccgtgaattttgcctccctggacttcagaaaccggatctctctcagccgcgatagagacctgtccacagcgtatatggatattcgggggcttacccaggacgatacagctacctacttttgtgcccgccagaaattcgcctctagatatagcggagaccagggctcctactttgatctgtggggccgggggacgctcatcgttgtgagctct

SEQ ID NO: 41776 - RNA, 384 nt, synthetic construct
  misc_feature 1..384: note = derived and/or modified sequence opt5 from anti-HIV-1_HeavyChain
  source 1..384: mol_type = other RNA
agacacgacctggagcagagcggcgccggggtgaagaaacccggagcttccgtccgggtttcttgctggagctccgaagatatcttcgagcgcaccgaactcattcattgggtgagacaagcccctggccaggggctggagtggatcggatgggtgaagacagtcacgggcgcggtgaactttgggtctcttgacttccggcaccgcattagcctgaccagagatcgggacctctttacagctcatatggatatccgcggactgacccagggcgacacagccacctacttctgtgccagacagaaatttgaatcccggtatacaggcgggcaaggatggtacttcgatctttggggccgcgggacccacattgttgtgtctagc

SEQ ID NO: 41777 - RNA, 384 nt, synthetic construct
  misc_feature 1..384: note = derived and/or modified sequence opt5 from anti-HIV-1_HeavyChain
  source 1..384: mol_type = other RNA
caggtgcacctggagcaaagcggctccggggtcaagaaacccggagcctctgttagagtgagctgctggacctccgaagacatcttcgagaagtctgaactcattcattgggtgcggcaggctcctggccaggggctggagtggatcggatgggtcaaaacagtgacgggcgccgttaactttgggagctccgatttccgccagagagtgtctcttaccccggaccgggatctgtttacagcgcacatggacattcgcggactcacccaaggcgatacagctacctacttctgtgccagacagaagtttgaaagccggtatacaggcgggcagggatggtacttcgacctgtggggccgcgggacccatatcgtcgtgtccagc

SEQ ID NO: 41778 - RNA, 384 nt, synthetic construct
  misc_feature 1..384: note = derived and/or modified sequence opt5 from anti-HIV-1_HeavyChain
  source 1..384: mol_type = other RNA
ggcaccacatgggagcagagcgggtccggagtgaagaaacccggcgcctctgtcagagttagctgctggacgtccgaagacatcttcgagaagtctgaactgattcactgggtgcggcaagctcctgggcagggactcgagtggatcggctgggtgaaaaccgtcacaggggccgtgaactttggaagcctggatttccgccatagaatttcccttacccgggaccgcgatctgtttacagcgcacatggacatcagaggcctcacccagggcgatacagctacctacttctgtgcccggcagaagtttgaatctcgctataccgggggacaaggctggtacttcgacctgtgggggagaggaacgcatattgttgtgagctcc

SEQ ID NO: 41779 - RNA, 384 nt, synthetic construct
  misc_feature 1..384: note = derived and/or modified sequence opt5 from anti-HIV-1_HeavyChain
  source 1..384: mol_type = other RNA
agccacgacctggagcagtccggctctgaatggaagaaacccggggccagcgtgagagtctcctgctggacctctgaggatatcttcgacacaacggaactcattcattgggttcggcaagctcctggacagggcctggagtggatcgggtgggtgaagaccgtgacaggagccgtcaactttggcagccttgatttccgccacagaatttccctgacccgggaccgcgatctctttacagcgcatatggacatcagagggctgacccagggagatacagctacctacttctgtgcccggcagaaatttgaatctcgctatacgggcggccaagggtggtacttcgacctttggggaagaggcacccacattgtggttagctcc

SEQ ID NO: 41780 - RNA, 384 nt, synthetic construct
  misc_feature 1..384: note = derived and/or modified sequence opt5 from anti-HIV-1_HeavyChain
  source 1..384: mol_type = other RNA
cagagcagacccggcaacaagtccgggtctgccatgaaaaagcctggagctagcgtgcgggtctcctgctggacctctgaggacatcttcgaacgcacagagctgctctgggttagacaagccccgggccgggggctggaatggattggatgggtgaaaacggtgagcggcaccgtcaattttgggtcctctgatttccgcaacagaatcagccttacacgggaccgcgatctgtccaccgcgcacatggacattagaggactcacacaggatgacaccgctacatacttttgtgcccggcagaagttcgagagcctgtattctgatgaccagggctcctactttgatctttggggccgcgggaccctgatcattgtgagctct

SEQ ID NO: 41781 - RNA, 384 nt, synthetic construct
  misc_feature 1..384: note = derived and/or modified sequence opt5 from anti-HIV-1_HeavyChain
  source 1..384: mol_type = other RNA
ggcaccacatggagcaagtccgggtctggagtgaaaaagcccggcgccagcgtcagagtttcctgctggacgtctgaggacatcttcgaacggaccgagctgatttactgggtgcgccaggctcctgggcaaggactcgaatggatcggctgggtgaaaattgtcagcgggacagtgaactttgcctccctggatttcagaaatcggatctctcttagccgcgacagagatctgtccaccgcgcacatggacattcggggactcacacaggatgacaccgctacatatttttgtgcccgccagaagttcgccagcagatactctggcgatcagggctcctattttgacctgtgggggcggggaacccttatcatcgttagctct

SEQ ID NO: 41782 - RNA, 387 nt, synthetic construct
  misc_feature 1..387: note = derived and/or modified sequence opt5 from anti-HIV-1_HeavyChain
  source 1..387: mol_type = other RNA
caggcccacctggagcaaagcggctccggggtgaagaaacccggagcttctgtcagagttagctgctggacctccgaagacatcctccggaagaaacgcgtggattctgtgggctgtgacacagcccctgggcagggactggagtggattggctgggtcaagacggtgaccggggcggttaacttcggaagctccgattttagacagcgggtgtctcttacacgcgacagagatctgttcaccgctcatatggacatccggggcctcacacaggatgacaccgccacatacttttgcgcccgccaaaaattcgctagcagatattccggcgatcaggggagctactttgacctgtggggacggggcacccttattgtcgtgtcttcc

SEQ ID NO: 41783 - RNA, 387 nt, synthetic construct
  misc_feature 1..387: note = derived and/or modified sequence opt5 from anti-HIV-1_HeavyChain
  source 1..387: mol_type = other RNA
aaggcccacctgggcaacaaaagcgggtccggagtgaagaaacccggcgcttctgtcagagttagctgctggtcctctgaggacatcttcgaacggaccgagctcattcattgggtgcgccaggcccctgggcaaggactggaatggatcggctgggtgaagacagtcacgggggcggtgaattttggaagccttgatttcagacaccggatttccctgacccgcgacagagatctctttacagctcatatggacatccggggcctgacccagggcgatacagccacctacttctgtgcccgccagaaatttgagtctagatatacagggggacagggctggtacttcgacctttgggggcggggaacccacattgttgtgagctcc

SEQ ID NO: 41784 - RNA, 384 nt, synthetic construct
  misc_feature 1..384: note = derived and/or modified sequence opt5 from anti-HIV-1_HeavyChain
  source 1..384: mol_type = other RNA
accacagtgggcacgatcctggggagagccatgaagaaacccggagctagcgtccgggtttcctgctggacctctgaggacattttcgatacaaccgaactcatctactgggtgcgccaggcccctggccaagggctggagtggattggatgggtgaagatcgtcagcggcacagtgaactttgcgtcccttgacttcagaaatcggatttctctgagccgcgatagagacctctccaccgcttatatggatatccgggggctgacacaggacgataccgccacgtacttttgtgcccgccagaaattcgcttctagatatagcggagaccagggctcctactttgatctttggggccgggggaccctgatcgttgtgagctct

SEQ ID NO: 41785 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgaaggtctcctgctggacctctgaagacatcttcgatacaacggagctcatttactgggttagacaggcccctggacagggcctggaatggatcgggtgggtgaaaattgtgagcggaaccgtcaactttgcgtcccttgacttccggaatcgcatctctctgagcagagatcgggacctctccacagcttatatggatattcgcggcctgacccaggacgatacagccacctacttttgtgccagacaaaagttcgctagccggtattctggggaccagggatcctactttgatctttggggccgcggcacactgatcgtggttagctct

SEQ ID NO: 41786 - RNA, 387 nt, synthetic construct
  misc_feature 1..387: note = derived and/or modified sequence opt5 from anti-HIV-1_HeavyChain
  source 1..387: mol_type = other RNA
cagagccacctggagcaagtgtgggtctgccagtccaagaaacccggcgcctctgttagagtgagctgttggacctccgaagacatcttcgatacaacggagctcatttactgggtgcggcaggctcctgggcagggactggaatggatcggctgggtcaagattgtgtctgggaccgttaactttgccagccttgacttccgcaatagaatctccctgtctcgggatcgcgacctcagcacagcgcatatggatattagaggactgacccaagacgatacagctacctatttttgcgcccggcagaaattcgcctcccgctacagcggcgaccaggggtcttattttgatctttggggaagaggcacactgatcatcgtgtccagc

SEQ ID NO: 41787 - RNA, 384 nt, synthetic construct
  misc_feature 1..384: note = derived and/or modified sequence opt5 from anti-HIV-1_HeavyChain
  source 1..384: mol_type = other RNA
agacacaccgtggagcagagcggctccggggtcaagaaacccggagcctctgttcgggtgagctgctggtcctctgaagacatcttcgagcgcacagaactgattcattgggtgagacaagctcctggccaggggctcgagtggatgggatgggtcaagacggtgaccggcgccgttaactttgggagcctggatttccggcaccgcatctcccttacaagagaccgggatctgtttaccgcgcatatggacattcgcggactcacacagggcgataccgctacatacttctgtgccagacagaaatttgaatctcggtataccggcgggcaaggatggtacttcgacctgtggggccgcgggacgcacatcgtggtcagctcc

SEQ ID NO: 41788 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctctgcccgggaagacatcttcgataccacagagctcatttactgggttcgccaggcgcctggacagggcctggaatggatcgggtgggtgaagattgtgtgtggaacggtcaactttgctagccttgacttcagaaatcggatctccctgtctcgcgatagagacctcagcaccgcccatatggatattcggggcctgacacaggacgataccgccacatatttttgcgctcgccaaaaattcgcctccagatacagcggggaccagggatcttattttgatctttggggccggggcaccctgatcatcgtgtccagc

SEQ ID NO: 41789 - RNA, 387 nt, synthetic construct
  misc_feature 1..387: note = derived and/or modified sequence opt5 from anti-HIV-1_HeavyChain
  source 1..387: mol_type = other RNA
gaggtgcagagaggcgggcgggtcgttggacgcgacgtgaagaaacccggcgccagcgtgagagtctcctgctggacctctgaagatatcttccacacagagctgatttactgggtgcggcaagctcctgggcagggactcgaatggatcggctgggttaagattgtgagcgggacggtcaactttgcctccctggacttccgcaatagaatctctcttagccgggatcgcgacctgtccaccgcgtatatggatattagaggactcacacaggacgataccgctacatacttttgtgcccggcagaaattcgcctctcgctatagcggcgaccaaggctcctactttgatctgtgggggagaggaacccttatcgtggttagctct

SEQ ID NO: 41790 - RNA, 384 nt, synthetic construct
  misc_feature 1..384: note = derived and/or modified sequence opt5 from anti-HIV-1_HeavyChain
  source 1..384: mol_type = other RNA
ggcaccacatggaacgagagcgggtccggagtgaagaaacccggcgcctctgtcagagttccttgctggagctccgaagacatcttcgagcggacggaactgattcaccgcgtgagacaggctccggggcaaggactcgagtggatcggctgggtgaagaccgtcacaggggccgtgaattttggatctcccaacttccggcatcgcattagcctgaccagagatcgggacctttttacagcgcacatggatatccgcggcctgacccagggcgacacagctacctacttctgtgccagacagaaatttgaatcccggtataccgggggacagggctggtacttcgatctctgggggcgcggaacgcatattgttgtgtctagc

SEQ ID NO: 41791 - RNA, 384 nt, synthetic construct
  misc_feature 1..384: note = derived and/or modified sequence opt5 from anti-HIV-1_HeavyChain
  source 1..384: mol_type = other RNA
agaagcaactgggtgcagtccggcgccgacgtcaagaaacccggggcttctgttaagagctcctgctggacctctgaggatatcttcgacacaacggaactgatttactgggtgcggcaagcccctggacagggcctcgagtggatcgggtgggtgaaaattgtcagcggaaccgtgaattttgcgtccctggatttccgcaacagaatctctcttagccgggaccgcgatctgtccacagcttatatggacattagaggcctcacccaggatgacacagccacctacttttgtgcccggcagaagttcgctagccgctattctggggatcaaggatcctactttgacctgtggggcagaggcacacttatcgttgtgagctct

SEQ ID NO: 41792 - RNA, 384 nt, synthetic construct
  misc_feature 1..384: note = derived and/or modified sequence opt5 from anti-HIV-1_HeavyChain
  source 1..384: mol_type = other RNA
cccgtgcagctggtccaaagcggcgccgaggttaagaaacctggggcttccgtgaaggtgtcttgctggaccagcgaagacatcttcgagagaacagaactcattcactgggtccggcaggccccgggacagggcctggagtggatcgggtgggtgaaaacggttaccggagcggtgaactttggctcccttgatttccgccatagaatttctctgacacgggaccgcgatctctttaccgctcacatggacatcagagggctgacacagggagataccgccacatacttctgtgcccggcaaaagtttgaaagccgctataccggcggccaggggtggtacttcgacctttggggaagaggcacgcatattgtcgtgtcctct

SEQ ID NO: 41793 - RNA, 399 nt, synthetic construct
  misc_feature 1..399: note = derived and/or modified sequence opt5 from anti-HIV-1_HeavyChain
  source 1..399: mol_type = other RNA
agagagtacctggaacagagcggcgggggagtgaagaaactcggcgcctccgtccgggtttcttgccgcgctagcgaggacctgttcggggatgaagccatctatgacgatgagcttattcactggctgagacaagtgcccggacagcggcctgaatggatgggctggatccgcccgaagaccggggcgagaaaccaggctcggcagtttcaaccccgcattaatctctccagagaccgggccctgaacacagcctaccttgatctgtctagcctcacgtccgctgactctgccacctatttctgtgctcgccagacatttaaacctgatttctactttgccgaccagggatggagcttcaatctgtggggcagaggcgcgcgggtgatcgtctccagc

SEQ ID NO: 41794 - RNA, 399 nt, synthetic construct
  misc_feature 1..399: note = derived and/or modified sequence opt5 from anti-HIV-1_HeavyChain
  source 1..399: mol_type = other RNA
caggtgcaactggtccagagcggcaccgaggttaagaaacccggggcctccctcagagtgtcttgccgggctagcgaagacctgttcggagataagatcatttacgacgatgaggtgatccactggcttcgccagctgcctggccagagaccggaatggatggggtggattcggcccaaatccggagcccgcaaccaagcgagacagtttcagcctcggatctctctcacacgcgacagagctctgagcacggcctatcttgatctcaattccctgacctctgccgacagcggcacatacttctgtgctcggcagacctttaagcccgatttctattttgccgaccaagggtggtccttcaacctgtggggacgcggcgctcattttattgtcagctct

SEQ ID NO: 41795 - RNA, 399 nt, synthetic construct
  misc_feature 1..399: note = derived and/or modified sequence opt5 from anti-HIV-1_HeavyChain
  source 1..399: mol_type = other RNA
caggcccacctggagcaaagcggctccggggtgaagaaacccggagcttctgtcagagttagctgccgggcctccgaagacctcttcggcgatgagatcatttacgacgatgaagtgatccattggctgcgccaggtgcctgggcagagaccggagtggatgggatggattcggcccaagaccggcgcgcgcaaccaggctagacaatttcagcctcggatctctcttacacgcgacagagccctgagcacggcctatctcgatcttaattccctgacctctgctgacagcgggacatacttctgtgcccggcagacctttaaacccgatttctattttgctgaccagggatggtccttcaacctgtggggccgcggcgcccactttattgtcagctct

SEQ ID NO: 41796 - RNA, 399 nt, synthetic construct
  misc_feature 1..399: note = derived and/or modified sequence opt5 from anti-HIV-1_HeavyChain
  source 1..399: mol_type = other RNA
ggcaacatctggagcgagtccgggggaggcgtgaagaaacccggggcctctgtcagagttagctgccgggcttccgaagacctgttcggagatgagattatctacgacgatgaagtgattcactggctccgccaggtgcctggccaaagaccggagtggatggggtggatccggcccaagaatggaggccgcaaccaggccagacagtttcagcctcggatttctctgacccgcgacagagcgcttaatacagcttatctggatctcaacagcctgacgtccgccgactctggcacctacttctgtgcccggcaaacatttaaacccgatttctattttgctgaccaggggtggagcttcaatctttggggacgcggcgccagagtcatcgtgtccagc

SEQ ID NO: 41797 - RNA, 399 nt, synthetic construct
  misc_feature 1..399: note = derived and/or modified sequence opt5 from anti-HIV-1_HeavyChain
  source 1..399: mol_type = other RNA
caggtgcaactggtccagagcggcgccgaggttaagaaacccggggcttccctcagagtgccttgccgggcctctgaagacctgttcggagatgagatcatttacgacgatgaagtgatccactggcttcgccaggtcccgggccagagacccgagtggatggggtggattcggcctaagaccggagcgcgcaaccaagctagacagtttcagccccggatcagcctgacacgcgacagagccctctccacggcctatctggatcttaattctctgaccagcgctgactccggcacatacttctgtgcccggcagacctttaaacctgatttctattttgctgaccaagggtggtctttcaacctctggggacgcggcgcccattttattgtgagctcc

SEQ ID NO: 41798 - RNA, 390 nt, synthetic construct
  misc_feature 1..390: note = derived and/or modified sequence opt5 from anti-HIV-1_HeavyChain
  source 1..390: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgcctcccgcagcgct

SEQ ID NO: 41799 - RNA, 393 nt, synthetic construct
  misc_feature 1..393: note = derived and/or modified sequence opt5 from anti-HIV-1_HeavyChain
  source 1..393: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacacgctctacc

SEQ ID NO: 41800 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcggcgccgaggttaagaaacccggggcttccgtgaccgtgtcttgcaaggccagcagatacacattcatcaactattacattcactgggtccggcaggcgcctggacagggcctcgaatggatcgggtgggtgaaaccggtttccggagctgtgaattttggctctcccaacttccgccatagagtcagcctgacgcgggaccgcgatctttttaccgcccacatggacattagagggctgacacaaggagataccgccacatatttctgtgctcggcagaagtttgcccgcggcgaccagggctggttctttgatctctgggggagaggaaccctgatcgtggtttcctctgctagcacaaaaggcccttccgtgttcccccatgaccttcgg

SEQ ID NO: 41801 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcggcgccgaggttaagaaacccggggcttccgtgaaggtgtcttgcaaagccagcggatacaccatcacaagacactatatgcattgggtccggcaggcgcctggccaggggctcgaatggattggatgggtgaagacggttaccggcgctgtgaacttcgggtccccgaattttcgccacagagtctctctgacacgggaccgcgatcttttcaccgcccatatggacatcagaggactgacacaaggcgataccgccacatacttttgtgctcggcagaaattcgagcgcggcgggcagggatggtattttgacctctggggcagagggaccctgattgtggttagctccgcctctacgaagggacccagcgtgttccctcacgatcttcgg

SEQ ID NO: 41802 - RNA, 408 nt, synthetic construct
  misc_feature 1..408: note = derived and/or modified sequence opt5 from anti-HIV-1_HeavyChain
  source 1..408: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagcccgaatttccgccacagagtttcccttacccgggatcgcgacctgtttacagctcatatggatattagaggactcacccagggcgacacagccacctacttctgtgcccggcaaaagtattacgctggcgggcagggatggtattttgatctgtggggccgcgggacacttatcgtggtctctagcgcctccaccaaaggacccagcgacgatctgaga

SEQ ID NO: 41803 - RNA, 411 nt, synthetic construct
  misc_feature 1..411: note = derived and/or modified sequence opt5 from anti-HIV-1_HeavyChain
  source 1..411: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgcctccacaaagggacccagcgtctatgacctgcgc

SEQ ID NO: 41804 - RNA, 417 nt, synthetic construct
  misc_feature 1..417: note = derived and/or modified sequence opt5 from anti-HIV-1_HeavyChain
  source 1..417: mol_type = other RNA
caggtgcaactggtccagagcggctccggggttaagaaacccggagcctctgtgagagtgagctgctggacctccgaggacatcttcgaacggacagagctcattcactgggtccgccaggctcctggccaggggctggaatggatcggatgggtgaagacggtttctggcgccgtgaactttgggagcccgaatttcagacatcgggtctcccttacccgcgatagagacctgtttacagcgcacatggatattcggggactcacccaaggcgacacagctacctacttctgtgcccgccagaaatttgagagaggcgggcagggatggtatttcgatctgtggggccgggggacacttatcgtggtttctagcgcctccaccaagggacccagcgtgtttcctcatgacctgcgc

SEQ ID NO: 41805 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagcccgaatttccgccacagagtttcccttacccgggatcgcgacctgtttacagctcatatggatattagaggactcacccagggcgacacagccacctacttctgtgcccggcaaaagtttgaacgcggcgggcagggatggtatttcgatctgtggggcagagggacacttatcgtggtctctagcgcttccaccaaaggacccagcgtgtttcctacgatttacgtt

SEQ ID NO: 41806 - RNA, 417 nt, synthetic construct
  misc_feature 1..417: note = derived and/or modified sequence opt5 from anti-HIV-1_HeavyChain
  source 1..417: mol_type = other RNA
caggtgcaactggagcagagcggctccggggtcaagaaactcggagcctctgttagagtgagctgctggacctccgaagacatcttcgaggatgaactgattcactgggtgcggcaggctcccggccaggggcttgagtggatcggatgggtcaaggccgtgtctggcgcggttaactacgggagcctggactttcgccatagagtgtccctcacacgggatcgcgacctgttcacggctcacatggatattagaggacttacccaagacgatacagccacctatttttgtgcccggcagaaattcgctcgcggcgaccagggctggtttttcgatctgtgggggagaggaacactcatcgtcgtgtctagcggcctgcatcaggggcctattggactgccgccccggctctcccgc

SEQ ID NO: 41807 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgccagcccccgcgctcatagatcctctcctacaatctgcgtc

SEQ ID NO: 41808 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctagcgatttcagacagcgggtttcccttacacgcgacagagatctgtttaccgctcacatggacattcggggactcacacaaggcgataccgccacatacttctgtgcccgccagaaattttatgctggcgggcagggatggtacttcgacctgtggggcagagggacccttatcgtggtctctagcgcctccacgaagggaccgagcgtgtttccccatgatctgcgg

SEQ ID NO: 41809 - RNA, 414 nt, synthetic construct
  misc_feature 1..414: note = derived and/or modified sequence opt5 from anti-HIV-1_HeavyChain
  source 1..414: mol_type = other RNA
caggtgcacctggtccaaagcggcgccgaggttaagagacccggggcttccgtgaaagtgtcttgcaaggccagcggatacaccttcacagactattttatccattgggtccggcaggcgcctggccaggggctcgaatggattggatgggtgaaaacggtttccggcgctgtgaacttcgggtctctgaattttcgccacagagtcagccttacccgggatcgcgacctgttcacagcccatatggatatcagaggactcacccagggcgacacagccacctacttttgtgctcggcaaaagttcgcccgcggcgatcaggggtggtttttcgacctgtggggaagaggcacacttattgtggtttcctctgctagcaccaaagggccgtccgtgtttccccacgatctgcgg

SEQ ID NO: 41810 - RNA, 420 nt, synthetic construct
  misc_feature 1..420: note = derived and/or modified sequence opt5 from anti-HIV-1_HeavyChain
  source 1..420: mol_type = other RNA
caggtgcaactggtccagagcggcgccgaggttaagaaacccggggcttccgtgaaggtgtcttgcaaagccagcggatacatcttcaccggctcctatatgcactgggtcagacaggcgcctgggcagacatttgaatggctcggatggatgaagccggtgacgggcgctgttaactacgcccggcaattccaggggcgcgtgtctttttatagaacccgggagctgggaattgcctacatggaccttcgcgatctgaaattcgacgatacagctgtctatttttgtgccagaaagaccaagggcgacgtgagcggcgatgaccgggggttctttttcgatctctggggacgcggcacaagagttatcgtgtcctctgctagcaccaaagggccctccgtctttcctcatgacctgcgg

SEQ ID NO: 41811 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagcccgaatttccgccacagagtttcccttacccgggatcgcgacctgtttacagctcatatggatattagaggactcacccagggcgacacagccacctacttctgtgcccggcaaaagtttgaacgcggcgggcagggatggtatttcgatctgtggggcagagggacacttatcgtggtctctagcgcttccaccaaaggacccagcgtgtttcctcacgacctgcgg

SEQ ID NO: 41812 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcccgaatttccgccacagagtttcccttacccgggatcgcgacctgtttacagctcatatggatattagaggcctcacccagggcgacacagccacctacttctgtgcccggcaaaaatttgaacgcgggggacagggctggtatttcgatctgtgggggagaggaacacttatcgtggtctctagcgcttccaccaagggccccagcgtgtttcctcacgacctgcgg

SEQ ID NO: 41813 - RNA, 420 nt, synthetic construct
  misc_feature 1..420: note = derived and/or modified sequence opt5 from anti-HIV-1_HeavyChain
  source 1..420: mol_type = other RNA
caggtgcaactggtccagagcggcgccgaggttaagaaacccggggcttccgtgaaggtgtcttgcaaagccagcggatacaccttcacaggctattacatccactgggtcagacaggcgcctgggcagggactcgaatggatgggctggattaaccccaattccggggctacgaactatgcccaaaagtttcagggacggctgaccatcgcccgcgacacatctattagcaccgcttacatggatcttagaaatctgcggttcgacgatacagccgtgtatttttgtgctcgcaaaaccgccggcgacgtttccggcgataacagagggtacttctttgacctctggggacggggctctcgcgtgatcgtcagctccgcgagcacaaaggggccgtctgtgttccctcatgatctgaga

SEQ ID NO: 41814 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttcatgatctgaga

SEQ ID NO: 41815 - RNA, 414 nt, synthetic construct
  misc_feature 1..414: note = derived and/or modified sequence opt5 from anti-HIV-1_HeavyChain
  source 1..414: mol_type = other RNA
caggccaccctggagcaaagcggctccggggtgaagaaacccggagcttctgtcagagttagctgctggtcctctgaagacatcttcaagacagagctcattcactgggtgcggcaggcccctggccaggggctggaatggatcggatgggtgaaagcggtcagcggcgctgtgaactacgggtcccttgattttcgccatagagtttctctgacgcgggaccgcgatctcagcaccgcccacatggacattagaggactgacacaggatgacaccgccacacatttctgtgctcggcaaaagtttgcccgcggcgatcagggctggttctttgacctttgggggagaggaaccctgatcgtggtctccagcgcttctacaaaaggcccgtccgtgttccccaccatttatgtt

SEQ ID NO: 41816 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctctgctagcacgaagggaccctccgtgtttcctaccatttgcgtt

SEQ ID NO: 41817 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggatcttcgatctgtggggccgggggacacttattgctgtgtctagcgccagcccccgcgctcacagatcctctcctcggtccgcc

SEQ ID NO: 41818 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgagcgcggcgggcagggatggatcttcgacctgtggggcagagggacacttattgctgtgagctccgccagcaccaaaggaccgtctgtctttcccacgatctgcgtg

SEQ ID NO: 41819 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggccccggggtgaagaaactcggagcttccgtcagagtttcttgctggaccagcgaagacatcttcgagcggacagaactgattcattgggtgcgccaggcccctggccaggggcttgagtggatcggatgggtgaaggcggtctccggcgctgtgaactacgggtctctggattttagacaccgggttagcctcacgcgcgacagagatctgttcaccgcccatatggacattcggggacttacacaggatgacaccgccatctatttttgtgctcgccaaaaattcgccagaggcgatcagggctggtttttcgacctgtgggggcggggaacactcattgtggtctcctctgctagcaccaaggcccaccgctccagcccgagatctaca

SEQ ID NO: 41820 - RNA, 420 nt, synthetic construct
  misc_feature 1..420: note = derived and/or modified sequence opt5 from anti-HIV-1_HeavyChain
  source 1..420: mol_type = other RNA
caggtgcaactggtccagagcggcgccgagatgaagaaacccggggcttccgttaagctctcttgcatgaccagcggatacgtgttcacagacttttatatccactgggtgagacaggcccctggccaggggctggaatggatgggatggattaacccgggcaccgggggaacgatctccgcgccccggttccttggccgcgtcacactgaccagagatacatctattagcgctgcctacatcgagattaatcgggtgaccatcgacgatacagccacctatttttgtgctcgccaaaaattcgcctccagatactctggcgaccaggggagctattttgatctctggggacggggcacgctgatcgttgtgtccagcgcttctaccaaggggcctcttggactgccccctcgctccgcc

SEQ ID NO: 41821 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacccctgaagacatcttcgagcggacagaactcattcattgggtgcgccaggccccgggccaggggctggagtggatcggatgggtgaagattgtctccggcgcggtgaactttgggtctcccaatttcagacagcgggttagccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtcctctgccagccctcgcgctcatagatccagcccccggtctgcc

SEQ ID NO: 41822 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagccggtcacgggcgcggtgaaccttgctcccaattttagacaccgggtttctctgacccgcgatagagacctcttcacagcccatatggatattcgggggctgacccagggagacacagccacctacttttgtgctcgccaaaaattcgaaagaggcggccaggggtggtattttgatctttggggacggggcacactgatcgtggtcagctccgcctctaccaaggggcctagcgtgttcccccacgacctccgc

SEQ ID NO: 41823 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcagcacggcccatatggacattcggggactgacccaggatgacacagccacctatttctgtgctcgccaaaaatttgccagaggcgatcagggctggttctttgacctttgggggcggggaacactgatcgtggtctccagcgcttctaccaagggcccgtccgtgttcccccacgatctccgc

SEQ ID NO: 41824 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacagcgggtttcccttacccgcgatagagacctgtttacagctcacatggatattcggggactcacccaaggcgacacagccacctacttctgtgcccgccagaaattttatgctggcgggcagggatggtacttcgatctgtggggcagagggacacttatcgtggtctctagcgcctccaccaaggctcatcggagctctccccgctccacg

SEQ ID NO: 41825 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttcccacgatttgcgtt

SEQ ID NO: 41826 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaactcggagcttctgtcagagttagctgctggacctccgaagacatcttcaagacagagctgattcattgggtgcggcaggcccccggccaggggcttgaatggatcggatgggtgaaagcggtctctggcgctgtgaactacgggagcctggattttcgccacagagtttccctcacgcgggaccgcgatctgtctaccgcccatatggacattagaggacttacacaggatgacaccgccacatatttctgtgctcggcaaaagtttgcccgcggcgatcagggctggttctttgacctgtgggggagaggaaccctcatcgtggtcagctccgctagcacaaaaggcccttctgtgttcccgcacgatctgcgg

SEQ ID NO: 41827 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttcccacgatttatgtt

SEQ ID NO: 41828 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgccagaggcgatcaggggtggttctttgacctgtggggacggggcacgcttatcgtggtctcctctgctagcaccaaggggccctccgtgttccctacaatttgcgtt

SEQ ID NO: 41829 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttccccagatttatgtt

SEQ ID NO: 41830 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcagacacctggccaggggctggagtggatcggatgggtgaaaacggtcaccggcgccgtgaactttgggagctccgatttccgccagagagtttctcttacacgggaccgcgatctgtttaccgcgcacatggacattagaggactcacacaaggcgataccgctacatacttctgtgcccggcagaagttttatgccggcgggcagggatggtacttcgacctgtggggccgcgggacccttatcgtggtcagctccgctagcacgaaaggaccgtctgtgtttcccaccatttatgtt

SEQ ID NO: 41831 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatgggaatccggggcctcacacaaggcgataccgccacatacttctgtgcccgccagaaatttgaaagagggggacagggctggattttcgacctgtgggggcggggaacccttatcgctgtgtctagcgcctccacaaagggccccagcgtctttcctaccatctatgtg

SEQ ID NO: 41832 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgtgtttccgcacgatctgcgc

SEQ ID NO: 41833 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggatcttcgatctgtggggccgggggacccttattgctgtgtcctctgccagcacgaagggaccctccgtctttcctcgcagcgctgtg

SEQ ID NO: 41834 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatggatgaagattgtgtctggcgcggtcaactttgggagcccgaatttcagacagcgggtgtcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtttctagcgcctccacaaagggacccagcgtgtttcctcatgacctgcgc

SEQ ID NO: 41835 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatctctgagggcagcgaactcattcattgggtgcggcaggcccctgggcagggactggagtggatcggctgggtgaagacagtcacgggggcggtgaacttcggatccgcttactttcgccacagagtttctcttacccgggatcgcgacctgttcacagcccatatggatattagaggcctcacccagggcgacacagccacctatttttgtgctcggcaaaaattctacaaagggggacagggctggtattttgatctgtgggggcgcggaacacttatcgtggtcagctccgccagcaccaagggcccgtctgtgttccccacgatttgcgtt

SEQ ID NO: 41836 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttgattttagacaccgggttagcctgacacgcgacagagatctctccaccgctcatatggacattcggggactgacacaggatgacaccgccacatatttctgtgcccgccaaaaatttgctagaggcgatcagggctggttctttgacctttgggggcggggaaccctgatcgtggtctctagcgcctccacgaagggcccgagcgtgttcccccacgatctccgc

SEQ ID NO: 41837 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagattgtcagcggcgcggtgaactttgggtccccgaatttcagacagcgggtttctcttacacgcgatagagacctgtttacggctcacatggatatccggggactcacccaaggcgacacagccacctacttctgtgcccgccagaaatttgaaagaggcgggcagggatggattttcgatctgtggggccgggggacacttatcgctgtgagctccgccagcaccaagggaccctctgtctttcctacaatctatgtg

SEQ ID NO: 41838 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtctctggcgcggtgaactttgggagccttaatttcagacaccgggtttccctgacacgcgatagagacctctttaccgctcatatggatattcggggactgacacagggcgacaccgccacatacttctgtgcccgccaaaagtttgctagaggcgatcaggggtggttctttgacctttggggacggggcaccctgatcgtggtctctagcgcctccacgaaagggccgagcgtgttccccaccatttgcgtt

SEQ ID NO: 41839 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaaccttgggtctccgaattttagacaccgggttagcctgacacgcgatagagacctcttcaccgctcatatggatattcggggactgacacagggcgacaccgccacatacttttgtgcccgccaaaaattcgaaagaggcgggcagggatggtattttgatctttggggccgggggaccctgatcgtggtctcctctgctagcacgaagggaccctccgtgttccctcacgacctccgc

SEQ ID NO: 41840 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagaggcggccaggggtggatcttcgatctgtggggacggggcaccctcattgccgtgagctccgctagcacaaaggggccttctgtctttccgaccatctgcgtg

SEQ ID NO: 41841 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctctgctagcacgaagggaccctccgtgtttcctcacgacctggtt

SEQ ID NO: 41842 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcttcacggcccatatggacattcggggactgacccaggatgacacagccacctatttttgtgctcgccaaaaattcgccagaggcgatcagggctggtttttcgacctttgggggcggggaacactgatcgtggtcagctccgctagcaccaagggcccgtctgtgtttcccacaatttacgtt

SEQ ID NO: 41843 - RNA, 420 nt, synthetic construct
  misc_feature 1..420: note = derived and/or modified sequence opt5 from anti-HIV-1_HeavyChain
  source 1..420: mol_type = other RNA
caggtgcacctcgagcaaagcggctccggggtcaagaaacccggagcccctgttagagtgtcttgctggagctccgaagacatcttcgagcggaccgaactcattcattgggtgcgccaggctccgggccaggggctggagtggatcggatgggtcaagacagtgacgggcgccgttaactttgggtctcttgatttcagacaccggattagcctgacccgcgacagagatctctttacagcgcatatggacatccggggactgacccagggcgatacagctacctacttctgtgcccgccaaaaattttatgccggcgggcagggatggtacttcgacctttggggcagagggacactgattgtggtctcctctgctagcaccaaggcccactccgtgctgccccctcggagccgcgtt

SEQ ID NO: 41844 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagctctcgtcagagtttcttgctggaccagcgaagacatcttcgagaagtccgaactgattcattgggtgcggcaggcccctggccaggggcttgagtggatcggatgggtgaaaacagtcacgggcgcggtgaactttgggtctagcgatttccgccagagagtttccctgacccgggaccgcgatctctttacagctcacatggacattagaggactgacccaaggcgatacagccacctacttctgtgcccggcagaagttttatgctggcgggcagggatggtacttcgacctttggggccgcgggacactgatcgtggtctctagcgcctccaccaaaggaccgagcgtgtttccccatgatctcaga

SEQ ID NO: 41845 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcggcgccgaggttaagaaacccggggcttccgtgaaggtgtcttgccaggtcagcggatacaccctcacagaactgtccatgcactgggtgagacaggcccctggccaagggcttgagtggatcggatgggttaaaacggtgaccggcgcggtcaacttcgggtctccgaattttcggcatcgcgtgagcctgacaagagaccgggatctcttcaccgctcacatggacattcgcggactgacacagggcgataccgccacatatttttgtgccagacagaagttcgaacggggcgggcagggatggtactttgacctttggggccgcgggaccctgatcgttgtgtcctctgctagcacgaaaggaccctccgtcttccctcatgatctcaga

SEQ ID NO: 41846 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcaagacagagctcattcattgggtgcggcaggcccctggccaggggctggaatggatcggatgggtgaaaattgtctctggcgcggtgaactttgggagcccgaatttccgccagagagtttcccttacgcgggatcgcgacctgtttaccgctcacatggatatcagaggactcacacaaggcgacaccgccacatacttctgtgcccggcagaagtttgagcgcggcgggcagggatggattttcgatctgtggggcagagggacccttatcgctgtgtctagcgcctccacaaaaggacccagcgtctttcctcatgacctgcgg

SEQ ID NO: 41847 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgtgtttccgaccatttgcgtt

SEQ ID NO: 41848 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtgggtgggatgggtcaaaacagtgacgggcgcggttaactttgggagctccgatttccgccagagagtgtctcttacccgggaccgcgatctgtttacagctcacatggacatcagaggactcacccaaggcgatacagccacctacttctgtgcccggcagaagttttatgctggcgggcagggatggtacttcgacctgtggggccgcgggacacttattgtcgtgagctccgccagcaccaaaggaccgtctgtttttccccatgatctgaga

SEQ ID NO: 41849 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaacgcggcgggcagggatggtatttcgacctgtggggcagagggacacttatcgtggtcagctccgctagcaccaaaggaccgtctgtgtttcccacgatttgcgtt

SEQ ID NO: 41850 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgttcccgcagatttgcgtt

SEQ ID NO: 41851 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggcaccagattagcgatcgcgtttcccttaccccggacagagatctgttcacagctcatatggacatccggggactcacccaaggcgatacagccacctacttttgtgcccgccagaagttctatgctggcgggcagggatggtactttgacctgtggggcagagggacacttattgtggtctctagcgcctccaccaaaggacccagcgtgttccctacgatctgcgtt

SEQ ID NO: 41852 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcgcgcccctggccaggggctggagtggatcggatgggtgaaaacagtcacgggcgcggtgaactttgggagctccgatttcagacagcgggtttctcttacccgcgacagagatctgtttacagctcacatggacattcggggactcacccagggcgatacagccacctacttctgtgcccgccaaaagttttatgctggcgggcagggatggtacttcgacctgtggggcagagggacacttatcgtggtcagctccgccagcaccaaagctcatcggtcttccccgacgatttgcgtg

SEQ ID NO: 41853 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgctcctacaaagggcccgtccgtgtttcccaccatttgcgtt

SEQ ID NO: 41854 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctagcgatttcagacagcgggtttcccttacacgcgacagagatctgtttaccgctcacatggacattcggggactcacacaaggcgataccgccacatacttctgtgcccgccagaaattttatgctggcgggcagggatggtacttcgacctgtggggcagagggacccttatcgtggtctctagcgcctccacgaagggaccgagcgtgtttccccagatttatgtt

SEQ ID NO: 41855 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccggggacgcgacctgtttacagctcacatggatattagaggcctcacccaaggcgacacagccacctacttctgtgcccggcagaagttttatgctgggggacagggctggtacttcgatctgtgggggcgcggaacacttatcgtggtcagctccgccagcaccaaaggcccgtctgtgtttcccacgatttgcgtt

SEQ ID NO: 41856 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtccaccgctcatatggatattcggggactcacacaggacgataccgccacatacttttgtgcccgccaaaaattcgctagaggcgaccagggctggtttttcgatctgtgggggcggggaacccttatcgtggtctctagcgcctccacgaagggccccagcgtgtttcctcacgaccatgtt

SEQ ID NO: 41857 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaattttatgctggcgggcagggatggtacttcgatctgtggggcagagggacccttatcgtggtctcctctgccagcacgaagggaccctccgtgtttcctcagatttgcgtt

SEQ ID NO: 41858 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgtggtctctagcgcttccacaaagggacccagcgtgtttcctaccatctgcgtt

SEQ ID NO: 41859 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctgggcctccgaagacatcttcgagcggaccgaactcattcattgggtgcgccaggcgcctggccaggggctggagtggatcggatgggtgaagacagtcacgggcgctgtgaactttgggtctccgaatttcagacaccgggttagccttacccgcgatagagacctgtttacagcccatatggatattcggggactcacccagggcgacacagccacctacttctgtgctcgccaaaaattttatgccggcgggcagggatggtacttcgatctgtggggcagagggacacttatcgtggtctcctctgctagcaccaagggaccctccgtgtttcctcacgacctgctc

SEQ ID NO: 41860 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaacgcggcgggcagggatggatcttcgacctgtggggcagagggacacttattgctgtgagctccgccagcaccaaaggaccgtctgtctttccccatgatctgcgg

SEQ ID NO: 41861 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactacgggagccttgattttagacaccgggtttccctgacgcgcgacagagatctctctaccgcccatatggacattcggggactgacacaggatgacaccgccacatatttctgtgctcgccaaaaatttgccagaggcgatcagggctggttctttgacctttgggggcggggaaccctgatcgtggtcagctccgctagcacaaagggcccgtctgtgttcccccacgatctccgc

SEQ ID NO: 41862 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatattacgctggcgggcagggatggtattttgatctgtggggcagagggacacttatcgtggtctctagcgcctccaccaagggacccagcgtgttccctacgatttgccgg

SEQ ID NO: 41863 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaacgcggcgggcagggatggtatttcgacctgtggggcagagggacacttatcgtggtcagctccgctagcaccaaaggaccgtctgtgtttccccatgatctgcgg

SEQ ID NO: 41864 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgtgtttccgaccatttacgtt

SEQ ID NO: 41865 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttataaaggcgggcagggatggtacttcgacctgtggggccgcgggacacttatcgtggtcagctccgctagcaccaagggaccgtctgtgtttccccatgatctgaga

SEQ ID NO: 41866 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaagacgatacagctacctacttctgtgcccgccagaaatttgccagaggcgaccagggctggttctttgatctttgggggcggggaacgctgatcgtggtctcctctgctagcaccaagggcccgtccgtgttcccccatgacctccgc

SEQ ID NO: 41867 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggccttccgaagacatcttcgagaagtctgaactcattcattgggtgcggcaggccccgggccaggggctggagtggatcggatgggtgaaaaccgtcacaggcgcggtgaactttgggagctccgatttccgccagagagtttctcttacgcgggaccgcgatctgtttaccgctcacatggacattagaggactcacacaaggcgataccgccacatacttctgtgcccggcagaagtttgaacgcggcgggcagggatggatcttcgacctgtggggcagagggacccttattgctgtgagctccgccagcacaaaaggaccctctgtctttcctcatgatctgcgg

SEQ ID NO: 41868 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtctctggcgcggtgaactttgggagccttaatttcagacaccgggtttccctgacacgcgatagagacctctttaccgctcatatggatattcggggactgacacagggcgacaccgccacatacttctgtgcccgccaaaagtttgctagaggcgatcaggggtggttctttgacctttggggacggggcaccctgatcgtggtctctagcgcctccacgaaagggccgagcgtgttcccccacgatctccgc

SEQ ID NO: 41869 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtggaaaagcccggagcttctgtcagagttagctgctggacctccgaggacatcttcgaacggtctgagctcattcattgggtgcgccaggcccctggccaggggctggaatggatcggatgggtgaaaacagtcacgggcgcggtgaactttgggagcccgaatttcagacaccgggtttcccttacccgcgatagagacctgtttacagctcatatggatattcggggactcacccagggcgacacagccacctacttctgtgcccgccaaaagtattacgctggcgggcagggatggtattttgatctgtggggcagagggacacttatcgtggtctctagcgcctccaccaaaggacccagcgtgttccctcacgacctgcgg

SEQ ID NO: 41870 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgcctccacaaagggacccagcgtctttcctcatgacctgcgc

SEQ ID NO: 41871 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagaaacctgtttaccgctcatatggacattcggggactcacacagggcgataccgccacatacttctgtgcccgccaaaaatttgaaagaggcgggcagggatggtatttcgacctgtggggccgggggacccttatcgtggtctcctctgctagcacgaagggaccctccgtgtttcctcacgatctgcgc

SEQ ID NO: 41872 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaattttatgctggcgggcagggatggtacttcgatctgtggggcagagggacccttattgtggtctctagcgcctccacaaagggacccagcgtgtttcctcatgacctgcgg

SEQ ID NO: 41873 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttaattttagaagccggatttccctgacacgcgatagagacctcttcaccgctcacatggatatccggggactgacacagggcgacaccgccacatatttttgtgcccgccaaaaattcgaaagaggcgggcagggatggatttttgatctttggggccgggggaccctgatcgctgtttctagcgcctccacgaagggaccgagcgtgttcccccatgacctccgc

SEQ ID NO: 41874 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccagggggacacagccacctatttttgtgcccggcaaaaattctacgctggaggccagggctggtattttgatctttgggggcgcggaacactgatcgtggttagctctgcctccaccaagggcccgagcgtgttcccccacgacctcaga

SEQ ID NO: 41875 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggattgaactcatccattgggtgcgccaggcccctggccaggggctggagtggattggatgggtgaagacagtcacgggcgcggtgaactttgggtctccgaatttcagacaccgggttagccttacccgcgatagagacctgtttacagctcatatggatatccggggactcacccagggcgacacagccacctacttctgtgcccgccaaaaatttgaaagaggcgggcagggatggtatttcgatctgtggggccgggggacacttattgtggtctcctctgctagcaccaagggaccctccgtgtttcctcacgacctgcgc

SEQ ID NO: 41876 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacagcgggtttccctcacgcgcgacagagatctgttcaccgcccacatggacattcggggacttacacaaggcgataccgccacatatttttgtgctcgccagaaattctacgccggcgggcagggatggtattttgacctgtggggcagagggaccctcatcgtggtctctagcgcttccacaaagggacctagcgtgttcccgcatgatctgcgg

SEQ ID NO: 41877 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcgggccgaactcattcattgggtgcgccaggcgcctggccaggggctggagtggatcggatgggtgaagaccgtcacaggcgctgtgaactttgggagcccgaatttcagacagcgggtttcccttacgcgcgatagagacctgtttaccgcccacatggatattcggggactcacacaaggcgacaccgccacatacttctgtgctcgccagaaatttgaaagaggcgggcagggatggatcttcgatctgtggggccgggggacccttattgccgtgtctagcgcttccacaaagggacccagcgtctttcctcatgacctgcgc

SEQ ID NO: 41878 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaaggcggtctctggcgctgtgaactacgggagccttgattttagacaccgggtttccctgacgcgcgacagagatctcttcaccgcccatatggacattcggggactgacacaggatgacaccgccacatatttttgtgctcgccaaaaattcgccagaggcgatcagggctggtttttcgacctttgggggcggggaaccctgatcgtggtctctagcgcttccacaaagggcccgagcgtgtttccccacgatctccgc

SEQ ID NO: 41879 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgagcgcgggggacagggctggtactttgacctttggggcagagggacactgatcgtggttagctctgcttccaccaagggaccgagcgtgttcccccacgatctccgg

SEQ ID NO: 41880 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaattttatgctggcgggcagggatggtacttcgacctttggggcagagggacactgattgttgtgtctagcgcctccaccaagggaccgagcgtctttccccacgatctccgg

SEQ ID NO: 41881 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaagatgacacagccatctacttctgtgcccggcagaagtttgctcgcggcgatcagggctggttctttgacctgtgggggagaggaacccttattgtggtcagctccgccagcacaaaaggcccgtctgtgttcccccatgatctgcgg

SEQ ID NO: 41882 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagggacccggcgcttctgtcagagttagctgctggacctccgaagacatcttcgagacaacggaactcattcattgggtgcggcaggcccctgggcagggactggagtggatcggctgggtgaaaaccgtctctggggcggtgaactttggaagccttaatttccgccacagagtttccctgacacgggatcgcgacctctttaccgctcatatggatattagaggcctgacacagggcgacaccgccacatacttctgtgcccggcaaaagtttgctcgcggggatcagggatggttctttgacctttggggcagagggaccctgatcgtggtctctagcgcctccacgaaaggaccgagcgtgttcccccacgatctccgg

SEQ ID NO: 41883 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagttccgcttacccgggatcgcgacctgtttacagcccatatggatattagaggcctcacccagggcgacacagccacctatttctgtgctcggcaaaaattttacaaagggggacagggctggtatttcgatctgtgggggcgcggaacacttatcgtggtctcctctgccagcaccaagggcccctccgtgtttcctcacgacctgaga

SEQ ID NO: 41884 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctctgctagcacgaagggaccctccgtgtttcctcacgacctgcgc

SEQ ID NO: 41885 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaaggcggtgtctggcgctgttaactacgggagccttgattttagacaccgggtgtccctgacgcgcgacagagatctcttcaccgcccatatggacattcggggactgacacagggcgataccgccacatatttttgtgctcgccaaaaattctacgccggcgggcagggatggtattttgacctttggggcagagggaccctgatcgtcgtgtctagcgcttccacaaagggacctagcgttttcccgcacgatctccgg

SEQ ID NO: 41886 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacaggacgataccgccacatacttctgtgcccgccaaaaatttgctagaggcgaccagggctggttctttgatctgtgggggcggggaacccttatcgtggtctcctctgccagcacgaagggcccctccgtgttccctcacgacctgcgc

SEQ ID NO: 41887 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgcccggggagatcaaggctggtttttcgacctgtggggccgcgggacccttattgtggttagctctgcttccacgaagggaccgagcgtgtttccccacgatctgaga

SEQ ID NO: 41888 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcgaatccggcgtgaagaaactcggggcttctgtcagagttagctgctggacctccgaggacatcttcgaacggacagagctgattcattgggtgcgccaggcccccggacagggccttgaatggatcgggtgggtgaaggcggtctctggagctgtgaactacggcagcctggattttagacaccgggtttccctcacgcgcgacagagatctgttcaccgcccatatggacattcgggggcttacacaggatgacaccgccacatatttttgtgctcgccaaaaattcgccagaggagatcagggctggtttttcgacctgtggggccgggggaccctcatcgtggtctctagcgcttccacaaagggacctagcgtgtttccgcacgatctgcgc

SEQ ID NO: 41889 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttcccacgaccctgaga

SEQ ID NO: 41890 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaagacggtgaccggcgcggttaactttgggtctagcgatttcagacagcgggtgtcccttacacgcgacagagatctgtttaccgctcacatggacattcggggactcacacaaggcgataccgccacatacttctgtgcccgccagaaattttatgctggcgggcagggatggtacttcgacctgtggggcagagggacccttatcgtcgtgtctagcgcctccacgaagggacctagcgtttttccgcatgatctgcgg

SEQ ID NO: 41891 - RNA, 420 nt, synthetic construct
  misc_feature 1..420: note = derived and/or modified sequence opt5 from anti-HIV-1_HeavyChain
  source 1..420: mol_type = other RNA
caggccagacccggcgctaaccgggggagcggagtgaagaaacctggcgcctccgtccgcgtttcttgctggaccagcgaggacatcttcgaaagaacagagctgattcactgggtgcggcaagcgccggggcagggactcgaatggatcggctgggtgaagattgtctccggggctgtgaattttggatctcccaacttccgccagagagttagcctgacgcgggatcgcgacctttttaccgcccatatggatatcagaggcctgacacagggcgacaccgccacatacttctgtgctcggcaaaaatttgagcgcgggggacagggctggattttcgatctctgggggagaggaaccctgatcgccgtgtcctctgctagcacaaagggcccttccgtctttccccacgaccttcgg

SEQ ID NO: 41892 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatattacgctggcgggcagggatggtattttgatctgtggggcagagggacacttatcgtggtctctagcgcctccaccaagggacccagcgtgttccctcacgacctgcgg

SEQ ID NO: 41893 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaattttacaaagggggacagggctggtatttcgatctgtgggggcgcggaacacttatcgtggtctctagcgcctccaccaagggcccgagcgtgtttccccacgacctgaga

SEQ ID NO: 41894 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgctgccgccccgctccgcc

SEQ ID NO: 41895 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccgggatgaagaaacccggagcttctgtgagagtcagctgctggtcctctgaagacatcttcgagcggaccgaactcattcattgggttcgccaggcccctggccaggggctggagtggatcggatgggtgaagacagtgacgggcgcggtcaactttgggagctccgatttcagacagcgggtgtctcttacccgcgacagagatctgtttacagctcacatggacattcggggactcacccaaggcgatacagccacctacttctgtgcccgccagaaattttatgctggcgggcagggatggtacttcgacctgtggggcagagggacacttatcgttgtgagctccgccagcaccaagggaccgtctgtctttccccatgatctgcgg

SEQ ID NO: 41896 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaaggaacccggaacctctgtcagagttagctgctggacatccgaggacatcttcgaacggacggagctcattcattgggtgcgccaggctcctggccaggggctggaatggatcggatgggtgaaaaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaagtttgagagaggcgggcagggatggatcttcgatctgtggggccgggggacgcttattgccgtgtcctctgctagcaccaaaggaccctccgtctttcctcagacactgcgc

SEQ ID NO: 41897 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgccatagagtgtctctgacacgggatcgcgacctcagcaccgctcacatggatatcagaggcctgacacaggacgataccgccacatatttttgtgcccggcaaaaattcgctcgcggggaccagggatggtttttcgatctttggggcagaggcaccctgattgttgtgtccagcgcctctacgaaggggccgtccgtctttccccatgacctccgg

SEQ ID NO: 41898 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagacaacggaactcattcattgggtgcggcaggcccctggccaggggctggagtggatcggatgggtgaagaccgtctctggcgcggtgaactttgggagccttaatttccgccacagagtttccctgacacgggatcgcgacctctttaccgctcatatggatattagaggactgacacagggcgacaccgccacatacttctgtgcccggcaaaaatttgctcgcggcgatcaggggtggttctttgacctttggggaagaggcaccctgatcgtggtctctagcgcctccacgaaggggccgagcgtgttcccccacgatctccgg

SEQ ID NO: 41899 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaagacggtgaccggcgcggttaactttgggtctcctaatttcagacaccgggtgagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtcgtgtcctctgctagcacgaagggaccgtccgtttttccccacgacctgcgc

SEQ ID NO: 41900 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtctccggcgctgtgaactttgggtctccgaatttcagacaccgggttagccttacccgcgatagagacctgtttacagcccatatggatattcggggactcacccagggcgacacagccacctacttctgtgctcgccaaaaatttgaaagaggcgggcagggatggtatttcgatctgtggggccgggggacacttatcgtggtctcctctgccagcaccaagggaccctccgtgtttcctcacgacctgcgc

SEQ ID NO: 41901 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttaattttagaagccggatttccctgacacgcgatagagacctcttcaccgctcacatggatatccggggactgacagaaggcgacaccgccacatatttttgtgcccgccagaaattctacgctggcgggcaaggatggtattttgatctttggggcagagggaccctgattgttgtgtctagcgcctccacgaagggaccgagcgtcttcccccatgacctccgg

SEQ ID NO: 41902 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgcctcgcctccgaagacatcttcgagcggaccgaactgattcattgggtgcgccaggcgcctggccaggggcttgagtggatcggatgggtgaagacagtcacgggcgctgtgaactttgggtctccgaatttcagacaccgggttagcctgacccgcgatagagacctctttacagcccatatggatattcggggactgacccagggcgacacagccacctacttctgtgctcgccaaaaatttgaaagaggcgggcagggatggtatttcgatctttggggccgggggacactgatcgtggtctcctctgccagcaccaagggaccctccgtgtttcctcacgacctccgc

SEQ ID NO: 41903 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaaagaggcgggcagggatggattttcgacctttggggccgggggacactgatcgctgtttctagcgcctccaccaagggaccgagcgtgtttccccacgatctccgc

SEQ ID NO: 41904 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaatttgaaagaggcgggcagggatggtatttcgatctgtggggccgggggacccttatcgtggtctcctctgctagcacgaagggaccctccgtgtttcctcatgacctgcgc

SEQ ID NO: 41905 - RNA, 417 nt, synthetic construct
  misc_feature 1..417: note = derived and/or modified sequence opt5 from anti-HIV-1_HeavyChain
  source 1..417: mol_type = other RNA
caggtgcacctggagcaaagcggctccggggtcaagaaacccggagcctctgttagagtgagctgctggacctccgaagacatcttcgagcggacagaactcattcattgggtgcgccaggctcctggccaggggctggagtggatcggatgggtcaagacggtgaccggcgccgttaactttgggtctccgaatttcagacaccgggtgagccttacacgcgatagagacctgtttaccgcgcatatggatattcggggactcacacagggcgacaccgctacatacttctgtgcccgccaaaaatttgaaagaggcgggcagggatggtatttcgatctgtggggccgggggacccttatcgtcgtgtcctctgccagcacgaagggaccctccgtttttcctcacgacctgcgc

SEQ ID NO: 41906 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacagcgggtttcccttacccgcgatagagacctgtttacagctcacatggatattcggggactcacccaaggcgacacagccacctacctgtgtgcccgccagaaattcgaaagaggcgggcagggatggatctttgatctttggggccgggggacactgattgctgtgtctagcgcctccaccaagggacccagcgtcttccctcatgacctccgc

SEQ ID NO: 41907 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggcatcgcgtgagccttacaagagaccgggatctgtttaccgcgcacatggacattcgcgggctcacacagggagataccgctacatatttctgtgccagacagaaattttacaagggcggccaagggtggtatttcgacctgtggggacggggcacccttatcgttgtgtccagcgcctctacgaaagggccgtccgtctttccccatgatctgcgc

SEQ ID NO: 41908 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttaccccggaccgggatctgtttacagctcacatggacattcgcggactcacccaaggcgatacagccacctacttctgtgccagacagaagttttatgctggcgggcagggatggtacttcgacctgtggggccgggggacacttatcgtggtcagctccgccagcaccaaaggatcttccgtgtttccccatgatctgcgc

SEQ ID NO: 41909 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttaccccggaccgggatctgtttacagctcacatggacattcgcggactcacccaaggcgatacagccacctacttctgtgccagacagaagttttatgctggcgggcagggatggtacttcgacctgtggggccgggggacacttatcgtggtcagctccgccagcaccaaaggaccctctgtgtttcctcatgatctgcgc

SEQ ID NO: 41910 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgttcccgcacgatctgcgc

SEQ ID NO: 41911 - RNA, 417 nt, synthetic construct
  misc_feature 1..417: note = derived and/or modified sequence opt5 from anti-HIV-1_HeavyChain
  source 1..417: mol_type = other RNA
caggtgcacctggagcaaagcggctccggggtcaagaaactcggagcctctgttagagtgagctgctggacctccgaagacatcttcgagcggacagaactgattcattgggtgcgccaggctcccggccaggggcttgagtggatcggatgggtcaaggccgtgtctggcgcggttaactacgggagcctggattttagacaccgggtgtccctcacgcgcgacagagatctgttcaccgctcatatggacattcggggacttacacaggatgacaccgccacatatttttgtgcccgccaaaaattcgctagaggcgatcagggctggtttttcgacctgtgggggcggggaaccctcatcgtcgtgtctagcgcctccacaaagggccctagcgtttttccgcaccgctctacc

SEQ ID NO: 41912 - RNA, 420 nt, synthetic construct
  misc_feature 1..420: note = derived and/or modified sequence opt5 from anti-HIV-1_HeavyChain
  source 1..420: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactggggatggcttacatggatcttcggaacctgcgcttcgacgataccgccgtgtatttttgtgcgagaaaaacagccggagacgtctccggcgataatcggggctacttctttgacctctgggggcgcggatctagagtgatcgttagctccgcttctaccaagggccccagcgtgttcacaatttatgtc

SEQ ID NO: 41913 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgtgtttccgcacgatcccgcc

SEQ ID NO: 41914 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgctgccgccccgctccacc

SEQ ID NO: 41915 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaaggcggtcagcggcgctgtgaactacgggtcccttgattttagacaccgggtttctctgacacgcgacagagatctcttcacggcccatatggacattcggggactgacccaggatgacacagccacctatttttgtgctcgccaaaaattcgccagaggcgatcagggctggtttttcgacctttgggggcggggaacactgatcgtggtcagctccgctagcaccaagggcccgtctgtgtttccccacgatctccgc

SEQ ID NO: 41916 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccgaatggaagaaactcggggcttctgtgagagtcagctgctggacctccgaggacatcttcgaacggacagagctgattcattgggttcgccaggcccccggacagggccttgaatggatcgggtgggtgaaggcggtgtctggagctgtcaactacggcagcctggattttagacaccgggtgtccctcacgcgcgacagagatctgtctaccgcccatatggacattcgggggcttacacaggatgacaccgccacatatttctgtgctcgccaaaaatttgccagaggagatcagggctggttctttgacctgtggggccgggggaccctcatcgttgtgagctccgctagcacaaagggaccttctgtcttcccgcacgatctgcgc

SEQ ID NO: 41917 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccgaagtgaagaaacccggggcttctgtcagagttagctgctggacctccgaggacatcttcgaaaagtctgagctcattcattgggtgcggcaggcccctggacagggcctggaatggatcgggtgggtgaaaacagtcacgggagcggtgaactttggcagctccgatttccgccagagagtttctcttacccgggaccgcgatctgtttacagctcacatggacattagagggctcacccaaggagatacagccacctacttctgtgcccggcagaagttttatgctggcggccaggggtggtacttcgacctgtggggacgcggcacacttatcgtggtcagctccgccagcaccaaagggccgtctgtgtttccccatgatctgaga

SEQ ID NO: 41918 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctcctaatttcagacaccgggttagcctgacacgcgatagagacctctttaccgctcatatggatattcggggactgacacagggcgacaccgccacatacttctgtgcccgccaaaaatttgaaagaggcgggcagggatggtatttcgatctttggggccgggggaccctgatcgtggtctcctctgctagcacgaagggaccgtccgtgtttccccacgacctccgc

SEQ ID NO: 41919 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcctccggaagtctgagctgattcattgggtgcgccaggcccctggccaggggcttgaatggatcggatgggtgaaaacagtcacgggcgcggtgaacttcgggagctccgattttagacagcgggtttctctgacccgcgacagagatctcttcacagctcacatggacattcggggactgacccaaggcgatacagccacctacttttgtgcccgccagaagttctatgctggcgggcagggatggtactttgacctttggggcagagggacactgatcgtggtcagctccgccagcaccaaaggaccgtctgtgttcccccatgatctccgg

SEQ ID NO: 41920 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcgcttccggcgtgaagagacccggggcctctgtccgggttagctgcctcgcgtccgaagacatcttcgagcgctctgaactgatttactgggtgagacaggctcctggacagggccttgagtggatcgggtgggtgaaaattgtcagcggagccgtgaactttggctccccgaatttccggcagcgcgtttctctgaccagagatcgggacctctttacagcccatatggatatccgcgggctgacgcaaggagacaccgctacatatttctgtgccagacagaagtttgaacggggcggccaggggtggattttcgatctttggggacgcggcaccctgatcgctgtgagctccgccagcacaaaagggccctctgtctttcctcacgacctcaga

SEQ ID NO: 41921 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagagacccggagcttctgtccgggttagctgctggacctccgaagacatcttcgagacaacggaactcattcattgggtgcgccaggcccctggccaggggctggagtggatcggatgggtgaaaaccgtcacaggcgcggtgaactttgggtctgcttacttcagacaccgggttagccttacccgcgatagagacctgtttacagcccatatggatattcggggactcacccagggcgacacagccacctatttctgtgctcgccaaaagttttacaaaggcgggcagggatggtatttcgatctgtggggcagagggacgcttatcgtggtctcctctgccagcaccaagggaccgtccgtgtttccccacgacctgcgg

SEQ ID NO: 41922 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcgcttccggcgtgaagagacccggggcctctgtccgggttagctgctggacctccgaagacatcttcgagcgctctgaactcatttactgggtgagacaggcgcctggacagggcctggagtggatcgggtgggtgaaaacagtcagcggagctgtgaactttggctccacggatttccggcatcgcgtttctcttaccagagaccgggatctgtttacagcccacatggacattcgcgggctcacccagggagatacagccacctatttctgtgctagacaaaagtttgaacggggcggccaggggtggtacttcgacctgtggggacgcggcacacttatcgtggtcagctccgccagcaccaaagggccgtctgtgtttccccatgatctgaga

SEQ ID NO: 41923 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgggctgccgccccgctccgcc

SEQ ID NO: 41924 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccagggggacacagccacctatttttgtgcccggcaaaaattcgagcgcggaggccagggctggatctttgatctttgggggagaggaacactgatcgctgtgagctctgcctccaccaagggcccgagcgttttccccctccggtctgct

SEQ ID NO: 41925 - RNA, 423 nt, synthetic construct
  misc_feature 1..423: note = derived and/or modified sequence opt5 from anti-HIV-1_HeavyChain
  source 1..423: mol_type = other RNA
caggtgcaaatggagcaggccggcgctgggatgaagaaacccggagccagcatgaccgtctcctgcaagacagcggacgaagatatcttcgacgctgcctacatgcactgggttagacaggcccctggccagacgtttgagtggctggggtggatgaaaccggtgaccggagctgtgaactatgcccggcaattccagggccgcgcttctttttacagaacacgggaactcgggattgcctatatggatctgcgcgaccttaagttcgatgacaccgcggtctacttttgtgccagaaaaacaaagggagatgtgagcggcgacgatcggggcttctttttcgacctgtgggggcgcggaaccagagttatcgtgtcctctgctagcacaaagggcccctccgtctttcctcatgatctccgg

SEQ ID NO: 41926 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaattttataagggcgggcagggatggtacttcgacctttggggcagagggacactgattgttgtgtctagcgcttccaccaaaggaccgagcgtctttccccagatctgccgg

SEQ ID NO: 41927 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggcgctggggtgaagaaacccggagcctccgtcagagtttcttgctggaccagcgaagacatcttcgagaagtccgaactcattcattgggtgcggcaggcgcctggccaggggctggagtggatcggatgggtgaaaacagtcacgggcgctgtgaaccttgttcaccagatttctgatcgcgtgagcctgaccagagaccgggatctctccacagcccatatggacatccgcgggctgacccaagatgacacagccacctacttttgtgctagacagaagttcgcccggggagatcagggctggtttttcgacctttggggccgcgggacactgattgtcgtgtctagcgcttccaccaaaggaccgagcgtttttccccacgatctcaga

SEQ ID NO: 41928 - RNA, 420 nt, synthetic construct
  misc_feature 1..420: note = derived and/or modified sequence opt5 from anti-HIV-1_HeavyChain
  source 1..420: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgggctgccgccccgcctgtgcgtg

SEQ ID NO: 41929 - RNA, 417 nt, synthetic construct
  misc_feature 1..417: note = derived and/or modified sequence opt5 from anti-HIV-1_HeavyChain
  source 1..417: mol_type = other RNA
caggccagactggagcaaagcggctccggggtgaagaaacccggagcttctgtccgggttagctgctggacctccgaagacatcttcgagggctctgaactcattcactgggtgcgccaggcccctgggcagggactggagtggatcggctgggtgaagacagtcacgggggcggtgaactttggaagcgcttacttcagacatcgggtttcccttacccgcgatagagacctgtttacagcccacatggatattcggggcctcacccagggcgacacagccacctatttctgtgctcgccaaaaatttgccagaggggatcagggatggttctttgacctgtggggccgggggacacttatcgtggtctctagcgcttccaccaagggaccgagcgtgttcccccatgattctgcc

SEQ ID NO: 41930 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcggcgccgaggttaagaaacccgggtcctctgtgaaggtgagctgcaaagtctccggaggcgtgttcacctcttacgctgttacatgggtgagacaggcccctgggcagggactcgaatggatcggctgggtcaaggcggtgagcggggctgttaactatggatccctggactttcggcaccgcgtgtctcttacgagagatcgggacctgttcaccgcccatatggatattcgcggcctcacacaagacgataccgccatctacttttgtgctagacagaaattcgcccggggcgaccaggggtggtttttcgatctgtggggacgcggcacacttattgtcgtgagctccgctagcaccaaggggccgtctgtgtttccccacgacctgaga

SEQ ID NO: 41931 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacagcgggtttcccttacccgcgatagagacctgtttacagctcacatggatattcggggactcacccaaggcgacacagccacctacttctgtgcccgccagaaatttgaaagaggcgggcagggatggatcttcgatctgtggggccgggggacacttattgctgtgtctagcgcctccaccaagggacccagcgtctttcctcatgacctgcgc

SEQ ID NO: 41932 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgaccgtctcctgctggacatctgaagacatcttcgatacgaccgagctcatttactgggttagacaggcccctggacagggcctggaatggatcgggtgggtgaagattgtgagcggaacagtcaactttgcgtcccttgacttccggaatcgcatctctctgagcagagatcgggacctctccaccgctcatatggatattcgcggcctgacacaggacgataccgccacatatttttgtgccagacaaaaattcgctagccggtactctggggaccagggatcctattttgatctttggggccgcggcaccctgatcatcgtgagctctgcctccacgaaggggccgagcgacgatctcaga

SEQ ID NO: 41933 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcggcgccgaggttaagaaacccggggcttccgtgaaggtgtcttgcaaaagctccggatactctttcaccagatttgacatcacatgggtccggcaggcccctggccaggggctcgaatggattggatgggtgaagacggttagcggcgcggtgaacttcgggtccctgaattttcgccacagagtctctcttacccgggatcgcgacctgttcacagctcatatggatatcagaggactcacccaaggcgacacagccacctatttttgtgcccggcagaaattcgctcgcggcgatcaggggtggtttttcgacctgtggggaagaggcacacttattgtggttagctccgccagcaccaaggggccgtctgtgtttccccacgatctgcgg

SEQ ID NO: 41934 - RNA, 420 nt, synthetic construct
  misc_feature 1..420: note = derived and/or modified sequence opt5 from anti-HIV-1_HeavyChain
  source 1..420: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgattggcctgccccctagactctgcgtg

SEQ ID NO: 41935 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtcaccggcgctgtgaactttgggtccccgaatttcagacaccgggtttctcttacacgcgatagagacctgtttaccgcccatatggatattcggggactcacacagggcgacaccgccacatacttctgtgctcgccaaaaatttgaaagaggcgggcagggatggtatttcgatctgtggggccgggggacccttatcgtggtcagctccgcctctacgaagggacccagcgtgtttcctcacgacctgcgc

SEQ ID NO: 41936 - RNA, 420 nt, synthetic construct
  misc_feature 1..420: note = derived and/or modified sequence opt5 from anti-HIV-1_HeavyChain
  source 1..420: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcggggaaccctcatcgtggtctctagcgcttccacaaagggccctagcgggccgtctcccgaaatttgcgtg

SEQ ID NO: 41937 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggcgctggggtgaagagacccggagcctccgtccgggtttcttgctggaccagcgaagacatcttcgagacaacggaactcattcattgggtgcgccaggcgcctggccaggggctggagtggatcggatgggtgaaaaccgtctccggcgctgtgaactttgggtctcttaatttcagacaccgggttagcctgacacgcgatagagacctctttaccgcccatatggatattcggggactgacacagggcgacaccgccacatacttctgtgctcgccaaaagtttgccagaggcgatcaggggtggttctttgacctttggggacggggcaccctgatcgtggtctcctctgctagcacgaaagggccgtccgtgttcccccacgatctccgc

SEQ ID NO: 41938 - RNA, 417 nt, synthetic construct
  misc_feature 1..417: note = derived and/or modified sequence opt5 from anti-HIV-1_HeavyChain
  source 1..417: mol_type = other RNA
agagcccacctggagcagagcggctccggggtgaagaaactcggagcttctgtccgggttagctgctggacctccgaagacatcttcgagcgcacagaactgattcattgggtgagacaagcccccggccaggggcttgagtggatcggatgggtgaaggcggtctctggcgctgccaactacgggagccctaattttcggcagcgcgtgtccctgacgagagatcgggacctcttcaccgcccacatggatattcgcggactgacacagggcgacaccgctacatatttttgtgccagacaaaaattcgaacggggcgggcagggatggatctttgatctttggggccgcgggaccctgattgctgtttctagcgcctccacaaagggaccgagcgtgttcccccatgacctcaga

SEQ ID NO: 41939 - RNA, 417 nt, synthetic construct
  misc_feature 1..417: note = derived and/or modified sequence opt5 from anti-HIV-1_HeavyChain
  source 1..417: mol_type = other RNA
caggtgcacctggagcaaagcggctccggggtcaagaaactcggagcctctgttagagtgagctgctggacctccgaagacatcttcgagcggacagaactgattcattgggtgcgccaggctcccggccaggggcttgagtggatcggatgggtcaaggccgtgtctggcgcggttaactacgggagcctggattttagacaccgggtgtccctcacgcgcgacagagatctgttcaccgctcatatggacattcggggacttacacaggatgacaccgccacatatttttgtgcccgccaaaaattcgctagaggcgatcagggctggtttttcgacctgtgggggcggggaaccctcatcgtcgtgtctagcgcctccacaaagggccctagcgtttttccgcacgatctgcgc

SEQ ID NO: 41940 - RNA, 417 nt, synthetic construct
  misc_feature 1..417: note = derived and/or modified sequence opt5 from anti-HIV-1_HeavyChain
  source 1..417: mol_type = other RNA
agagcccacctggagcagagcggctccggggtgaagaaacccggagcttctgtccgggttagctgctggacctccgaagacatcttcgagcgcacagaactcattcattgggtgagacaagcccctggccaggggctggagtggatcggatgggtgaagattgtctctggcgcggtgaactttgggagcccgaatttccggcagcgcgcttcccttacgagagatcgggacctgtttaccgcccacatggatatccgcggactcacacagggcgacaccgccacatacttctgtgctagacaaaaatttgaacggggcgggcagggatggattttcgatctgtggggccgcgggacccttatcgccgtttctagcgcttccacaaagggacccagcgtgtttcctaccatctatgtc

SEQ ID NO: 41941 - RNA, 414 nt, synthetic construct
  misc_feature 1..414: note = derived and/or modified sequence opt5 from anti-HIV-1_HeavyChain
  source 1..414: mol_type = other RNA
caggtgcaactggtccagagcgaggccgaagttaagaaacccggcgcttccgtgaagatctcttgcgccaccagcgggtacgcgttcacactctattacctgcactgggtgagacaggctcctggacagggccttgagtggattgggtgggtcaaaacggtgaccggagccgttaactttggctccgcctatttccggcatcgcgtgtctctgacaagagaccgggatctctttaccgctcacatggacatccgcgggctgacacaaggagataccgccacatacttctgtgctagacagaagttttataaaggcggccaggggtggtacttcgacctttggggacggggcaccctgattgtcgtgagctccgcctctacgaaggggccgagcgtttttccccatgatctccgc

SEQ ID NO: 41942 - RNA, 420 nt, synthetic construct
  misc_feature 1..420: note = derived and/or modified sequence opt5 from anti-HIV-1_HeavyChain
  source 1..420: mol_type = other RNA
caggcccaccccgagcaaagcggctccggggtgaagaaacctggagcttctgtcagagttagctgctggacctccgaagacatcttcgagcggacagaactgattcattgggtgcgccaggccccgggccaggggctcgagtggatcggatgggtgaagattgtctctggcgcggtgaactttgggagccccaatttcagacagcgggtttccctgacgcgcgatagagacctttttaccgctcacatggatatccggggactgacacaaggcgacaccgccacatacttctgtgcccgccagaaatttgaaagaggcgggcagggatggattttcgatctctggggccgggggaccctgatcgctgtgtctagcgcctccacaaagggacctagcggccttccccctcgcctgtgcgtc

SEQ ID NO: 41943 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagcgcttccaccaagggacccagcgtgtttcctccccgctctacg

SEQ ID NO: 41944 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagagacccggagcttctgtccgggttagctgctggacctccgaagacatcttcgagaaatctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagcgcttccaccaagggacccagcgtgtttcctcacgacctgcgc

SEQ ID NO: 41945 - RNA, 417 nt, synthetic construct
  misc_feature 1..417: note = derived and/or modified sequence opt5 from anti-HIV-1_HeavyChain
  source 1..417: mol_type = other RNA
ggcgcccacctggagcagagcgggtccggagtgaagaaacccggcgcttctgtcagagttagctgctggacctccgaagacatcttcgagaagtctgaactcattcattgggtgcggcaagcccctgggcagggactggagtggatcggctgggtgaaaacagtcacgggggcggtgaactttggaagctccgatttccgccagagagtttctcttacccgggaccgcgatctgtttacagctcacatggacattagaggcctcacccagggcgatacagccacctacttctgtgcccggcaaaagttttatgctgggggacagggctggtacttcgacctgtgggggcgcggaacacttatcgtggtcagctccgccagcaccaaaggcccgtctgtgtttccccatgatctgaga

SEQ ID NO: 41946 - RNA, 417 nt, synthetic construct
  misc_feature 1..417: note = derived and/or modified sequence opt5 from anti-HIV-1_HeavyChain
  source 1..417: mol_type = other RNA
agacacgacctggagcagagcggctccggggtgaagaaacccggagcctctgtccgggttagctgctggacctccgaagatatcttcgagcgcacagaactcattcattgggtgagacaagctcctggccaggggctggagtggatcggatgggtgaagattgtctctggcgccgtgaactttgggagcccgaatttccggcagcgcgtttcccttacgagagaccgggatctgtttaccgcgcacatggacatccgcggactcacacagggcgataccgctacatacttctgtgccagacaaaaatttgaacggggcgggcagggatggattttcgacctgtggggccgcgggacccttatcgccgtgtctagcgcttccacaaagggacccagcgtctttcctcatgatctgaga

SEQ ID NO: 41947 - RNA, 420 nt, synthetic construct
  misc_feature 1..420: note = derived and/or modified sequence opt5 from anti-HIV-1_HeavyChain
  source 1..420: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctgtcaccatctatgtg

SEQ ID NO: 41948 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcccgggacccattggcccttctcccagatccgct

SEQ ID NO: 41949 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcgcttccggcgtgaagagacccggggcctctgtccgggttagctgctggacctccgaagacatcttcgagcgcacagaactcattcattgggtgagacaggcgcctggacagggcctggagtggatcgggtgggtgaaaacggtcaccggagctgtgaactttggctctagcgatttccggcagcgcgtttcccttacaagagaccgggatctgtttaccgcccacatggacattcgcgggctcacacaaggagataccgccacatacttctgtgctagacagaagttttatgccggcggccaggggtggtacttcgacctgtggggacggggcacccttatcgtggtctctagcgcttccacgaaagggccgagcgtgtttccccatgatctgcgc

SEQ ID NO: 41950 - RNA, 417 nt, synthetic construct
  misc_feature 1..417: note = derived and/or modified sequence opt5 from anti-HIV-1_HeavyChain
  source 1..417: mol_type = other RNA
caggtgcaactggtccagagcggcgccgaggttaagaaacccggggcttccgtgagagtgtcttgctggaccagcgaagacatcttcgagaagtccgaactcattcactgggtccggcaggcccctggacagggcctggagtggatcgggtgggtgaaaacagttacgggagcggtgaactttggctctagcgatttccgccaaagagtctcccttacccgggaccgcgatctgtttacagctcatatggacattagagggctcacccagggagatacagccacctacttctgtgcccggcagaagttttatgctggcggccaggggtggtacttcgacctgtggggacgcggcacacttatcgtggtttctagcgcctccaccaaagggccgagcgtgtttcccacgatttatgtc

SEQ ID NO: 41951 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagagaatcggatgggtgaagacggtcaccggcgcggtgaactttgggtctccgaatttccggcaccgcgttagccttacaagagatcgggacctgtttaccgctcatatggatattcgcggactcacacagggcgacaccgccacatacttctgtgccagacaaaaatttgaacggggcgggcagggatggtatttcgatctgtggggccgcgggacccttatcgtggtctcctctgctagcacgaagggaccctccgtgtttcctaccatttgcgtt

SEQ ID NO: 41952 - RNA, 420 nt, synthetic construct
  misc_feature 1..420: note = derived and/or modified sequence opt5 from anti-HIV-1_HeavyChain
  source 1..420: mol_type = other RNA
cagagccacctggagcaatccggctctgccatgaagaaacccggggctagcgtgagagtctcctgctggacctctgaagacatcttcgatacaacggagctcattcattgggttcggcaggcccctggacagggcctggaatggatcgggtgggtgaagaccgtgagcggagcggtcaactttggctcccttaatttccgccacagagtgtctctgacacgggaccgcgatctctttaccgctcatatggacattagagggctgacacagggagataccgccacatacttctgtgcccggcaaaaatttgctcgcggcgaccagggctggttctttgatctttgggggagaggaaccctgatcgttgtgagctccgccagcacgaacggcccgattgggccctctcctaccgacctccgg

SEQ ID NO: 41953 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcagtgggtgcgccaggcccccggccaggggcttgagtggatgggatgggtgaaggcggtctctggcgctgtgaactacgggagcctggattttagacatcgggtttccctcacgcgcgacagagatctgttcaccgcccacatggacatccggggacttacacaagatgacaccgccacatatttttgtgctcgccagaaattcgccagaggcgatcagggctggtttttcgacctgtgggggcggggaaccctcattgtggtctctagcgcttccacaaagggccctagcgtgtttccgcatgatctgcgc

SEQ ID NO: 41954 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaaggcggtgagcggagctgtcaactatggctcccttgactttcgccatagagtgtctctgacccgggatcgcgacctcagcacagcccacatggatattagagggctgacccaggacgatacagccacctacttctgtgctcggcaaaaatttgcccgcggagaccagggctggttctttgatctttggggcagagggacactgatcgttgtgtccagcgcttctaccaagggaccgtccgtcttcccccatgacctccgg

SEQ ID NO: 41955 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgttcccgaccatttacgtt

SEQ ID NO: 41956 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccgggggacccttatcgtggtctcctctgctagcacgaagggaccctccgtgtttcctcacgacccccgc

SEQ ID NO: 41957 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctgggatgaagaaacccggagccagcatgaccgtctcctgcaagacagcggacgaagatatcttcgacgctgcctatatgcactgggttagacaggcccctggccagacgtttgagtggctggggtggatgaaaccggtgaccggagctgtgaactacgcccggcagttccaaggccgcgtctctttttatagaacacgggaactcgggattgcttacatggatctgcgcgaccttaagttcgatgacaccgccgtgtatttttgtgcgagaaaaacaaagggagatgttagcggcgacgatcggggcttctttttcgacctgtgggggcgcggaaccagagtgatcgtctcctctgccagcacaaagggcccctccgtgtttcctcatgatctccgg

SEQ ID NO: 41958 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccgggggcagacgtttgagtggctgggatggatgaaacctgtgaccggcgccgtgaactacgctcgccagttccaagggagagtctctttttatcggacacgcgaactcggaattgcctacatggatctgagagaccttaagttcgatgacaccgctgtgtatttttgtgcccggaaaacaaagggcgatgttagcggcgacgatcgcgggttctttttcgacctgtggggaagaggcacccgggtgatcgtctcctctgcgagcacaaaggggccgtccgtgtttcccaccatttacgtt

SEQ ID NO: 41959 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactggggatggcttacatggatcttcggaacctgcgcttcgacgataccgccgtgtatttttgtgcgagaaaaacagccggagacgtctccggcgataatcggggctacttctttgacctctgggggcgcggatctagagtgatcgttagctccgcttctaccaagggccccagcgtgttccctacaatttatgtc

SEQ ID NO: 41960 - RNA, 423 nt, synthetic construct
  misc_feature 1..423: note = derived and/or modified sequence opt5 from anti-HIV-1_HeavyChain
  source 1..423: mol_type = other RNA
caggtgtacagcggcgccgggagaggaggcgtcaagaaacccggggcttccgttaccctgtcttgcaagacagccgacgaggatgtgttcgacgcggcttatatgcactgggtgcggcaagcccctggacagacgtttgaatggctcggctggatgaaaccggtcaccggggccgtgaactacgctcgcaagttccagggaagagttagcttttatcggacacgcgagctgggcatcgcctacatggatcttagaaatctgcggttcgacgataccgctgtgtatttttgtgcccgcaaaacagcgggcgacgtctccggggataagagaggattctttttcgacctctggggccgggggtctcgcgtgattgttagctccgcctctaccaagggacccagcgtgtttcctacaatctacgtc

SEQ ID NO: 41961 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctctagcgcttttaccaagggaccctccgtgttccctcacgacctgcgc

SEQ ID NO: 41962 - RNA, 414 nt, synthetic construct
  misc_feature 1..414: note = derived and/or modified sequence opt5 from anti-HIV-1_HeavyChain
  source 1..414: mol_type = other RNA
caggtgcaactgggccagagcggggccgagatgaagaaacccggatcctctgtcaaggttagctgcaaggcttccggcgggaccttcagacactctcctatcagctgggtgcggcaggccccgggacagggcctcgaatggattgggtgggtgaaagcggtctccggagctgtgaactacggctctctggactttcgccatagagttagccttacacgggatcgcgacctgtccacggcccacatggatatcagaggcctcacccaagacgatacagccacctatttctgtgctcggcagaaatttgcccgcggggaccagggatggttctttgatctgtggggcagagggacacttattgtggtcagctctgcttccaccaagggacccagcgtgttccctcatgacctgcgg

SEQ ID NO: 41963 - RNA, 417 nt, synthetic construct
  misc_feature 1..417: note = derived and/or modified sequence opt5 from anti-HIV-1_HeavyChain
  source 1..417: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagaccgtgacaggagcggtcaactttggcagcccgaatttccgccatagagtgtcccttacccgggaccgcgatctgtttacagctcacatggacattagagggctcacccagggagatacagccacctatttctgtgcccggcaaaaatttgagcgcggcggccaggggtggtacttcgacctgtggggaagaggcacgcttatcgttgtgtctagcgcttccaccaaggggcccagcgtctttcctcatgatctgcgg

SEQ ID NO: 41964 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactggggatggcttacatggatcttcggaacctgcgcttcgacgataccgccgtgtatttttgtgcgagaaaaacagccggagacgtctccggcgataatcggggctacttctttgacctctgggggcgcggatcttgggtgatcgttagctccgcttctaccaagggccccagcgtgttccctcatgatctgaga

SEQ ID NO: 41965 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccgggtgattgtttctagcgcctccaccaaggggccctctgtgtttcctacaatctgcgtc

SEQ ID NO: 41966 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatatttttgtgctagacagaaattcgcccggggcgatcaaggctggtttttcgacctgtgggggcgcggaaccctcatcgtggtctctagcgcttccacaaagggccctagcgtgtttccgcacgatctgaga

SEQ ID NO: 41967 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccgggtgattgtttctagcgcctccaccaaggggccctctgtgtttcctacaatctacgtc

SEQ ID NO: 41968 - RNA, 423 nt, synthetic construct
  misc_feature 1..423: note = derived and/or modified sequence opt5 from anti-HIV-1_HeavyChain
  source 1..423: mol_type = other RNA
caggtgttcatggagcaagccggcgctgggatgaagaaacccggagccagcatgaccgtctcctgcaagacagcggacgaagatgtttttgacgctgcctacatgcactgggtgagacaggcccctggccagacgttcgagtggctggggtggatgaaaccggtgaccggagctgtcaactatgcccggaagtttcagggccgcgtgtctttctacagaacacgggaactcgggatcgcttatatggatctgcgcaatcttagatttgacgataccgccgtttacttctgtgcgcggaaaacagccggagacgtgagcggcgataagcgcggctttttctttgacctgtgggggagaggatcccgggtcattgtgtctagcgcttccaccaagggcccctctgttttccctcatgatctccgc

SEQ ID NO: 41969 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgaactacgcccggaagttccagggccgcgtttctttttatagaacacgggaactggggatcgcttacatggatcttcgcaatctgagactcgacgataccgccgtgtatttctgtgcgcggaaaacagccggagacgtcagcggcgataagcgcggctttttctttgacctgtgggggagaggatcccgggtgattgtttctagcgcttccaccaagggcccctctgtgttccctcatgatcttcgc

SEQ ID NO: 41970 - RNA, 420 nt, synthetic construct
  misc_feature 1..420: note = derived and/or modified sequence opt5 from anti-HIV-1_HeavyChain
  source 1..420: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtgagctctgcctccacgaaggggccgagcgttttccccaccatc

SEQ ID NO: 41971 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctctagagtgatcgttagctccgcctctaccaaggggcccagcgtgttccctacaatttgcgtc

SEQ ID NO: 41972 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtattacgctggcgggcagggatggtattttgacctgtggggccgcgggacacttatcgtggtcagctccgccagcaccaaaggaccgtctgtgttcccccatgatctgaga

SEQ ID NO: 41973 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctgtctttccccatgatctgcgc

SEQ ID NO: 41974 - RNA, 423 nt, synthetic construct
  misc_feature 1..423: note = derived and/or modified sequence opt5 from anti-HIV-1_HeavyChain
  source 1..423: mol_type = other RNA
caggtgtacatgggcgccgggagaggaggcgtcaagaaacccggggctagcgttaccctgtcctgcaagacagccgacgaggatgtgttcgacgcggcttatatgcactgggtgcggcaagcccctggacagacgtttgaatggctcggctggatgaaaccggtcaccggggccgtgaactacgctcgcaagttccagggaagagtttctttttatcggacacgcgagctgggcatcgcctacatggatcttagaaatctgcggttcgacgataccgctgtgtatttttgtgcccgcaaaacagcgggcgacgtcagcggggataagagaggattctttttcgacctctggggccgggggtcccgcgtgattgtttctagcgcctccaccaagggaccctctgtgtttcctacaatctacgtc

SEQ ID NO: 41975 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcagttccaagggcgcgtctctttttatagaacacgggaactcggaattgcctacatggatctgcgcgaccttaagttcgatgacaccgctgtgtatttttgtgccagaaaaacaaagggcgatgttagcggcgacgatcgggggttctttttcgacctgtggggacgcggcaccagagtgatcgtctcctctgcgagcacaaaggggccctccgtgtttcctaccatttgcgtt

SEQ ID NO: 41976 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcagttccaagggcgcgtctctttttatagaacacgggaactcggaattgcctacatggatctgcgcgaccttaagttcgatgacaccgctgtgtatttttgtgccagaaaaacaaagggcgatgttagcggcgacgatcgggggttctttttcgacctgtggggacgcggcaccagagtgatcgtctcctctgcgagcacaaaggggccctccgtgtttcctcatgatctccgg

SEQ ID NO: 41977 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgaactacgcccggaagttccagggcaaagtttctttttatcgcacaagagaactggggatcgcttacatggatcttcggaatctgcgcttcgacgataccgccgtgtatttttgtgcgagaaagacagccggagacgtcagcggcgataagcggggcttctttttcgacctctgggggcgcggatccagagtgattgtttctagcgcttccaccaaaggcccctctgtgtttcctcatgatctgcgg

SEQ ID NO: 41978 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgaactacgcccggaagttccagtctcgcgttagcttttatggcacaagagaactggggatcgcttacatggatcttcggaatctgcgcttcgacgataccgccgtgtatttttgtgcgagaaaaacagccggagacgtctccggcgataagcggggcttctttttcgacctctgggggcgcggatctagagtgattgttagctccgcttctaccaagggccccagcgtgtttcctcatgatctgcgg

SEQ ID NO: 41979 - RNA, 420 nt, synthetic construct
  misc_feature 1..420: note = derived and/or modified sequence opt5 from anti-HIV-1_HeavyChain
  source 1..420: mol_type = other RNA
cagggccacaccgtggagcaaagcgggtccggagtcaagaaactgggcgcctctgttagagtgagctgctggacatccgaagacatcttcgagacgaccgaactcattcattgggtgcggcaggctcccgggcagggactggagtggatcggctgggtcaagacagtgtctggggccgttaactttggaagccttaatttccgccacagagtgtccctgacccgggatcgcgacctctttacagcgcatatggatattagaggcctgacccagggcgacacagctacctacttctgtgcccggcaaaaatttgcccgcggggatcagggatggttctttgacctttggggcagagggacgctgatcgtcgtgtctagcgcttccaccaagggacctagcgttttcccgcacgatctccgg

SEQ ID NO: 41980 - RNA, 420 nt, synthetic construct
  misc_feature 1..420: note = derived and/or modified sequence opt5 from anti-HIV-1_HeavyChain
  source 1..420: mol_type = other RNA
caggccaccccctggagcaacctgggcagaggggtgaagaaactcggagcttccgtccgggtttcttgctggacaagcgaggacatcttcgaacgcacggagctgattcactgggtgagacaagcccctggccaggggcttgaatggatcggatgggtgaagaccgtcacaggcgcggtgaattttgggtccccgaacttccggcatcgcgtttctctgaccagagatcgggacctctttacagctcacatggatattcgcggactgacccagggcgacacagccacctacttctgtgccagacagaaatttgagcggggcgggcaaggatggtatttcgatctttggggccgcgggacgctgatcgtggtcagctccgcttctaccaagggacccagcgtgtttcctcatgacctcaga

SEQ ID NO: 41981 - RNA, 423 nt, synthetic construct
  misc_feature 1..423: note = derived and/or modified sequence opt5 from anti-HIV-1_HeavyChain
  source 1..423: mol_type = other RNA
caggtgttcatggagcaagccggcgctgggatgaagaaacccggagccagcatgaccgtctcctgcaagacagcggacgaagatgtttttgacgctgcctatatgcactgggtgagacaggcccctggccagacgttcgagtggctggggtggatgaaaccggtgaccggagctgtctcttatgcccggaagtttcagggccgcgtgagcttctacatgacaagagaactcgggatggcttatatggatctgcggaaccttcgctttgacgataccgccgtttacttctgtgcgagaaaaacagccggagacgtgtccggcgataatcggggctactttttcgacctgtgggggcgcggatctagagtcatcgtgagctccgcttctaccaagggccccagcgtttttcctcatgatctccgg

SEQ ID NO: 41982 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaaagcggcgggggagtcaagaaacccggcgcctccgttaccctgtcttgcaagacagctgacgaagatgtgttcgacgccgcgtatatgcactgggtgagacaggctcctgggcagacgtttgagtggctcggatggatgaaaccggtcaccggcgccgtgagctacgcccggaagttccaggggcgcgtttccttttatagaacacgggaactgggaatcgcttacatggatcttcgcaacctgagattcgacgataccgccgtgtatttttgtgctcggaaaacagccggcgacgtctctggcgataagcgcgggttctttttcgacctctggggaagaggcagccgggtgattgtttcctctgcgagcaccaaggggccctccgtgtttcctcatgatctgcgc

SEQ ID NO: 41983 - RNA, 423 nt, synthetic construct
  misc_feature 1..423: note = derived and/or modified sequence opt5 from anti-HIV-1_HeavyChain
  source 1..423: mol_type = other RNA
caggtgtacatggagagaggccgcgggggagtcaagaaacccggcgccagcgttaccctgtcctgcaagacagctgacgaagatgtgttcgacgccgcgtatatgcactgggtgcggcaagctcctgggcagacgtttgagtggctcggatggatgaaaccggtcaccggcgccgtgaactacgccagaaagttccaggggcgggtttctttttatcgcacaagagaactgggaatcgcttacatggatcttcggaatctgcgcttcgacgataccgccgtgtatttttgtgctagaaaaacagccggcgacgtcagcggcgataagcgggggttctttttcgacctctggggacgcggctccagagtgattgtttctagcgcgtccaccaaggggccctctgtgtttcctcatgatctgcgg

SEQ ID NO: 41984 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggcgcttccaggggagagttagcttttatatgacacgggaactgggaatggcctacatggatcttcgcaacctgagattcgacgataccgctgtgtatttttgtgcccggaagacagcgggcgacgtctccggcgataatcgcgggtacttctttgacctctggggaagaggctctcgggtgatcgttagctccgcctctaccaaagggcccagcgtgttccctacaatttgcgtc

SEQ ID NO: 41985 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctctagagtgatcgttagctccgcctctaccaaggggcccagcgtgttccctcatgatctgcgg

SEQ ID NO: 41986 - RNA, 423 nt, synthetic construct
  misc_feature 1..423: note = derived and/or modified sequence opt5 from anti-HIV-1_HeavyChain
  source 1..423: mol_type = other RNA
caggtgttcatggagcaagccggcgggggaatgaagaaacccggcgctagcatgaccgtctcctgcaagacagccgacgaagatatctttgacgcggcttacatgcactgggttagacaggcccctgggcagacgttcgagtggctgggatggatgaaaccggtgaccggcgccgtgaactatgctcggcagtttcaagggcgcgtctctttctacagaacacgggaactcggaattgcctatatggatctgcgcgaccttaagtttgatgacaccgctgtgtacttctgtgccagaaaaacaaagggcgatgttagcggcgacgatcgggggtttttctttgacctgtggggacgcggcaccagagtgatcgtctcctctgcgagcacaaaggggccctccgtgttccctcatgatctccgg

SEQ ID NO: 41987 - RNA, 423 nt, synthetic construct
  misc_feature 1..423: note = derived and/or modified sequence opt5 from anti-HIV-1_HeavyChain
  source 1..423: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgcttccagatattctggcgaccaggggagctacttcgatctttggggacggggcaccctgattgttgtgtccagcgcctctacgaaggggccgtccgtctttccccacgacctc

SEQ ID NO: 41988 - RNA, 423 nt, synthetic construct
  misc_feature 1..423: note = derived and/or modified sequence opt5 from anti-HIV-1_HeavyChain
  source 1..423: mol_type = other RNA
caggtgttcatggagcaagccggcgctgggatgaagaaacccggagccagcatgaccgtctcctgcaagacagcggacgaagatgtttttgacgctgcctacatgcactgggtgagacaggcccctggcccggatctggagtggctcgggtggatgaaacccgtgacgggagctgtcaactatgcccggaagttccagggccgcgtgtctttttacagaacccgggaactggggatcgcttatatggaccttcgcgatctgagattcgacgatacagccgtttacttttgtgcgcggaaaaccgccggagacgtgagcggcgataagcgcggcttctttttcgacctctgggggagaggatcccgggtcattgtgtctagcgcttccacaaaggcccatcgctctagccctaccatctgcgtt

SEQ ID NO: 41989 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccggattagccttacacgcgatagagacctgtttaccgctcatatggatatccggggactcacacagggcgacaccgccacatacttctgtgcccgccaaaaatttgaatccagatataccggcgggcagggatggtacttcgatctgtggggccgggggacgcacattgttgtgtctagcgcttccaccaagggacccagcgtctttcctcatgaccttcgc

SEQ ID NO: 41990 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcaatgacaccgctgtgtatttttgtgccagaaaaacagcgggcgatgtctccggcgacaaccgggggtacttctttgatctctggggacgcggctctagagtgatcgttagctccgcctctaccaaggggcccagcgtgttccctcatgacctgcgg

SEQ ID NO: 41991 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataaccgcgggtacttctttgacctctggggaagaggctcccgggtgattgtttctagcgcctccaccaaggggccctctggactgcctcatgatcttcgc

SEQ ID NO: 41992 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacggcaccgctgtgtatttttgtgcccggaaaacagcgggcgatgtcagcggggacaagcgcggattctttttcgatctctggggcagagggtcccgggtgattgtttctagcgcctccaccaagggaccctctgtgtttcctcatgacctgcgc

SEQ ID NO: 41993 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccgggtgattgtttctagcgcctccaccaaggggccctctgtgtttcctcatgatctgcgc

SEQ ID NO: 41994 - RNA, 423 nt, synthetic construct
  misc_feature 1..423: note = derived and/or modified sequence opt5 from anti-HIV-1_HeavyChain
  source 1..423: mol_type = other RNA
caggtgcaactggtccagagcggcgccgaggttaagaaacccggggcttccctcaaggtgtcttgcaaagccagcggatacaccttcacagactattacatccactgggtgagacaggcgcctggccaggggctggaatggattggatgggtcaagatcgtgtccggcacggttaactttgcttctcttgatttccggaatcgcattagcctgtccagagaccgggatctctctaccgcctatatggacatccgcgggctgacacaagatgacaccgccacatacttttgtgctagacagaaattcgccagccggtattccggagatcagggcagctactttgacctttggggccgcgggaccctgattgtggtctcttccgctagcacaaagggaccgtctgtgttcccccatgatctcaga

SEQ ID NO: 41995 - RNA, 423 nt, synthetic construct
  misc_feature 1..423: note = derived and/or modified sequence opt5 from anti-HIV-1_HeavyChain
  source 1..423: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggaccctgattgttgtgagctccgctagcacgcgcgcccacagatctccgcatgatctccgg

SEQ ID NO: 41996 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacagcgggttagccttacacgcgatagagacctgtttaccgctcacatggatattcggggactcacacaaggcgacaccgccacatacttctgtgcccgccagaaatttgaatccagatataccggcgggcagggatggtacttcgatctgtggggccgggggacgcatatcgtggtctctagcgcttccaccaagggacccagcgtgtttcctcacgaccttcgc

SEQ ID NO: 41997 - RNA, 426 nt, synthetic construct
  misc_feature 1..426: note = derived and/or modified sequence opt5 from anti-HIV-1_HeavyChain
  source 1..426: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagcttatatggatattagaggcctgacccaagacgatacagccacctacttttgtgcccggcagaaattcgctagccgctattccggggaccagggaagctactttgatctttggggcagaggcacactgatcgtcgtgtcttccgccagcaccaaggggccgtctgttttcccccagatctgcgtg

SEQ ID NO: 41998 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtggatgaagacggtgagcggaaccgtgaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtcagctctgcctccacgaaggctcaccgcagctctccgaccacactcaga

SEQ ID NO: 41999 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcgttttcccccggtctgct

SEQ ID NO: 42000 - RNA, 423 nt, synthetic construct
  misc_feature 1..423: note = derived and/or modified sequence opt5 from anti-HIV-1_HeavyChain
  source 1..423: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggcaccagattagcgatcgcgtttccctttctagagaccgggatctgagcaccgcttacatggacatccgcggactcacacaagatgacaccgccacatatttctgtgccagacagaagtttgcttcccggtacagcggcgatcagggctcttatttcgacctgtgggggcgcggaacccttattgtggtctccagcgcctctacaaaaggcccgtccgtgtttccccatgatctgaga

SEQ ID NO: 42001 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccacccgggctcaccgcagctctccgagatccgcc

SEQ ID NO: 42002 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccacagaatttctcttacccgggaccgcgatctgtttacagctcatatggacatcagaggactcacccagggcgatacagccacctacttctgtgcccggcaaaagtttgaaagccgctatacaggcgggcagggatggtacttcgacctgtggggcagagggacccacattgttgtgtccagcgcttctacgaaaggaccgtccgtctttccccatgatcttcgg

SEQ ID NO: 42003 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttggctcctctgacttccgcaatagaatcagccttacacgggatcgcgacctgtccaccgcgcatatggatattagagggctcacacaggacgataccgctacatatttttgtgcccggcaaaaattcgagagcctgtactctgacgatcagggatcctattttgacctttggggccgcggcaccctgatcatcgtgagctctgcctccacgaaggggccgagcgttttccccaccatttacgtg

SEQ ID NO: 42004 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcgtggttagctctgcctccaccaaggggccgagcgtgttcccccatgacctccgg

SEQ ID NO: 42005 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcgttttccccacgatttgc

SEQ ID NO: 42006 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtccaccgctcatatggatattcggggactcacacaggacgataccgccacatacttttgtgcccgccaaaaattcgctagaggcgaccagggctggtttttcgatctgtgggggcggggaacccttatcgtggtctctagcgccctgcaccagggccccattgggctccctccccgctccacg

SEQ ID NO: 42007 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaagttccaggggcgcgtttctttttatagaacacgggaactgggaatcgcctacatggatcttcgcaatctgagattcgacgataccgctgtgtatttttgtgcccggaaaacagcgggcgacgtcagcggcgataagcgcgggttctttttcgacctctggggaagaggctcccgggtgattgtttctagcgcctccaccaaggggccctctgtgctgcctccccgcagcgct

SEQ ID NO: 42008 - RNA, 423 nt, synthetic construct
  misc_feature 1..423: note = derived and/or modified sequence opt5 from anti-HIV-1_HeavyChain
  source 1..423: mol_type = other RNA
caggtgcaactcgtccagagcggcgccgaggttaagaaacccggggcttccgtgaagatctcttgcaaagccagcggatacaccttcattagacacggcatccattggctccgccaggtgcctgggcagcggccggaatggatgggatggattagacccaagacaggcgcgcggaaccaagctcgccagtttcagcctagaatctccctggcccgggaccgcgccctttctacggcttatctggatctcaatagcctgacctccgccgactctgggacatacttctgtgctagacagacctttaaacccgatttctattttgccgaccaaggatggagcttcaacctttggggccggggcgcgcactttattgtctccagcgccctgcatcaggggcctatcggactgccccctcgctctaca

SEQ ID NO: 42009 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggacagggcctggagtggatcgggtgggtgaagattgtgagcggaacggtcaactttgcgtcccttgatttcagaaatcggatctctctgagccgcgacagagatctctccaccgcttatatggacattcggggcctgacacaggatgacaccgccacatacttttgtgcccgccaaaaattcgctagcagatattctggggatcagggatcctactttgacctttggggccggggcaccctgatcgtggttagctctgcctccacaaaggggccgagcgtgttcccccatgatctccgc

SEQ ID NO: 42010 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacctttgtgcccgccaaaaattcgaatccagatataccggcgggcagggatggtactttgacctgtggggccgggggacgcacattgttgtgtctagcgcttccaccaagggaccgagcgtcttccccacaatctgcgtg

SEQ ID NO: 42011 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgatacaacggagctcatttactgggtgcggcaggcccctggccaggggctggaatggatcggatgggtgaagattgtctctggcaccgtgaactttgcgagccttgacttccgcaatagaatctccctgtctcgggatcgcgacctcagcacagcttatatggatattagagggctgacccaggacgatacagccacctacttttgtgcccggcaaaaattcgcttcccgctatagcggagaccagggctcttactttgatctttggggcagagggacactgatcgttgtgtccagcgcctctaccaagggaccgtccgtcttcccccagatctgcgtg

SEQ ID NO: 42012 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgcacattgttgtgtctagcgcttccaccaagggaccgagcgtctttcccacaatctgcgtg

SEQ ID NO: 42013 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagcctgtattccgacgatcagggcagctacttcgacctttgggggcgcggaacactgatcattgtgtcttccgctagcaccaaaggcccgtctgtctttcccacgatctgcgtg

SEQ ID NO: 42014 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaatctagatatacaggcgggcagggatggtacttcgatctgtggggccgggggacccacatcgtggtcagctccgctagcacgaagggaccctctgtgtttcctcatgaccttcgc

SEQ ID NO: 42015 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcgttttccccacgatttgcgtg

SEQ ID NO: 42016 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaagacgatacagctacctacttctgtgcccgccagaaatttgcctccagatattctggcgaccagggcagctacttcgatctttgggggcggggaacgctgatcgtggtctccagcgcttctaccaagggcccgtccgtgtttcccacaatttgcgtt

SEQ ID NO: 42017 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggcaccggagctctccgacgatttgcgtt

SEQ ID NO: 42018 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctgggatgaagaaacccggagccagcatgaccgtctcctgcaagacagcggacgaagatgttttcgacgctgcctatatgcactgggtgagacaggcccctggccagacgtttgagtggctggggtggatgaaaccggtgaccggagctgtcaactacgcccggaagttccagggccgcgtgtctttttatagaacacgggaactcgggatcgcttacatggatctgcgcaatcttagattcgacgataccgccgtttatttttgtgcgcggaaaacagccggagacgtgagcggcgataagcgcggcttctttttcgacctgtgggggagaggatcccgggtcattgtgtctagcgcttccaccaagggcccctctgtttttcctacaatctacgtg

SEQ ID NO: 42019 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacggagctctactgggttcggcaggcccctggacagggcctggaatggattgggtgggtgaagatcgtgagcggaaccgtcaactttgcgtcccttgacttccgcaatagaatttctctgagccgggatcgcgacctctccacagcttatatggatatcagaggcctgacccaggacgatacagccacctacttttgtgcccggcaaaaattcgctagccgctattctggggaccagggatcctactttgatctttggggcagaggcacactgattgtggttagctctgcctccaccaaggggccgagcgtgttcccccatgacctccgg

SEQ ID NO: 42020 - RNA, 423 nt, synthetic construct
  misc_feature 1..423: note = derived and/or modified sequence opt5 from anti-HIV-1_HeavyChain
  source 1..423: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgcgccagttccaaggcagagtgtccttttatcggacacgcgagcttgggatcgcttacatggacctgagagatctcaaattcgacgataccgccgtttatttttgtgcccggaagacaaaaggagacgtgtctggcgatgaccgcggcttctttttcgatctgtgggggagaggaacccgggtcattgtgagctccgctagcacaaagggcccgtctgtttttccccatgaccctgcc

SEQ ID NO: 42021 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagccgctatacaggcgggcagggatggtacttcgacctgtggggcagagggacccatatcgtggtctccagcgcttctacgaaaggaccgtccgtgtttcccaccatttgcgtt

SEQ ID NO: 42022 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacagcgggtttcccttacccgcgatagagacctgtctacagctcacatggatattcggggactcacccaagacgatacagccacctacttttgtgcccgccagaaattcgaaagcctgtattccgacgatcagggcagctactttgacctttggggcagagggacactgatcattgtgtcttccgctagcaccaagggaccctctgtcttccctacgatctgcgtg

SEQ ID NO: 42023 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcgcttccggcgtgaagagacccggggcctctgtccgggttagctgctggacctccgaagacatcttcgagcgcacagaactcatttactgggtgagacaggcgcctggacagggcctggagtggatcgggtgggtgaaaacggtctctggagctgtgaactttggcagccaggatttccgggaccgcttttcccttaccagagatcgggacctgttcacagcccatatggatattcgcgggctcacccaaggagacacagccacctatttttgtgctagacagaagttcgcctctcggtacagcggcgatcagggctcctattttgacctgtgggggcgcggaacacttatcgttgtgagctctgcttccaccaaaggcccgagcgtcttccccacgatttgcgtg

SEQ ID NO: 42024 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgaatctagatacaccggcggccaggggtggtattttgatctgtggggacggggcacacacatcgtggtcagctccgccagcaccaaggggccttctgtgttcccgacgatttgcgtt

SEQ ID NO: 42025 - RNA, 423 nt, synthetic construct
  misc_feature 1..423: note = derived and/or modified sequence opt5 from anti-HIV-1_HeavyChain
  source 1..423: mol_type = other RNA
caggtgcacatggagcaagccggcgggggaatgaagaaacccggcgctagcatgaccgtctcctgcaagacagccgacgaagatatcttcgacgcggcttacatgcattgggttagacaggcccctgggcagacgtttgagtggctgggatggatgaaaccggtgaccggcgccgtgaactatgctcggcagttccaagggcgcgtctcttttctccaggatcagggaattagaatcgcctacatggacctgcgggatcttaagttcgacgatacagctgtgtatttttgtgcccgcaaaaccaagggcgacgttagcggcgatgacagagggttctttttcgatctgtggggacggggcacacgcgtgattgtctcctctagcctccaccaggggcccatcggactgcctcccagatccgcg

SEQ ID NO: 42026 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccacagaatttctcttacccgggaccgcgatctgtttacagctcatatggacatcagaggactcacccagggcgatacagccacctacttctgtgcccggcaaaagtttgaaagccgctatacaggcgggcagggatggtacttcgacctgtggggcagagggacccacattgttgtgtccagcgcttctacgaaaggaccgtccgtctttcccaccatctatgtg

SEQ ID NO: 42027 - RNA, 426 nt, synthetic construct
  misc_feature 1..426: note = derived and/or modified sequence opt5 from anti-HIV-1_HeavyChain
  source 1..426: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgaactacgctcggaatttccaggggcgcgtttctttttatagaacacgggaactgggaatcgcctacatggatcttcgcaacctgagattcgacgataccgctgtgtatttttgtgcccggaagacaaaaggcgacgtcagcggcgatgaccgcgggttctttttcgatctctggggaagaggcacccgggtgattgtttcctctgggctgcatcaacgcgcgcacagaagctcccccacaatctgcgtg

SEQ ID NO: 42028 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcgtggttagctctgcctccaccaaggggccgagcgtgttccccacgatctgcgtc

SEQ ID NO: 42029 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgtcggggttaagaaacccggagctagcgtgaccctgtcctgcaagacagccgacgaagatgtgttcgacgcggcttatatgcactgggtcagacaggcccctggcccggatctcgagtggctggggtggatgaaacccgtgacgggagccgttaactacgctcggaagtttcagggccgcgtgtctttctatagaacccgggaacttgggatcgcctacatggacctgcgcaatctcagatttgatgacacagctgtctatttctgtgcccggaaaaccgcgggagatgtgagcggcgacaagcgcggctttttctttgatctgtgggggagaggatcccgggttattgtgtctagcgcctccacaaagggcccttctgtcttccccaccatctgcgtg

SEQ ID NO: 42030 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcgttttcccccacgacctccgg

SEQ ID NO: 42031 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtcacgggcgctgtgaactttgggtctctggatttcagacaccggattagcctcacccgcgacagagatctgtttacagcccatatggacatccggggacttacccagggcgatacagccacctacttctgtgctcgccaaaaatttgaatccagatatacaggcgggcagggatggtacttcgacctgtggggccgggggacccacattgttgtgtctagcgcctccacgaagggacctagcgtctttccgcatgatctccgc

SEQ ID NO: 42032 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagagaatcggatgggtgaagacggtcaccggcgcggtgaactttgggtctcttgatttccggcaccgcattagcctgacaagagaccgggatctctttaccgctcatatggacatccgcggactgacacagggcgataccgccacatacttctgtgccagacaaaaatttgaatcccggtataccggcgggcagggatggtacttcgacctttggggccgcgggacgcacattgttgtgtctagcgcttccaccaagggaccgagcgtctttcccacaatctgcgtg

SEQ ID NO: 42033 - RNA, 423 nt, synthetic construct
  misc_feature 1..423: note = derived and/or modified sequence opt5 from anti-HIV-1_HeavyChain
  source 1..423: mol_type = other RNA
gaggtgtacatggaaagaggccgcgggggagtcaagaaacccggcgccagcgctaccctgtcctgcaagacagccgacgaggatgttttcgacgcggcttatatgcactgggtgcggcaggcccctgggcaaacgtttgaatggctcggatggatgaaaccggtgaccggcgccgtctcttacgctagaaagttccaggggcgggtgagcttttatatgacacgcgagctgggaatggcctacatggatcttagaaacctgcggttcgacgataccgctgtttatttttgtgcccgcaaaacagcgggcgacgtgtccggcgataatagagggtacttctttgacctctggggacggggctctcgcgtcatcgtgagctccgcctctaccaaggggcccagcgttttccctcatgatctgaga

SEQ ID NO: 42034 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgccagagtcagctgctggtcctctgaagacatcttcgagcggattgaactcatccattgggttcgccaggcgcctggccaggggctggagtggattggatgggtgaagaccgtggctggcgccgtcaactttgggagccttgatttcagacaccggatctccctgacacgcgacagagatctctttacggcccatatggacattcggggactgacccagggcgatacagctacctacttctgtgcccgccaaaaatttgaatctagatatacaggcgggcagggatggtacttcgacctttggggccgggggacccacatcgtggttagctccgctagcacaaagggaccgtctgtgtttccccatgatctgcgc

SEQ ID NO: 42035 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgcggcaggacgataccgccacatatttttgtgcccgccaaaaattcgagagcagatactctggggaccagggatcctattttgatctttggggccggggcaccctgatcatcgtgagctctgcttccacaaaggggccgagcgttttccccaccatttacgtg

SEQ ID NO: 42036 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatggcatctctctgagcagagatcgggacctctccacagcttatatggatattcgcgggctgacccaggacgatacagccacctacttttgtgccagacaaaaattcgctagccggtattctggagaccagggctcctactttgatctttggggccgcgggacactgatcgtggttagctctgcctccaccaagggaccgagcgtgttcccccatgacctcaga

SEQ ID NO: 42037 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcgtggttagctctgcctccaccaaggggccgagcgtgttcccccacgacctccgg

SEQ ID NO: 42038 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccggcgacatcctccggaagtctgaactgattcattgggtgcgccaggcccctgggcagggacttgagtggatcggctgggtgaaaacagtcacgggggcggtgaacttcggaagcctggattttagacaccggatttccctcacccgcgacagagatctgttcacagctcatatggacatccggggccttacccagggcgatacagccacctacttttgtgcccgccaaaagttcgaatctagatatacagggggacagggctggtactttgacctgtgggggcggggaacccacattgttgtgagctccgctagcacgaaaggcccgtctgtcttcccccatgatctccgc

SEQ ID NO: 42039 - RNA, 426 nt, synthetic construct
  misc_feature 1..426: note = derived and/or modified sequence opt5 from anti-HIV-1_HeavyChain
  source 1..426: mol_type = other RNA
caggtgcacctggagcaaagcggctccggggtcaagaaacccggagcctctgttagagtgagctgctggtcctctgaagacatcttcgagcggaccgaactcattcattgggtgcgccaggctcctggccaggggctggagtggatcggatgggtcaagacagtgacgggcgccgttaactttgggagccttgatttcagacaccggatttccctgacccgcgacagagatctctttacagcgcatatggacatccggggactgacccagggcgatacagctacctacttctgtgcccgccaaaaatttgaatctagatatacaggcgggcagggatggtacttcgacctttggggccgggggacccacattgtggtcagctccgcctgcacgaagggaccgagcgtgtttccccatgatctgcgc

SEQ ID NO: 42040 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagctggtccggcgtgaagaaacccggggcttctgtcagagttagctgctggtcctctgaagacatcttcgagcggaccgaactcattcattgggtgcgccaggcccctggacagggcctggagtggatcgggtgggtgaagacagtcacgggagcggtgaactttggcagccttgatttcagacaccggatttccctgacccgcgacagagatctctttacagctcatatggacatccgggggctgacccagggagatacagccacctacttctgtgcccgccaaaaatttgaatctagatatacaggcggccaggggtggtacttcgacctttggggacggggcacccacattgttgtgagctccgctagcacgaaggggccgtctgtctttccccatgatctgcgc

SEQ ID NO: 42041 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcccggagtggatcgggtgggtgaagacggtgagcggaaccgtcaactttggctcctctgatttccggaatcgcattagcctgacaagagaccgggatctttccaccgcgcatatggacatccgcgggctgacacaggatgacaccgctacatatttttgtgccagacagaaattcgaaagcctctactctgatgaccaaggatcctattttgatctgtggggccggggcacccttattatcgtgagctctgcctccacgaaggggcccagcgttttccctcacgacctgcgc

SEQ ID NO: 42042 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctgtctttcccaccatcctgcgc

SEQ ID NO: 42043 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattgccgtgagctctgcttccacgaaggggccgagcgttttcccccacgacctccgc

SEQ ID NO: 42044 - RNA, 426 nt, synthetic construct
  misc_feature 1..426: note = derived and/or modified sequence opt5 from anti-HIV-1_HeavyChain
  source 1..426: mol_type = other RNA
cagagccacctgaagcaatccggctctgccatgaaaaagcccggggctagcgtgagagtctcctgctggacctctgaggacatcttcgaacggacagagctcatttactgggttcgccaggcccctggaagaggcctggaatggatcgggtgggtgaaaacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaagttcgagagcctgtactctgatgaccaaggatcctattttgatctttggggccggggcaccctgattatcgtgagctctgcctccacgaaagggccgagcgttttcccccacgacctccgc

SEQ ID NO: 42045 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcgaatgggtgaaggcggtctctggagctgtgaactacggcagcctggattttagacaccgggtttccctcacgcgcgacagagatctgttcaccgcccatatggacattcgggggcttacacaggatgacaccgccacatatttttgtgctcgccaaaaattcgagtctagatacaccggaggccagggctggtattttgatctgtgggggcggggaacacacatcgtggtcagctccgccagcaccaagggcccttctgtgttcccgcatgacctccgc

SEQ ID NO: 42046 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgagagccgctactctggggaccagggatcctattttgatctttggggcagaggcacactgatcatcgtgagctctgcttccaccaaggggccgagcgttttcccccacgacctccgg

SEQ ID NO: 42047 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagccttgatttccgcaatagaatttccctgtctcgggaccgcgatctcagcaccgcttacatggacatcagaggactgacacaggatgacaccgccacatatttttgtgcccggcaaaagttcgcttcccgctacagcggcgatcagggctcttattttgacctttgggggagaggaaccctgattgttgtgtccagcgcctctacaaaaggcccgtccgtcttcccccacgatctccgg

SEQ ID NO: 42048 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacagcgggtttccctttctcgcgatagagacctgagcaccgctcacatggatattcggggactcacacaagacgataccgccacatacttttgtgcccgccagaaattcgcttccagatatagcggcgaccagggctcttactttgatctgtgggggcggggaacccttatcattgtgtccagcgcctctacaaagggcccctccgtcttccctcatgacctgcgc

SEQ ID NO: 42049 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtgagctctgcctccacgaaggggccgagcgttttcccccacgacctccgc

SEQ ID NO: 42050 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggcagagggctggagtggatcggatgggtgaagacggtctctggcaccgtgaactttgggagctccgatttccggaatcgcatttctcttacaagagaccgggatctgagcaccgcgcacatggacatccgcggactcacacaggatgacaccgctacatacttttgtgccagacagaaattcgaatccctgtatagcgatgaccaaggctcttactttgatctttggggccgggggaccctgattatcgtttccagcgcctctacgaagggaccgtccgtgttcccccatgacctccgc

SEQ ID NO: 42051 - RNA, 426 nt, synthetic construct
  misc_feature 1..426: note = derived and/or modified sequence opt5 from anti-HIV-1_HeavyChain
  source 1..426: mol_type = other RNA
caggtgcacctggagcaaagcggctccggggtcaagaaacccggagcctctgttagagtgagctgctggtcctctgaagacatcttcgagcggaccgaactcattcattgggtgcgccaggctcctggccaggggctggagtggatcggatgggtcaagacagtgacgggcgccgttaactttgggagccttgatttcagacaccggatttccctgacccgcgacagagatctctttacagcgcatatggacatccggggactgacccagggcgatacagctacctacttctgtgcccgccaaaaatttgaatctagatatacaggcgggcagggatggtacttcgacctttggggccgggggacccacattgtggtcagctccgccagcacgaagggaccgtctgtgtttccccatgatctgcgc

SEQ ID NO: 42052 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgcggcaggacgataccgccacatatttttgtgcccgccaaaaattcgagagcagatactctggggaccagggatcctattttgatctttggggccggggcaccctgatcatcgtgagctctgcttccacaaaggggccgagcgttttcccccacgacctccgc

SEQ ID NO: 42053 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactgggggtggcttacatggatcttcggaacctgcgcttcgacgataccgccgtctatttttgtgcgagaaaaacagccggagacgtgtccggcgataatcggggctacttctttgacctctgggggcgcggatctagagttatcgtgagctccgcttctaccaagggccccagcgtcttccctcatgatctgcgg

SEQ ID NO: 42054 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcaacctctccacagctcatatggacattagaggcctgcggcaggatgacaccgccacatatttttgtgcccgccaaaaattcgagagcagatactctggggatcagggatcctattttgacctttggggccggggcaccctgatcatcgtgagctctgcttccacaaaggggccgagcgttttcccccacgatctccgc

SEQ ID NO: 42055 - RNA, 423 nt, synthetic construct
  misc_feature 1..423: note = derived and/or modified sequence opt5 from anti-HIV-1_HeavyChain
  source 1..423: mol_type = other RNA
caggtgcaactggtccagagcggcgccgaggttaagaaacccggggcttccgtgaccctctcttgcaagacagccgacgaagatgtgttcgacgcggcttacatgcactgggtcagacaggcccctggacagacgtttgagtggctgggctggatgaaaccggtgaccggggccgttagctatgctcggaagttccaaggacgcgtgtccttttacatgacaagagaacttggcatggcctatatggatctgcggaacctccgcttcgacgataccgctgtctacttttgtgccagaaaaacagcgggggacgtgtctggagataatcggggctatttctttgacctgtggggccgcgggagcagagttatcgtgtcctctgccagcaccaagggaccctccgtcttccctacaatttacgtg

SEQ ID NO: 42056 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcgtgcattgggtgcgccaggcccctggccaggggctggagtggattggatgggtcaagacggtgaccggcgcggttaactttgggtctccgaatttcagacagcgggtgagccttacacgcgatagagacctgtttaccgctcacatggatatccggggactcacacaagacgataccgccacatacttctgtgcccgccagaaatttgcttccagatattctggcgaccagggcagctacttcgatctgtgggggcggggaacccttattgtcgtgtccagcgcctctacgaagggcccctccgtttttcctcatgacctgcgc

SEQ ID NO: 42057 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcatcgtgagctctgcctccaccaaggggccgctcggactgccccatgacctgcgg

SEQ ID NO: 42058 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagcagatactccggcgatcagggcagctatttcgacctgtgggggcggggaaccctcatcgtggtctcttccgctagcacaaagggcccttctgtgtttccgcacgatctgcgc

SEQ ID NO: 42059 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcatttactgggtgcgccaggcccctggccaggggctggagtggatcggatgggtgaagattgtctctggcacggtgaactttgcgagccttgatttcagaaatcggatctccctgtctcgcgacagagatctcagcaccgctcatatggacattcgggggctgacacaggatgacaccgccacatatttttgtgcccgccaaaaattcgcttccagatacagcggagatcagggctcttattttgacctttggggccgggggaccctgatcatcgtttccagcgcctctacaaagggaccgtccgtgttcccccacgatctccgc

SEQ ID NO: 42060 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagaaaccggattagccttacacgcgatagagacctgtccaccgctcacatggatatccggggactcacacaggacgataccgccacatacttttgtgcccgccaaaaattcgaatctctgtatagcgacgatcagggctcctactttgacctttggggcagagggaccctgattatcgttagctctgcttccacgaagggacccagcgtgttccctcatgatctccgg

SEQ ID NO: 42061 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagcctgtattccgacgatcagggcagctacttcgacctttgggggcgcggaacactgatcattgtgtcttccgctagcaccaaaggcccgtctgtctttccccatgatctcaga

SEQ ID NO: 42062 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctagcgatttcagaaatcggatttcccttacacgcgacagagatctgtctaccgctcacatggacatccggggactcacacaggatgacaccgccacatacttttgtgcccgccaaaaattcgaaagcctgtattccgatgaccagggcagctactttgatctttggggcagagggaccctgattatcgtttcttccgctagcacgaagggaccgtctgtgttcccccatgacctccgg

SEQ ID NO: 42063 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgccagagtgtcctgctggacctctgaagacatcttcgatacaacggagctcatttactgggtccggcaggcgcctggacagggcctggaatggatcgggtgggttaagattgtgagcggaaccgtgaactttgcttcccttgacttccgcaatagaatctctctgagccgggatcgcgacctctccacagcccatatggatattagaggcctgacccaggacgatacagccacctatttttgtgctcggcaaaaattcgccagccgctactctggggaccagggatcctattttgatctttggggcagaggcacacacatcgtcgtgagctctgcttccaccaaggggccgagcgttttcccccatgacctgcgg

SEQ ID NO: 42064 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgaatctagatacaccggcggccaggggtggtattttgatctgtggggacggggcacacacatcgtggtcagctccgccagcaccaaggggccttctgtgttcccgcatgacctccgc

SEQ ID NO: 42065 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgaaagcagatacaccggcggccaggggtggtatttcgatctgtggggacggggcacacacatcgtggtctccagcgcctctaccaaggggccttccgtgtttccgcatgacctccgc

SEQ ID NO: 42066 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgccagccggtactctggagatcaaggctcctattttgacctgtggggccgcgggacccttattatcgtgagctctgcttccacgaagggaccgagcgttttcccccacgatctgaga

SEQ ID NO: 42067 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcgcatggacatcagagggctcacacaggatgacaccgctacatatttttgtgcccggcagaaattcgaaagcctgtactctgatgaccaaggatcctattttgatctttggggccgcggcaccctgattatcgtgagctctgcctccacgaaggggccgagcgttttccccaccgacctcaga

SEQ ID NO: 42068 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaagatgacacagccacctacttctgtgcccggcagaagtttgctagccgctattccggcgatcagggcagctacttcgacctgtgggggagaggaacacttatcgtggtctcttccgccagcaccaaaggcccgtctgtgtttccccatgatctgcgg

SEQ ID NO: 42069 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaactttggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattatcgtgagctctgcctccacgaacgggccgatcggactcccccacgacctgcgc

SEQ ID NO: 42070 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagccgctatacaggcgggcagggatggtacttcgacctgtggggcagagggacccatatcgtggtctccagcgcttctacgaaaggaccgtccgtgtttccccacgatcttcgg

SEQ ID NO: 42071 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacaggacgataccgccacatacttctgtgcccgccaaaaatttgcttccagatattctggcgaccagggcagctacttcgatctgtgggggcggggaacccttatcgtggtctccagcgcctctacgaagggcccctccgtgtttcctcacgacctgcgc

SEQ ID NO: 42072 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacaggactcatttactgggttcgccaggcccctggcagagggctggaatggatcggatgggtgaagacggtgagcggcaccgtcaactttgggtcctctgatttccggaatcgcattagccttacaagagaccgggatctgtccaccgcgcatatggacatccgcggactcacacaggatgacaccgctacatatttttgtgccagacagaaattcgagagcctgtactctgatgaccaaggctcctattttgatctttggggccgggggaccctgattatcgtgagctctgcctccacgaagggaccgagcgttttcccccacgacctccgc

SEQ ID NO: 42073 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcagattttcagacaccggatcagccttacacgcgatagagacctgtttaccgctcatatggatattcggggactcacacaaggcgacaccgccacatacttctgtgcccgccagaaatttgaatccagatataccggcgggcagggatggtacttcgatctgtggggccgggggacgcacatcgttgtgtctagcgcttccaccaagggaccgagcgtctttccccatgaccttcgc

SEQ ID NO: 42074 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcattcattgggttcggcaggcccctggacagggcctggaatggatcgggtgggtgaagaccgtgacaggagcggtcaactttggcagccttgacttccgccacagaatttccctgacccgggatcgcgacctctttacagctcatatggatatcagagggctgacccagggagacacagccacctacttctgtgcccggcaaaaatttgagtctcgctatacgggcggccaggggtggtacttcgatctttggggaagaggcacccacattgtggttagctccgctagcacaaaggggccgtctgtgtttccccatgacctgcgg

SEQ ID NO: 42075 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgaagtgaagaaacccggggccagcgtcagagtttcctgctggacctctgaggacatcttcgaacggacagagctcatttactgggtgcgccaggctcctggaagaggcctggaatggatcgggtgggtgaagacggtcagcggaaccgtgaactttggctcctctgatttccggaatcgcattagccttacaagagaccgggatctgtccaccgcccatatggacatccgcgggctcacacaggatgacaccgcgacatatttttgtgctagacagaaattcgagagcctgtactctgatgaccaaggatcctattttgatctttggggccggggcaccctgattatcgttagctctgcctccacgaaggggccgagcgtgttcccccacgacctccgc

SEQ ID NO: 42076 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgggggagtcaagaaacccggcgctagcgttaccctgtcctgcaagacagccgacgaagatatcttcgacgcggcttatatgcactgggtgagacaggcccctgggcagacgtttgagtggctcggatggatgaaaccggtgaccggcgccgtcaactacgctcggcagttccaagggcgcgtgtctttttatagaacacgggaactgggaattgcctacatggatcttcgcgacctgaagttcgatgacaccgctgtttatttttgtgccagaaaaacaaagggcgatgtgagcggcgacgatcgggggttctttttcgacctctggggacgcggcaccagagtcatcgtgtcctctgcgagcacaaaggggccctccgtttttcctcatgatctgcgg

SEQ ID NO: 42077 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgaagtgaagaaacccggggccagcgtcagagtttcctgctggacctctgaggacatcttcgatacaacggaactcatttactgggtgcggcaggctcctggacagggcctggagtggatcgggtgggtgaagattgtcagcggaaccgtgaactttgcctcccttgacttccgcaatagaatctctctgagccgggatcgcgacctctccacagcgcatatggatattagaggcctgacccaggacgatacagctacctatttttgtgcccggcaaaaattcgccagccgctactctggggaccagggatcctattttgatctttggggcagaggcacactgatcatcgttagctctgcttccaccaaggggccgagcgtgttcccccacgacctccgg

SEQ ID NO: 42078 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttccctttctcgcgatagagacctgagcaccgcttacatggatattcggggactcacacaggacgataccgccacatatttttgtgcccgccaaaaattcgcttccagatacagcggcgaccagggctcttattttgatctgtgggggcggggaacccttatcgtggtctccagcgcctctacaaagggcccctccgtgttccctcatgacctgcgc

SEQ ID NO: 42079 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcgccaagggaccgtctgtctttccccatgatctgcgc

SEQ ID NO: 42080 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgagcggacagaactcatttactgggttcgccaggcccctggaagaggcctggagtggatcgggtgggtgaagacggtgagcggaaccgtcaacttcggctcctctgatttccggaatcgcattagccttacaagagaccgggatctgtccaccgcgcatatggacatccgcgggctcacacaggatgacaccgctacatatttttgtgccagacagaaattcgaaagcctgtactctgatgaccaaggatcctattttgatctttggggccggggcaccctgattgtggttagctctgcctccacgaaggggccgagcgtgtttccccctcgctctgct

SEQ ID NO: 42081 - RNA, 426 nt, synthetic construct
  misc_feature 1..426: note = derived and/or modified sequence opt5 from anti-HIV-1_HeavyChain
  source 1..426: mol_type = other RNA
caggtgcacatggagcaagccggcgggggagtcaagaaacccggcgctagcgttaccctgtcctgcaagacagccgacgaagatgtgttcgacgcggcttacatgcattgggtgagacaggcccctgggcagacgtttgagtggctcggatggatgaaaccggtcaccggcgccgtgaactatgctcggaagttccaggggcgcgtttctttttacagaacacgggaactgggaatcgcctatatggatcttcgcaatctgagattcgacgataccgctgtgtacttttgtgcccggaaaacaaagggcgacgtcagcggcgatgaccgcgggttctttttcgatctctggggaagaggcacccgggtgattgtttcctctgcgagcacaaaggggcccctgcgctcctttcctagacggtctgcc

SEQ ID NO: 42082 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctgtctttcccaccatctatgtg

SEQ ID NO: 42083 - RNA, 426 nt, synthetic construct
  misc_feature 1..426: note = derived and/or modified sequence opt5 from anti-HIV-1_HeavyChain
  source 1..426: mol_type = other RNA
gagagccacctggaacagtccggctctgccatgaagaaacccggggctagcgtgagagtctcctgctggacctctgaggacatcttcgatacaacggaactcatttactgggttcggcaagcccctggacagggcctggagtggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcagaaattcgctagccgctactctggggaccaaggatcctattttgatctttggggcagaggcacactgatcatcgtgagctctgcctccaccaaggggccgagcgttttcccccacgacctccgg

SEQ ID NO: 42084 - RNA, 429 nt, synthetic construct
  misc_feature 1..429: note = derived and/or modified sequence opt5 from anti-HIV-1_HeavyChain
  source 1..429: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaagacgataccgccacatacttctgtgcccgccagaaatttgcttctagatatagcggcgaccagggctcctacttcgatctgtgggggcggggaacccttattgtggtcagctctgcctccacaaagggccccagcgggctgcctccccgctcttgcgtg

SEQ ID NO: 42085 - RNA, 423 nt, synthetic construct
  misc_feature 1..423: note = derived and/or modified sequence opt5 from anti-HIV-1_HeavyChain
  source 1..423: mol_type = other RNA
caggtgcacctggtccaaagcggcgccgaggttaagaaacccggggcttccgtgaaggtgtcttgcaaagccagcggatacaccttcacaacgtccggcatccattggctcagacaggtccctgggcagcggccggaatggatgggatggattcgccccaagaccggcgcgagaaaccaggctcggcaatttcagcctcgcatctctctgacaagagaccgggcccttagcaccgcctatctggatctcaattccctgacatctgctgacagcgggacctacttctgtgcccgccagacatttaaacccgatttctattttgctgaccagggatggtccttcaacctttggggcagaggcgcccactttattgtgagctctgcgtccaccaaggggcctagcgttttcccccatgatctgcgg

SEQ ID NO: 42086 - RNA, 429 nt, synthetic construct
  misc_feature 1..429: note = derived and/or modified sequence opt5 from anti-HIV-1_HeavyChain
  source 1..429: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgcagggaccgatcggcctgccccctcgcctctgcgtc

SEQ ID NO: 42087 - RNA, 426 nt, synthetic construct
  misc_feature 1..426: note = derived and/or modified sequence opt5 from anti-HIV-1_HeavyChain
  source 1..426: mol_type = other RNA
cagagccacctcgagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgattggactgccccctcggagcacg

SEQ ID NO: 42088 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagccttgatttccgccacagaatttccctgacccgggaccgcgatctctttacagctcatatggacatcagaggactgacccagggcgatacagccacctacttctgtgcccggcaaaagtttgaatctcgctatacaggcgggcagggatggtacttcgacctttggggcagagggacccacattgttgtgagctccgctagcacgaaaggaccgtctgtctttcccaccatctgcgtg

SEQ ID NO: 42089 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattcgaatctagatacaccggcgggcagggatggtattttgacctgtggggccgggggacacacatcgtggtcagctccgccctccatcagggacctattggcctgccgccccgcagcacc

SEQ ID NO: 42090 - RNA, 429 nt, synthetic construct
  misc_feature 1..429: note = derived and/or modified sequence opt5 from anti-HIV-1_HeavyChain
  source 1..429: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagagtgtctctgagccgggatcgcgacctctccacagcttatatggatatcagaggcctgacccaggacgatacagccacctacttttgtgcccggcaaaaattcgctagccgctattctggggaccagggatcctactttgatctttggggcagaggcacactgattgttgtgagctctgccctccatcaggggccgatcggaccctcccctaccatcctgcgg

SEQ ID NO: 42091 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcgttttccccacgatttacgtg

SEQ ID NO: 42092 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgagagccgctatacagggggacagggctggtactttgacctttggggcagagggacccatatcgtggtttcttccgctagcacgaagggaccgtctgtgttccccaccatctgcgtc

SEQ ID NO: 42093 - RNA, 426 nt, synthetic construct
  misc_feature 1..426: note = derived and/or modified sequence opt5 from anti-HIV-1_HeavyChain
  source 1..426: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagctcacatggatattagaggcctgacccaagacgatacagccacctatttttgtgcccggcagaaattcgagagccgctacacagggggacagggctggtattttgacctttggggcagagggacccatatcgtcgtgtccagcgcttctacgaagggaccgtccgttttccccaccatctgcgtg

SEQ ID NO: 42094 - RNA, 426 nt, synthetic construct
  misc_feature 1..426: note = derived and/or modified sequence opt5 from anti-HIV-1_HeavyChain
  source 1..426: mol_type = other RNA
agacggcacctggagcagagcggctccggggtgaagaaacccggagcctctgtccgcgttagctgctggtcctctgaagacatcttcgagagaaccgaactcattcattgggtgcggcaagctcctggccaggggctggagtggatcggatgggtgaagacagtcacgggcgccgtgaactttgggagccttgatttccgccacagaatttccctgacccgggaccgcgatctctttacagcgcatatggacatcagaggactgacccagggcgatacagctacctacttctgtgcccggcagaaatttgaatctcgctatacaggcgggcaaggatggtacttcgacctttggggcagagggacccacattgttgtgagctccgccagcacgaagggaccgtctgtctttccccatgatctgcgg

SEQ ID NO: 42095 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgagagccgctattctggggaccagggatcctactttgatctttggggcagaggcacactgatcatcgtgagctctgcttccaccaaggggccgagcgttttccccacgatttgcgtg

SEQ ID NO: 42096 - RNA, 429 nt, synthetic construct
  misc_feature 1..429: note = derived and/or modified sequence opt5 from anti-HIV-1_HeavyChain
  source 1..429: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaatccagatataccggcgggcagggatggtacttcgacctttggggccgggggacgcacattgttgtgtctagcgcttccaccaagggaccgcatcccgtctttcctcacgatctgccc

SEQ ID NO: 42097 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaactcggagcttctgtcagagttagctgctggacctccgaagacatcttcgagcggacagaactgatttactgggtgcgccaggcccccggccaggggcttgagtggatcggatgggtgaagattgtctctggcacggtgaactttgcgagcctggatttcagaaatcggatctccctctctcgcgacagagatctgagcaccgcttatatggacattcgggggcttacacaggatgacaccgccacatacttttgtgcccgccaaaaattcgcttccagatatagcggagatcagggctcttactttgacctgtggggccgggggaccctcatcgttgtgtccagcgcctctacaaagggaccttccgtcttcccgaccatctatgtg

SEQ ID NO: 42098 - RNA, 429 nt, synthetic construct
  misc_feature 1..429: note = derived and/or modified sequence opt5 from anti-HIV-1_HeavyChain
  source 1..429: mol_type = other RNA
caggcccacctggagcaaagcggctccggggtgaagaaacccggagcttctgtcagagttagctgctggacctccgaagacatcttcgagcggacagaactcattcattgggcccgccaggcgcctggccaggggctggagtggatcggatgggtgaagacggtgaccggcgctgtcaactttgggtctcttgatttcagacaccggattagcctgacacgcgacagagatctctttaccgcccatatggacatccggggactgacacagggcgataccgccacatacttctgtgctcgccaaaaatttgaatccagatataccggcgggcagggatggtacttcgacctttggggccgggggacgcacattgtggtttctagcgcctccaccaagggaccgctgggcctgccccctcgcctcagcaga

SEQ ID NO: 42099 - RNA, 426 nt, synthetic construct
  misc_feature 1..426: note = derived and/or modified sequence opt5 from anti-HIV-1_HeavyChain
  source 1..426: mol_type = other RNA
cagagccacctcgagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagctcatatggatattagaggcctgacccaggacgatacagccacctatttttgtgcccggcaaaaattcgctagccgctactctggggaccagggatcctattttgatctttggggcagaggcacactgatcatcgtgagctctgcctccaccaaggggccgagcggactgccccctcggtctgct

SEQ ID NO: 42100 - RNA, 426 nt, synthetic construct
  misc_feature 1..426: note = derived and/or modified sequence opt5 from anti-HIV-1_HeavyChain
  source 1..426: mol_type = other RNA
caggtgcaactggtccagagcggcgccgaggttaagaaacccggggcttccgtgagagtgtcttgctggaccagcgaagacatcttcgatacaacggagctcatttactgggtccggcaggcccctggacagggcctggaatggatcgggtgggtgaagattgtttccggaaccgtgaactttgcgtctcttgacttccgcaatagaatcagcctgtcccgggatcgcgacctctctacagctcacatggatattagaggcctgcggcaagacgataccgccacatatttttgtgcccgccagaaattcgagagcagatactccggggaccagggaagctattttgatctttggggccggggcaccctgatcatcgtctcttccgctagcacaaaggggccgtctgtgttcccccatgacctccgc

SEQ ID NO: 42101 - RNA, 426 nt, synthetic construct
  misc_feature 1..426: note = derived and/or modified sequence opt5 from anti-HIV-1_HeavyChain
  source 1..426: mol_type = other RNA
gaggcccacctggaacagagcggctccggggtgaagaaacccggagcttctgtcagagttagctgctggacctccgaggacatcttcgaacggacagagctcattcattgggtgcgccaagcccctggccaggggctggaatggatcggatgggtgaagattgtctctggcacggtgaactttgcgagccttgatttcagaaatcggatctccctgtctcgcgacagagatctcagcaccgcttacatggacattcgggggctgacacaggatgacaccgccacatatttttgtgcccgccagaaattcgcttccagatacagcggagatcaaggctcttattttgacctttggggccgggggaccctgatcgttgtgtccagcgcctctacaaagggaccgtccgtcttcccccacgatctccgc

SEQ ID NO: 42102 - RNA, 423 nt, synthetic construct
  misc_feature 1..423: note = derived and/or modified sequence opt5 from anti-HIV-1_HeavyChain
  source 1..423: mol_type = other RNA
caggtgcaactggtccagagcggcgccgaggttaagaaacccggggcttccgtgaaggtgtcttgcagagccagcggatacaccttcggcaaccacgcgatctcctgggtccggcaggctcctgggcagggactcgaatggatgggctggattcgcccgaaaacaggggccagaaatcaagcccggcagtttcagccccgcatctctctgacgagagaccgggctcttagcaccgcctatctggatctcaactccctgacatctgctgacagcggaacctacttctgtgcccgccagacatttaagcctgatttctattttgcggaccaaggctggtccttcaatctttggggcagaggggcccattttattgtgagctctgcttccaccaaaggacccagcgttttccctcacgatctgcgg

SEQ ID NO: 42103 - RNA, 429 nt, synthetic construct
  misc_feature 1..429: note = derived and/or modified sequence opt5 from anti-HIV-1_HeavyChain
  source 1..429: mol_type = other RNA
cagggccacaacctggagcaaagcgggtccgaagtgaagaaacccggagcctctgtcagagttagctgctggacctccgaggacatcttcgaacggacagagctcattcattgggtgcgccaggctcctggccaggggctggaatggatcggatgggtgaagacggtcaccggcgccgtgaattttgggtctcttgatttcagacaccggattagcctgacacgcgacagagatctctttaccgcgcatatggacatccggggactgacacagggcgataccgctacatacttctgtgcccgccaaaaatttgagtccagatataccggcgggcagggatggtacttcgacctttggggccgggggacgcacattgttgtgtctagcgcctccaccaagggaccgagcgtctttccccatgatctgcgc

SEQ ID NO: 42104 - RNA, 426 nt, synthetic construct
  misc_feature 1..426: note = derived and/or modified sequence opt5 from anti-HIV-1_HeavyChain
  source 1..426: mol_type = other RNA
cccaccacatggaacaagagcggctccgacgtgaaaaagcctggggcctctgtcagagttagctgctggacgtccgaggatatcttcgaacggaccgagctgattcactgggtgcgccaggctccgggacaaggcctcgaatggatcgggtgggtgaaaacagtcaccggagccgtgaattttggctctcccaacttcagacatcgggttagcctgacacgcgacagagatctttccaccgcgcacatggacattcgggggctgacacaggatgacaccgctacgtacttttgtgcccgccagaagttcgagtctctctatagcgatgaccagggatcctactttgatctgtggggcagaggcacccttatcattgtgagctctgcctccacaaaagggcctagcgtcttcccccatgacctgcgg

SEQ ID NO: 42105 - RNA, 432 nt, synthetic construct
  misc_feature 1..432: note = derived and/or modified sequence opt5 from anti-HIV-1_HeavyChain
  source 1..432: mol_type = other RNA
cacgtgaccccctggaacgagtacgtcggcagagccatgaagaaacctgggcggagcgttcgcgtgtcctgctggacatctgaagacatcttcgatacgaccgagctgatttattgggtgagacaggctccgggacaaggcctcgaatggatcgggtgggtcaagattgtgagcggaacagttaattttgcctccctggacttccggaaccgcatctctcttagcagagatcgggacctgtccaccgcgtacatggatattcgcggcctcacacaggacgataccgctacatatttttgtgccagacagaaattcgcctctcggtacagcggggaccagggatcctattttgatctgtggggccgcggcacccttatcgtggtcagctctgcttccacgaaggggcccagcgtgttccctcatgacctgaga

SEQ ID NO: 42106 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttagacggcccggggcttccgtgaaggtgtcttgcaaagccagcggattctcctttctcggccactacatccattgggtccgccaggcgcctgggcagggactggaatggattggctgggtgaaggctgtttctggggccgtgaactatggaagccttgacttcagacaccgggtctccctgacccgcgatagagacctctctacagcccatatggatatccggggcctgacgcaagacgataccgctacatacttttgtgcccgccagaaattcgctagaggcgaccaggggtggtttttcgatctttggggacggggcaccctgattgtggttagctcc

SEQ ID NO: 42107 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaaacccggggcttccgtgaaggtgtcttgcaaagccagcggatacaccttcacatcctatggcatctcttgggtcagacaggcgcctgggcagggactcgaatggattggctgggtgaagatcgttagcggggctgtgaactttggatccccgaatttccggcaacgcgtctctctgacgagagaccgggatctttttaccgcccacatggacattcgcggcctgacacagggcgataccgccacatacttctgtgctagacagaaatttgagcgcgggggacagggctggatcttcgacctctgggggcggggaaccctgattgccgtgagctcc

SEQ ID NO: 42108 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcgaggccgaagttaagaaacccggcgcttccgtgaagatctcttgcgccaccagcgggtacgcgttcacactctattacctgcactgggtgagacaggctcctggacagggccttgagtggattgggtgggtcaaaacggtgaccggagccgttaactttggctccgcctatttccggcatcgcgtgtctctgacaagagaccgggatctctttaccgctcacatggacatccgcgggctgacacaaggagataccgccacatacttctgtgctagacagaagttttataaaggcggccaggggtggtacttcgacctttggggacggggcaccctgattgtcgtgagctcc

SEQ ID NO: 42109 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagacagagctcattcattgggtgcggcaggcccctggccaggggctggaatggatcggatgggtgaaaacggtcaccggcgcggtgaactttgggtctccgaatttccgccacagagttagccttacacgggatcgcgacctgtttaccgctcatatggatattagaggactcacacagggcgacaccgccacatacttctgtgcccggcaaaagtttgagcgcggcgggcagggatggtatttcgatctgtggggcagagggacccttatcgtggtctcctct

SEQ ID NO: 42110 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgttcctctcacgagagaccgggatctgttcaccgcccatatggacattcgcggacttacacaggatgacaccgccacatatttttgtgctagacagaaattcgcccggggcgatcaaggctggtttttcgacctgtgggggcgcggaaccctcatcgtggtctcctct

SEQ ID NO: 42111 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacccctgaagacatcttcgagcggacagaactcattcattgggtgcgccaggccccgggccaggggctggagtggatcggatgggtgaagattgtctccggcgcggtgaactttgggtctcccaatttcagacagcgggttagccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtcctct

SEQ ID NO: 42112 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcgcttccggcgtgaagagacccggggcctctgtccgggttagctgctggacctccgaagacatcttcgagggatctgaactcattcattgggtgcgccaggcgcctggccaggggctggagtggatcggatgggtgaaaacagtcacgggcgctgtgaactttgggagcgcctacttcagacaccgggtttcccttacccgcgatagagacctgtttacagcccatatggatattcggggactcacccagggcgacacagctacctatttctgtgcccgccaaaagttttacaaaggcgggcagggatggtatttcgatctgtggggcagagggacacttatcgtggtctctagc

SEQ ID NO: 42113 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaattttatgctggcgggcagggatggtacttcgatctgtggggcagagggacacttatcgtggtctctagc

SEQ ID NO: 42114 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcgggccgaactcattcattgggtgcgccaggcgcctggccaggggctggagtggatcggatgggtgaagaccgtcacaggcgctgtgaactttgggagcccgaatttcagacagcgggtttcccttacgcgcgatagagacctgtttaccgcccacatggatattcggggactcacacaaggcgacaccgccacatacttctgtgctcgccagaaatttgaaagaggcgggcagggatggatcttcgatctgtggggccgggggacccttattgccgtgtctagc

SEQ ID NO: 42115 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctcttgatttcagacaccggattagcctgacacgcgacagagatctctttaccgctcatatggacatccggggactgacacagggcgataccgccacatacttctgtgcccgccaaaaatttgaaagaggcgggcagggatggtatttcgacctttggggccgggggaccctgattgttgtgtcctct

SEQ ID NO: 42116 - RNA, 375 nt, synthetic construct
  misc_feature 1..375: note = derived and/or modified sequence opt5 from anti-HIV-1_HeavyChain
  source 1..375: mol_type = other RNA
caggtgcacctggagcaaagcggctccggggtcaagaaactcggagcctctgttagagtgagctgctggacctccgaagacatcttcgagcggacagaactgattcattgggtgcgccaggctcccggccaggggcttgagtggatcggatgggtcaaggccgtgtctggcgcggttaactacgggagcctggattttagacaccgggtgtccctcacgcgcgacagagatctgtctaccgctcatatggacattcggggacttacacaggatgacaccgccacatatttctgtgcccgccaaaaatttgctagaggcgatcagggctggttctttgacctgtgggggcggggaaccctcatcgtcgtgagctcc

SEQ ID NO: 42117 - RNA, 375 nt, synthetic construct
  misc_feature 1..375: note = derived and/or modified sequence opt5 from anti-HIV-1_HeavyChain
  source 1..375: mol_type = other RNA
caggcctacctggagcaaagcggctccatcatgaagaaacccggggcttctgtgagagtcagctgctggacctccgaagacattttcgatcggacagagctcatctattgggttcgccaggcccctggacagggcctggaatggattgggtgggtgaagatcgtgtctggagcggtcaactttggcagccttgacttcagaaatcgggtgtccctgacgcgcgatagagacctctttaccgctcacatggatattcgggggctgacacagggagacaccgccacatacttctgtgcccgccaaaaatttgagagaggcggccaggggtggtatttcgatctttggggacggggcaccctgatcgttgtgtctagc

SEQ ID NO: 42118 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattaactgggtgcgccaggcccctggccaggggctggagtggatcggatgggtgaaggcggtctctggcgctgtgaattacgggagccttgattttagacatcgggtttccctgacgcgcgacagagatctctctaccgcccacatggacattcggggactgacacaggatgacaccgccacatatttctgtgctcgccaaaaatttgccagaggcgatcagggctggttctttgacctttgggggcggggaaccctgatcgtggtcagctcc

SEQ ID NO: 42119 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaaagaggcgggcagggatggtatttcgacctttggggccgggggacactgattgttgtgtctagc

SEQ ID NO: 42120 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagattgtctctggcgccgtgaactttgggagcccgaatttcagacagcgggtttcccttacccgcgatagagacctgtttacagcgcacatggatatccggggactcacccaaggcgacacagctacctacttctgtgcccgccagaaatttgaaagaggcgggcagggatggattttcgatctgtggggccgggggacacttatcgccgtgtctagc

SEQ ID NO: 42121 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccggcgacatcttcgaacggacagagctgattcattgggtgcgccaggcccccgggcagggacttgaatggatcggctgggtgaaggcggtctctggggctgtgaactacggaagcctggattttagacaccgggtttccctcacgcgcgacagagatctgttcaccgcccatatggacattcggggccttacacaggatgacaccgccacatatttttgtgctcgccaaaaattcgccagaggcgatcaggggtggtttttcgacctgtggggacggggcaccctcatcgtggtctctagc

SEQ ID NO: 42122 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacacagatatccggggactcacccaaggcgacacagccacctacttctgtgcccgccagaaatttgaaagaggcgggcagggatggtatttcgatctgtggggccgggggacacttattgtggtctctagc

SEQ ID NO: 42123 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgcctcgcctccgaagacatcttcgagcggaccgaactgattcattgggtgcgccaggcgcctggccaggggcttgagtggatcggatgggtgaagacagtcacgggcgctgtgaactttgggtctccgaatttcagacaccgggttagcctgacccgcgatagagacctctttacagcccatatggatattcggggactgacccagggcgacacagccacctacttctgtgctcgccaaaaatttgaaagaggcgggcagggatggtatttcgatctttggggccgggggacactgatcgtggtctcctct

SEQ ID NO: 42124 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagagacccggagcctccgtccgggtttcttgctggaccagcgaagacatcttcgagacaacggaactcattcattgggtgcgccaggcgcctggccaggggctggagtggatcggatgggtgaaaaccgtctccggcgctgtgaactttgggtctcttaatttcagacaccgggttagcctgacacgcgatagagacctctttaccgcccatatggatattcggggactgacacagggcgacaccgccacatacttctgtgctcgccaaaagtttgccagaggcgatcaggggtggttctttgacctttggggacggggcaccctgatcgtggtctcctct

SEQ ID NO: 42125 - RNA, 375 nt, synthetic construct
  misc_feature 1..375: note = derived and/or modified sequence opt5 from anti-HIV-1_HeavyChain
  source 1..375: mol_type = other RNA
agacacacctggaacaagagcggctccggggtgaaaaagcccggagcctctgtccgggttagctgctggacatccgaggacatcttcgaaaaatctgagctgattcattgggtgcgccaggctcctggccaagggctcgaatggatcggatgggtgaagacggtcaccggcgccgtgaattttgggagctccgatttcagacagcgggtttctctgacacgcgacagagatctttttaccgcgcacatggacattcggggactgacacagggcgataccgctacatacttctgtgcccgccagaaattttatgccggcgggcaaggatggtacttcgacctctggggcagagggaccctgatcgtggtcagctcc

SEQ ID NO: 42126 - RNA, 375 nt, synthetic construct
  misc_feature 1..375: note = derived and/or modified sequence opt5 from anti-HIV-1_HeavyChain
  source 1..375: mol_type = other RNA
ggcacccccgggagcgagtccggatctggcgtgaagaaacctggggccagcgtcagagtttcctgctggacatctgaagacatcttcgagcggacggaactgattcactgggtgcgccaggctccgggacaaggcctcgagtggatcgggtgggtgaagattgtcagcggagccgtgaactttggctcccccaatttcagacagcgggtttctctgacccgcgatagagacctttttacagcgcatatggatatccggggcctgacccagggggacacagctacctacttctgtgcccgccagaaatttgaaagaggaggccaagggtggattttcgatctctggggacggggcacactgatcgccgtgagctcc

SEQ ID NO: 42127 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcaccgaggttcagaagcccggggcctccgtgaaagtgtcttgcaaggctttcggatacagctttacagactattacgtctattgggtgagacaggcccctggccaagggctcgaatacgttgcgtggatcaacccgtccaatggatatacgaaatacgctcagaagttccaggattgggtgaccctgacacgggactctagcattaacaccgcctatcttcagctggcccgcgtcacatccgatgacaccgctatctactactgtgccagacaaaaatttgcttctcggtatagcggcgatcaggggtcctacttcgacctctggggacgcggcacactgattgtggttagctct

SEQ ID NO: 42128 - RNA, 378 nt, synthetic construct
  misc_feature 1..378: note = derived and/or modified sequence opt5 from anti-HIV-1_HeavyChain
  source 1..378: mol_type = other RNA
caggtgcaactggtccagagcggcgccgctgttaagaaacccgggtcctctgtgaaggtgagctgcaaagcctccggatacatcttcaccggctattacattcactggatcagacaggcgcctgggcagggactcgagtggatgggctggattaacccgtctacaggggacacgaagtttgctcggcaattccagggacgcgtcagcttttatagaacccgggaactgggcatcgcctacatggatcttcgcgacctgaaattcgatgacacagccgtgtatttttgtgctagaaagaccaagggcgatgtttccggggacgatcggggattctttttcgacctctggggccgcgggacaagagtgattgtctctagc

SEQ ID NO: 42129 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgctgggatgaagaaacccggagccagcatgaccgtctcctgcaagacagcggacgaagatatcttcgacgctgcctatatgcactgggttagacaggcccctggccagacgtttgagtggctggggtggatgaaaccggtgaccggagctgtgaactacgcccggcagttccaaggccgcgtctctttttatagaacacgggaactcgggattgcttacatggatctgcgcgaccttaagttcgatgacaccgccgtgtatttttgtgcgagaaaaacaaagggagatgttagcggcgacgatcggggcttctttttcgacctgtgggggcgcggaaccagagtgatcgtctcctct

SEQ ID NO: 42130 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcgggggaatgaagaaacccggcgctagcatgaccgtctcctgcaagacagccgacgaagatgtttttgacgcggcttacatgcactgggtgagacaggcccctgggcagacgttcgagtggctgggatggatgaaaccggtgaccggcgccgtcaactatgctcggaagtttcaggggcgcgtgtctttctacagaacacgggaactcggaatcgcctatatggatctgcgcgaccttaaatttgatgacaccgctgtttacttctgtgccagaaagacaaagggcgatgtgagcggcgacgatcgggggtttttctttgacctgtggggacgcggcaccagagtcattgtgtcctct

SEQ ID NO: 42131 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcgggggaatgaagaaacccggcgctagcatgaccgtctcctgcaagacagccgacgaagatgtttttgacgcggcttacatgcactgggtgagacaggcccctgggcagacgttcgagtggctgggatggatgaaaccggtgaccggcgccgtcaactatgctcggcagtttcaagggcgcgtgtctttctacagaacacgggaactcggaatcgcctatatggatctgcgcgaccttaagtttgatgacaccgctgtttacttctgtgccagaaaaacaaagggcgatgtgagcggcgacgatcgggggtttttctttgacctgtggggacgcggcaccagagtcattgtgtcctct

SEQ ID NO: 42132 - RNA, 381 nt, synthetic construct
  misc_feature 1..381: note = derived and/or modified sequence opt5 from anti-HIV-1_HeavyChain
  source 1..381: mol_type = other RNA
caggtgcacatggagcaagccggcgggggagtcaagaaacccggcgctagcgttaccctgtcctgcaagacagccgacgaagatgtgttcgacgcggcttacatgcattgggtgagacaggcccctgggcagacgtttgagtggctcggatggatgaaaccggtcaccggcgccgtgtcttatgctcggaagttccaggggcgcgttagcttttacatgacaagagaactgggaatggcctatatggatcttcggaacctgcgcttcgacgataccgctgtgtacttttgtgccagaaaaacagcgggcgacgtctccggcgataatcgggggtatttctttgacctctggggacgcggctctagagtgatcgttagctcc

SEQ ID NO: 42133 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggaatgaagaaacccggcgctagcatgaccgtctcctgcaagacagccgacgaagatatcttcgacgcggcttatatgcactgggttagacaggcccctgggcagacgtttgagtggctgggatggatgaaaccggtgaccggcgccgtgaactacgctcggcagttccaagggcgcgtctctttttatagaacacgggaactcggaatggcctacatggatctgcgcaatcttagattcgacgataccgctgtgtatttttgtgcccggaagacagcgggcgacgttagcggcgataaccgcgggtacttctttgacctgtggggaagaggctcccgggtgattgtctctagc

SEQ ID NO: 42134 - RNA, 381 nt, synthetic construct
  misc_feature 1..381: note = derived and/or modified sequence opt5 from anti-HIV-1_HeavyChain
  source 1..381: mol_type = other RNA
caggtgtacatggagcaagccggcgggggagtcaagaaacccggcgctagcgttaccctgtcctgcaagacagccgacgaagatgtgttcgacgcggcttatatgcactgggtgagacaggcccctgggcagacgtttgagtggctcggatggatgaaaccggtcaccggcgccgtgtcttacgctcggaagttccaggggcgcgttagcttttatatgacaagagaactgggaatggcctacatggatcttcggaacctgcgcttcgacgataccgctgtgtatttttgtgccagaaaaacagcgggcgacgtctccggcgataatcgggggtacttctttgacctctggggacgcggctcttgggtgatcgttagctcc

SEQ ID NO: 42135 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaccctctcttgcaagacagccgacgaagatgtgttcgacgcggcttacatgcactgggtcagacaggcccctggacagacgtttgagtggctgggctggatgaaaccggtgaccggggccgttaactatgctcggaagttccaaggacgcgtgagcttttacagaacacgggaacttggcatcgcctatatggatctgcgcaatctcagattcgacgataccgctgtctacttttgtgcccggaaaacagcgggggacgtgtccggagataagcgcggcttctttttcgacctgtggggcagagggtctcgggttattgtgagctcc

SEQ ID NO: 42136 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcggcctctccacagcttatatggacattagagggctgacccaggatgacacagccacctacttttgtgcccggcaaaaattcgctagccgctattctggagatcagggctcctactttgacctttggggcagagggacactgatcgtggttagctct

SEQ ID NO: 42137 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcgcttccggcgtgagacggcccggggcctctgtccgcgttagctgctggacctccgaagacatcttcgagagatctgaactcatttactgggtgcggcaggcgcctggacgcggcctggagtggatcgggtggattaaacttgtgagcggagctgtcaactttggctccgtggatttcagagaccgggtttctctgacacgcgatagagacctctttacggcccatatggatatccgggggctgacccagggagacacagccacctatttctgtgctcgccagaagtttgaaagcagatacacaggcggccaagggtggtatttcgatctttggggacggggcacccacattgtggtctccagc

SEQ ID NO: 42138 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttaattttagaagccggatttccctgacacgcgatagagacctcttcaccgctcacatggatatccggggactgacacagggcgacaccgccacatatttttgtgcccgccaaaaattcgaatctagatacaccggcgggcagggatggtattttgatctttggggccgggggacgcatattgttgtgagctcc

SEQ ID NO: 42139 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaatctagatatacaggcgggcagggatggtacttcgatctgtggggccgggggacccacatcgtggtcagctcc

SEQ ID NO: 42140 - RNA, 384 nt, synthetic construct
  misc_feature 1..384: note = derived and/or modified sequence opt5 from anti-HIV-1_HeavyChain
  source 1..384: mol_type = other RNA
caggtgcacctggagcaaagcggctccggggtcaagaaacccggagcctctgttagagtgagctgctggtcctctgaagacatcttcgagcggaccgaactcattcattgggtgcgccaggctcctggccaggggctggagtggatcggatgggtcaagacagtgacgggcgccgttaactttgggagccttgatttcagacaccggatttccctgacccgcgacagagatctctttacagcgcatatggacatccggggactgacccagggcgatacagctacctacttctgtgcccgccaaaaatttgaatctagatatacaggcgggcagggatggtacttcgacctttggggccgggggacccacattgtggtcagctcc

SEQ ID NO: 42141 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgggccgggatcgcgacctcagcacagcttatatggatattagagggctgacccaggacgatacagccacctacttttgtgcccggcaaaaattcgcttcccgctatagcggagaccagggctcttactttgatctttggggcagagggacactgatcgtggtttccagc

SEQ ID NO: 42142 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaaggcgacacagctacctacttctgtgcccgccagaaatttgaatccagatatacgggcgggcagggatggtacttcgatctttggggccgggggacccatatcgtggtctctagc

SEQ ID NO: 42143 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaaggaatcttcgacacaacggagctcatttactgggttcggcaggcccctggccaggggctggaatggatcggatgggtgaagattgtgagcggcaccgtcaactttgcgtcccttgatttccgcaatagaatctctctgagccgggaccgcgatctctccacagcttatatggacattagagggctgacccaggatgacacagccacctacttttgtgcccggcaaaaattcgctagccgctattctggagatcagggctcctactttgacctttggggcagagggacactgatcgtggttagctct

SEQ ID NO: 42144 - RNA, 384 nt, synthetic construct
  misc_feature 1..384: note = derived and/or modified sequence opt5 from anti-HIV-1_HeavyChain
  source 1..384: mol_type = other RNA
cagagcagactggagcaatccggctctgccatgaagaaacccggggctagcgtgcgggtctcctgctggacctctgaagacatcttcgatacaacggagctcatttactgggttcgccaggcccctggacagggcctggaatggatcgggtgggtgaagattgtgagcggaaccgtcaactttgcgtcccttgacttcagaaatcggatctctctgagccgcgatagagacctctccacagctcacatggatattcggggcctgacccaggacgatacagccacctatttttgtgcccgccaaaaattcgctagcagatactctggggaccagggatcctattttgatctttggggccggggcacactgatcatcgtgagctct

SEQ ID NO: 42145 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagtttgaaagccgctatacaggcgggcagggatggtacttcgacctgtggggcagagggacccatatcgtggtctccagc

SEQ ID NO: 42146 - RNA, 384 nt, synthetic construct
  misc_feature 1..384: note = derived and/or modified sequence opt5 from anti-HIV-1_HeavyChain
  source 1..384: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcctctgacttccgcaatagaatcagcctttcccgggatcgcgacctgagcacagcttatatggatattagaggcctcacccaggacgatacagccacctacttttgtgcccggcaaaaattcgcttctcgctattccggggaccagggaagctactttgatctgtggggcagaggcacacttatcatcgtgtcttcc

SEQ ID NO: 42147 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcacggtgaactttgcgagccttgatttcagaaatcggatctccctgtctcgcgacagagatctcagcaccgcttacatggacattcgggggctgacacaggatgacaccgccacatatttttgtgcccgccaaaaattcgcttccagatacagcggagatcagggctcttattttgacctttggggccgggggaccctgatcgttgtgtccagc

SEQ ID NO: 42148 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggtcctctgaagacatcttcgagcgcacagaactgattcattgggtgagacaagctcctggccaggggctcgagtggatcggatgggtgaagacggtcaccggcgccgtgaactttgggagcctggatttccggcaccgcatttcccttacaagagaccgggatctgtttaccgcgcatatggacatccgcggactcacacagggcgataccgctacatacttctgtgccagacagaaatttgaatctcggtataccggcgggcaaggatggtacttcgacctgtggggccgcgggacgcacattgttgtgagctcc

SEQ ID NO: 42149 - RNA, 384 nt, synthetic construct
  misc_feature 1..384: note = derived and/or modified sequence opt5 from anti-HIV-1_HeavyChain
  source 1..384: mol_type = other RNA
agacacacctgggagcagagcggctccggggtgaagaaacccggagcctctgtccgggttagctgctggacatccgaagacatcttcgagcgcacggaactgattcattgggtgagacaagctcctggccaggggctcgagtggatcggatgggtgaagaccgtcacaggcgccgtgaactttgggtctctggatttccggcaccgcattagccttaccagagaccgggatctgtttacagcgcatatggacatccgcggactcacccagggcgatacagctacctacttctgtgccagacagaaatttgaatcccggtatacgggcgggcaaggatggtacttcgacctgtggggccgcgggacccacattgttgtgtctagc

SEQ ID NO: 42150 - RNA, 414 nt, synthetic construct
  misc_feature 1..414: note = derived and/or modified sequence opt5 from anti-HIV-1_HeavyChain
  source 1..414: mol_type = other RNA
caggcccacctggagcaaagcggctccggggtgaagaaacccggagcttctgtcagagttagctgctggacctccgaagacatcttcgagcggtctgaactcattcattgggtgcgccaggcccctggccaggggctggagtggatcggatgggtgaagacagtcacgggcgcggtgaactttgggagcccgaatttcagacaccgggtttcccttacccgcgatagagacctgtttacagctcatatggatattcggggactcacccagggcgacacagccacctacttctgtgcccgccaaaaatattacgctggcgggcagggatggtattttgatctgtggggcagagggacacttatcgtggtctctagcgcctccaccaagggacccagcgtgttccacgacctgcgg

SEQ ID NO: 42151 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggattttcgatctgtggggccgggggacccttatcgctgtgtctagcgcctccacaaagggacccagcgtctttcctaccatctgcgtg

SEQ ID NO: 42152 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaagcggtcagcggcgctgtgaactacgggtcccttgattttcgccacagagtttctctgacacgggaccgcgatctcttcacggcccatatggacattagaggactgacccaggatgacacagccatctatttttgtgctcggcaaaagttcgcccgcggcgatcagggctggtttttcgacctttgggggagaggaaccctgattgtggtcagctccgctagcacaaaaggcccgtctgtgtttccccacgatctccgg

SEQ ID NO: 42153 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaagtcggagcttctgttagagtgagctgctggacctccgaagacatcttcgagcggacagaactcattcattgggtgcgccaggcccccggccaggggctggagtggatcggatgggtcaaggcggtgtctggcgctgttaactacgggagccttgattttagacaccgggtgtccctgacgcgcgacagagatctcttcaccgcccatatggacattcggggactgacacaggatgacaccgccatctatttttgtgctcgccaaaaattcgccagaggcgatcagggctggtttttcgacctttgggggcggggaacactgattgtcgtgtctagcgcttccaccaagggccctagcgtttttccgcacgatctccgc

SEQ ID NO: 42154 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattctacgccggcgggcagggatggtattttgacctgtggggcagagggaccctcatcgtggtctctagcgcttccacaaagggacctagcgtgttcccgcacgatctgcgg

SEQ ID NO: 42155 - RNA, 423 nt, synthetic construct
  misc_feature 1..423: note = derived and/or modified sequence opt5 from anti-HIV-1_HeavyChain
  source 1..423: mol_type = other RNA
caggtgtacatggagcaagccggcgctggggtcaagaaacccggagccagcgttaccctgtcctgcaagacagcggacgaagatgtgttcgacgctgcctatatgcactgggtgagacaggcccctggccagacgtttgagtggctcgggtggatgaaaccggtcaccggagctgtgtcttacgcccggaagttccagggccgcgttagcttttatatgacaagagaactggggatggcttacatggatcttcggaacctgcgcttcgacgataccgccgtgtatttttgtgcgagaaaaacagccggagacgtctccggcgataatcggggctacttctttgacctctgggggcgcggatctagagtgatcgttagctccgcttctaccaagggccccagcgtgttccctcatgatctgcgg

SEQ ID NO: 42156 - RNA, 426 nt, synthetic construct
  misc_feature 1..426: note = derived and/or modified sequence opt5 from anti-HIV-1_HeavyChain
  source 1..426: mol_type = other RNA
cagagccacctggagcaatccggctctgccatgaagaaacccggggctagcgtgagagtctcctgctggacctctgaagacatcttcgatacaacggagctcatttactgggttcggcaggcccctggacagggcctggaatggatcgggtgggtgaagattgtgagcggaaccgtcaactttgcgtcccttgacttccgcaatagaatctctctgagccgggatcgcgacctctccacagcttatatggatattagaggcctgacccaggacgatacagccacctacttttgtgcccggcaaaaattcgctagccgctattctggggaccagggatcctactttgatctttggggcagaggcacactgatcgtggttagctctgcctccaccaaggggccgagcgtgttccccacgatctatgtc

SEQ ID NO: 42157 - RNA, 372 nt, synthetic construct
  misc_feature 1..372: note = derived and/or modified sequence opt5 from anti-HIV-1_HeavyChain
  source 1..372: mol_type = other RNA
caggtgcaactggtccagagcggcgccgaggttaagaagcccggggcttccgtgaaggtgtcttgcaaagccagcggaggcaccctctcctcttacgcgatcagctgggtcagacaggctcctgggcagggactggaatggattggctgggtgaagacagttacgggggccgtgaacttcggatccgcctgttttcggcaccgcgtctctcttaccagagaccgggatctgttcacagctcatatggacatccgcggcctcacccaaggcgatacagccacctatttttgcgctagacagaaattctacaaagggggacagggctggtattttgacctgtgggggcggggaacacttattgtggttagctcc

SEQ ID NO: 42158 - RNA, 372 nt, synthetic construct
  misc_feature 1..372: note = derived and/or modified sequence opt5 from anti-HIV-1_HeavyChain
  source 1..372: mol_type = other RNA
cacgtgagactggtccagagcggcgccgaggttgaaaagcccggggcttccgtgaaagtgtcttgcgagaccagcaactaccctttcaatatgtatggaatgacatgggtccggcaagccccgggccaggggctcgaatggatcggatgggtgaagattgtttccggcgcggtgaactttgggtctcccaatttccgccagagagtcagcctgacgcgggaccgcgatctttttaccgctcatatggacatcagaggactgacacagggcgataccgccacatacttctgtgcccggcaaaaatttgagcgcggcgggcagggatggattttcgacctctggggcagagggaccctgatcgctgtgtcctct

SEQ ID NO: 42159 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacgtgttcgagcggacagaactgatccattgggtgcgccaggcccccggccaggggcttgagtggattggatgggtcaaggcggtgtctggcgctgttaactacgggagcctggattttagacaccgggtgtccctcacgcgcgacagagatctgttcaccgcccatatggacatccggggacttacacaggatgacaccgccacatatttttgtgctcgccaaaaattctacgccggcggccaggggtggtattttgatctgtggggaagaggcaccctcattgtcgtgtctagc

SEQ ID NO: 42160 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagaaacccggagcctctgtccgggttagctgctggtcctctgaagacatcttcgagcgcacagaactgattcattgggtgagacaagctcctggccaggggctcgagtggatcggatgggtgaagacggtcaccggcgccgtgaactttgggagcctggatttccggcaccgcatttcccttacaagagaccgggatctgtttaccgcgcatatggacatccgcggactcacacagggcgataccgctacatacttctgtgccagacagaaatttgaacggggcgggcaaggatggtatttcgacctgtggggccgcgggacccttattgttgtgtctagc

SEQ ID NO: 42161 - RNA, 375 nt, synthetic construct
  misc_feature 1..375: note = derived and/or modified sequence opt5 from anti-HIV-1_HeavyChain
  source 1..375: mol_type = other RNA
agacacacctgggagcagagcggctccggggtgaagcggcccggagcctctgtccgcgttagctgctggacatccgaagacatcttcgagacgaccgaactgattcattgggtgagacaagctcctggccaggggctcgagtggatcggatgggtgaaaacagtctctggcgccgtgaactttgggagcctgaatttccggcaccgcgtttcccttaccagagatcgggacctgtctacagcgcatatggatattcgcggactcacccaggacgatacagctacctacttttgtgccagacagaagttcgcccggggcgaccaaggctggtttttcgatctgtgggggcgcggaacgcttatcgtggtcagctcc

SEQ ID NO: 42162 - RNA, 381 nt, synthetic construct
  misc_feature 1..381: note = derived and/or modified sequence opt5 from anti-HIV-1_HeavyChain
  source 1..381: mol_type = other RNA
caggtgttcatggagcaagccggcgctgggatgaagaaacccggagccagcatgaccgtctcctgcaagacagcggacgaagatgtttttgacgctgcctacatgcactgggtgagacaggcccctggccagacgttcgagtggctggggtggatgaaaccggtgaccggagctgtcaactatgcccggcagtttcaaggccgcgtgtctttctacagaacacgggaactcgggatcgcttatatggatctgcgcgaccttaagtttgatgacaccgccgtttacttctgtgcgagaaaaacaaagggagatgtgagcggcgacgatcggggctttttctttgacctgtgggggcgcggaaccagagtcattgtgtcctct

SEQ ID NO: 42163 - RNA, 384 nt, synthetic construct
  misc_feature 1..384: note = derived and/or modified sequence opt5 from anti-HIV-1_HeavyChain
  source 1..384: mol_type = other RNA
caggtgcacctggagcaaagcggctccggggtcaagaaacccggagcctctgttagagtgagctgctggacctccgaagacatcttcgagcggacagaactcattcattgggtgcgccaggctcctggccaggggctggagtggatcggatgggtcaagacggtgaccggcgccgttaactttgggtctcttgatttcagacaccggattagcctgacacgcgacagagatctctttaccgcgcatatggacatccggggactgacacagggcgataccgctacatacttctgtgcccgccaaaaatttgaatccagatataccggcgggcagggatggtacttcgacctttggggccgggggacgcacattgtggtctctagc

SEQ ID NO: 42164 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatttctgtgctcgccaaaaatttgccagaggcgatcagggctggttctttgacctgtgggggcggggaaccctcatcgtggtcagctccgctagcacaaagggcccttctgtgttcccgaccatttgcgtt

SEQ ID NO: 42165 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatcgtggtcagctccgccagcaccaaaggaccgtctgtgtttcccacgatttgcgtt

SEQ ID NO: 42166 - RNA, 417 nt, synthetic construct
  misc_feature 1..417: note = derived and/or modified sequence opt5 from anti-HIV-1_HeavyChain
  source 1..417: mol_type = other RNA
caggcccacctggagcaaagcggctccggggtgaagaaactcggagcttctgtcagagttagctgctggacctccgaagacgtgttcgagcggacagaactgatccattgggtgcgccaggcccccggccaggggcttgagtggattggatgggtcaaggcggtgtctggcgctgttaactacgggagcctggattttagacaccgggtgtccctcacgcgcgacagagatctgttcaccgcccatatggacatccggggacttacacaggatgacaccgccacatatttttgtgctcgccaaaaattctacgccggcggccaggggtggtattttgatctgtggggaagaggcaccctcattgtcgtgtctagcgcttccacaaaggggcctagcgttttcccgcacgacctgcgg

SEQ ID NO: 42167 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatacttctgtgcccgccagaaatttgaaagaggcgggcagggatggtatttcgatctgtggggccgggggacccttattgtggtctctagc

SEQ ID NO: 42168 - RNA, 384 nt, synthetic construct
  misc_feature 1..384: note = derived and/or modified sequence opt5 from anti-HIV-1_HeavyChain
  source 1..384: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaagacggtcaccggcgcggtgaactttgggtctctggatttcagacaccggattagcctcacacgcgacagagatctgtttaccgctcatatggacatccggggacttacacagggcgataccgccacatacttctgtgcccgccaaaaatttgaatccagatataccggcgggcagggatggtacttcgacctgtggggccgggggacgcacattgttgtgtctagc

SEQ ID NO: 42169 - RNA, 426 nt, synthetic construct
  misc_feature 1..426: note = derived and/or modified sequence opt5 from anti-HIV-1_HeavyChain
  source 1..426: mol_type = other RNA
caggcccacctggagcaaagcggctccggggtgaagaaacccggagcttctgtcagagttagctgctggtcctctgaagacatcttcgagcggaccgaactcattcattgggtgcgccaggcccctggccaggggctggagtggatcggatgggtgaagacagtcacgggcgcggtgaactttgggagccttgatttcagacaccggatttccctgacccgcgacagagatctctttacagctcatatggacatccggggactgacccagggcgatacagccacctacttctgtgcccgccaaaaatttgaatctagatatacaggcgggcagggatggtacttcgacctttggggccgggggacccacattgttgtgagctccgctagcacgaagggaccgtctgtctttcccaccatctgcgtg

SEQ ID NO: 42170 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgaaagaggcgggcagggatggtatttcgatctgtggggccgggggacgcttatcgtggtctcctct

SEQ ID NO: 42171 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggatacacctatacaacgtacggcgtctcctggctcagacaggtgcctgggcagcggccggaatggatgggatggatccgccccaagaccggcgcgagaaaccaagctcggcagttccagcctcgcatttctctgacaagagaccgggcccttagcaccgcctatctggatctcaattccctgacatctgctgacagcgggacctacttttgtgcccgccagacattcaaacccgatttttatttcgctgaccaaggatggtcctttaacctttggggcagaggcgcccacttcatcgttagctct

SEQ ID NO: 42172 - RNA, 384 nt, synthetic construct
  misc_feature 1..384: note = derived and/or modified sequence opt5 from anti-HIV-1_HeavyChain
  source 1..384: mol_type = other RNA
agagcccacctggagcagagcggctccggggtgaagaaactcggagcttctgtccgggttagctgctggacctccgaagacatcttcgagcgcacagaactgattcattgggtgagacaagcccccggccaggggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatatttttgtgctagacagaaattcgaatctcggtacaccggcggccaagggtggtattttgatctgtggggacgcggcacacacatcaccgtgagctcc

SEQ ID NO: 42173 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagattgtctctggcgcggtgaactttgggagcccgaatttcagacagcgggtttcccttacgcgcgatagagacctgtttaccgctcacatggatatccggggactcacacaaggcgacaccgccacatactattgtgcccgccagaaattcgaaagaggcgggcagggatggatttttgatctgtggggccgggggacccttatcgctgtgtctagc

SEQ ID NO: 42174 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatatttttgtgctcgccaaaaattcgccagaggcgatcagggctggtttttcgacctgtgggggcacggaaccctcatcgtggtctctagc

SEQ ID NO: 42175 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaatttgaaagaggcgggcagggatggtatttcgatctgtggggccacgggacccttatcgtggtctcctct

SEQ ID NO: 42176 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggacggagatctgtttacagctcacatggacattcgcggcctcacccaaggcgatacagccacctacttctgtgccagacagaagttttatgctgggggacagggctggtacttcgacctgtgggggcggggaacacttatcattgtgagctcc

SEQ ID NO: 42177 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggcaccagattagcgatcgcgtttcccttaccagagaccgggatctgttcacagctcatatggacatccgcggactcacccaaggcgatacagccacctacttttgtgccagacagaagttctatgctggcgggcagggatggtactttgacctgtggggccacgggacacttattgtggtctctagc

SEQ ID NO: 42178 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacacagccacctacttctgtgcccgccaaaaatttgaaagaggcgggcagggatggtatttcgatctgtggggccacgggacacttatcgtggtctctagc

SEQ ID NO: 42179 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggcgctggggtgaagaaacccggagcctccgtcagagtttcttgctggaccagcgaagacatcttcgagcggacagaactcattcattgggtgcgccaggcgcctggccaggggctggagtggatcggatgggtgaagacggtctccggcgctgtgaactttgggtctccgaatttcagacaccgggttagccttacccgcgatagagacctgtttacagcccatatggatattcggggactcacccagggcgacacagccacctactattgtgctcgccaaaaattcgaaagaggcgggcagggatggtactttgatctgtggggccgggggacacttatcgtggtctcctct

SEQ ID NO: 42180 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggcagagggcttgagtggatcggatgggtgaaggcggtctctggcgctgtgaactacgggagcctggattttcggcaccgcgtttccctcacgagagaccgggatctgttcaccgcccatatggacattcgcggacttacacaggatgacaccgccacatattactgtgctagacagaaatttgaacggggcggccaagggtggatcttcgatctgtggggacgcggcaccctcattgccgtgtctagc

SEQ ID NO: 42181 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctactattgtgcccggcagaagttctacgctggcgggcagggatggtattttgacctgtggggccgcgggacacttatcgtggtcagctcc

SEQ ID NO: 42182 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatacttctgtgcccgccaaaaattttataagggcgggcagggatggtacttcgatctgtggggcagagggacccttatcgtggtctcctct

SEQ ID NO: 42183 - RNA, 372 nt, synthetic construct
  misc_feature 1..372: note = derived and/or modified sequence opt5 from anti-HIV-1_HeavyChain
  source 1..372: mol_type = other RNA
tacgtggagctgggcaccaacacagggcccgaagtcagaaagcctggagccagcgttaaaatctcctgcaagacgtctggctatattttcaccgacaattactttcactggctccggcaggctccggccgtggggctggagtggatgggatggatcaacagccataatggctatacaaaatccgcgaagaaattccaagggcgcattaccatgacaagagataccgctgtggacacagcctacatggaacttatcgatctgacctctgacgatacggccacctattactgtgctcggcagaagttttatgccggaggccagggctggtacttcgacctctgggggtgcggaacactgattgtcgtgagctcc

SEQ ID NO: 42184 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccgcgggacacttatctgcgtgagctcc

SEQ ID NO: 42185 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctagcgatttcagacagcgggtttcccttacacgcgacagagatctgtttaccgctcacatggacattcggggactcacacaaggcgataccgccacatactattgtgcccgccagaaattctacgctggcgggcagggatggtattttgacctgtggggcagagggacccttatcgtggtctctagc

SEQ ID NO: 42186 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagccggtcacgggcgcggtgaactttgggtctcccaatttcagacaccgggttagccttacccgcgatagagacctgtttacagctcatatggatattcggggactcacccagggcgacacagccacctacttctgtgcccgccaaaaatttgaaagaggcgggcagggatggtatttcgatctgtggggccgggggacacttatcgtggtctcctct

SEQ ID NO: 42187 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgagagtgtcttgctggaccagcgaagacatcttcgagaagtccgaactcattcactgggtccggcaggcccctggacagggcctggagtggatcgggtgggtgaaaacagttacgggagcggtgaactttggctctagcgatttccgccaaagagtctcccttacccgggaccgcgatctgtttacagctcatatggacattagagggctcacccagggagatacagccacctactattgtgcccggcagaagttcgaacgcggcggccaggggtggtactttgacctgtggggaagaggcacacttatcgtggtttctagc

SEQ ID NO: 42188 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgtctaccgcccatatggacattcggggacttacacaggatgacaccgccacatatagctgtgctcgccaaaaattcgccagaggcgatcagggctggtttttcgacctgtgggggcggggaaccctcatcgtggtctccagc

SEQ ID NO: 42189 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctactattgtgcccgccaaaaattcgaaagaggcgggcagggatggtactttgatctgtggggccgggggacgcttatcgtggtctcctct

SEQ ID NO: 42190 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcacagtgaactttgggtctcttaatttcagacagcgggttagcctgacccgcgatagagacctctttacagcgcacatggatattcggggactgacccaaggcgacacagctacctacttctgtgcccgccagaaatttgccagaggcgatcaggggtggttctttgacctttggggacatggcacgctgatcgtggtctcctct

SEQ ID NO: 42191 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacccctttaccgctcatatggatattcggggactgacacagggcgacaccgccacatacttctgtgcccgccaaaaatttgaaagaggcgggcagggatggtatttcgatctctggggccacgggaccctgatcgtggtctcctct

SEQ ID NO: 42192 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatatttgtggactcacacagggcgacaccgccacatacttctgcgcccggcaaaaatttgaacgcggcgggcagggatggtatttcgatctgtggggccacgggacccttatcgtggtctcctct

SEQ ID NO: 42193 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacagcgggtttccctcacgcgcgacagagatctgttcaccgcccacatggacattcggggacttacacaaggcgataccgccacatattactgtgctcgccagaaattttatgccggcgggcagggatggtacttcgacctgtggggcagagggaccctcatcgtggtctctagc

SEQ ID NO: 42194 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcaagtctgagctcattcattgggtgcggcaggcccctggccaggggctggaatggatcggatgggtgaaaacagtcacgggcgcggtgaactttgggagctccgatttccgccagagagtttctcttacccgggaccgcgatctgtttacagctcacatggacattagaggactcacccaaggcgatacagccacctacttctgtgcccggcagaagttttatgctggcgggcagggatggtacttcgacctgtggggccatgggacacttatcgtggtcagctcc

SEQ ID NO: 42195 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggaacctctgtcagagttagctgctggacatccgaagacatcttcgagcggacggaactcattcattgggtgcgccaggctcctggccaggggctggagtggatcggatgggtgaagaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaaatttgccagaggcgatcaggggtggttctttgacctgtggggacacggcacgcttatcgtggtctcctct

SEQ ID NO: 42196 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacaggatgacaccgccacatattactgtgctcgccaaaaatttgccagaggcgatcagggctggttctttgacctgtgggggcggggaaccctcatcgtggtctctagc

SEQ ID NO: 42197 - RNA, 381 nt, synthetic construct
  misc_feature 1..381: note = derived and/or modified sequence opt5 from anti-HIV-1_HeavyChain
  source 1..381: mol_type = other RNA
caggtgcaactggtccagagcggcgccgaggttaagaaacccggggcttccgtgaaggtgtcttgcaaagccagcggatacaccttcacagactattacctccactgggtcagacaggcgcctggccaggggctggattgggtgggatggatcaaccccaattccggcgggacgaactatgctcaaaagtttcagggacgggttgccatgacccgcgacacatctcttagctccgtgtacctggatctcaattctctgaccagcgccgactccggcacatatttctgtgctagacagacctttaaaccggatttctactttgccgaccagggctggagcttcaacctttgggggcaaggatctcattttattgtctccagc

SEQ ID NO: 42198 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagaagtctgaactcattcattgggtgcggcgcgcccctggccaggggctggagtggatcggatgggtgaaaacagtcacgggcgcggtgaactttgggagctccgatttcagacagcgggtttctcttacccgcgacagagatctgtttacagctcacatggacattcggggactcacccagggcgatacagccacctactattgtgcccgccaaaagttctacgctggcgggcagggatggtattttgacctgtggggcagagggacacttatcgtggtcagctcc

SEQ ID NO: 42199 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcaccgttagctgctggacatccgaagacatcttcgagaagtctgaactcattcattgggtgagacaggcccctggccaggggctggagtggatcggatgggtgaaaacggtcaccggcgcggtgaaccttgtttaccagattagcgatcgggtgtccctgacacgcgacagagggctctttaccgctcacatggatatccggggactgacacaaggcgacaccgccacatattactgtgcccgccagaagttctatgctggcgggcagggatggtactttgatctttggggcagagggaccctgattgtcgtgtctagc

SEQ ID NO: 42200 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaagcccggagcttctgtcagagttagctgctggacctccgaagacatcttcgagggctctgaactcattcattgggtgcggcaggcccctgggcagggactggagtggatcggctgggtgaagacagtcacgggggcggtgaactttggaagcgcttacttccgccacagagtttcccttacccgggatcgcgacctgtttacagcccatatggatattagaggcctcacccagggcgacacagccacctatttctgtgctcggcaaaaattttacaaagggggacagggctggtatttcgatctgtgggggcacggaacacttatcgtggtctctagc

SEQ ID NO: 42201 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactacgggtctcttaattttagaagccggatttccctgacacgcgatagagacctcttcaccgctcacatggatatccggggactgacagaaggcgacaccgccacatatttttgtgcccgccagaaattctacgctggcgggcaaggatggtattttgatctttggggccatgggaccctgattgttgtgtctagc

SEQ ID NO: 42202 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtctctggcgcggtgaactttgggagcccgaatttcagacaccgggtttcccttacccgcgatagagacctgtttacagctcatatggatattcggggactcacccagggcgacatggccacatacttctgtgcccgccaaaaatttgaaagaggcgggcagggatggtatttcgatctgtggggccacgggacccttatcgtggtctctagc

SEQ ID NO: 42203 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaaggaacccggaacctctgtcagagttagctgctggacatccgaggacatcttcgaacggacggagctcattcattgggtgcgccaggctcctggccaggggctggaatggatcggatgggtgaaaaccgtcacaggcgccgtgaactttgggtctccgaatttcagacaccgggttagccttacccgcgatagagacctgtttacagcgcatatggatattcggggactcacccagggcgacacagctacctacttctgtgcccgccaaaagtttgagagaggcgggcagggatggatcttcgatctgtggggccgggggacgcttattgccgtgtcctct

SEQ ID NO: 42204 - RNA, 375 nt, synthetic construct
  misc_feature 1..375: note = derived and/or modified sequence opt5 from anti-HIV-1_HeavyChain
  source 1..375: mol_type = other RNA
caggtgcaactggagcagagcggctccggggtcaagaaactcggagcctctgttagagtgagctgctggacctccgaagacatcttcggccggacagagctgattcactgggtgcgccaggctcccgggcagggacttgaatggatcggctgggtcaaggccgtgtctggggcggttaactacggaagcctggattttagacatcgggtgtccctcacgcgcgacagagatctgttcaccgctcacatggacattcggggccttacacaagatgacaccgccacatattactgtgcccgccagaaatttgctagaggcgatcaggggtggttctttgacctgtggggacggggcaccctcatcgtcgtgtctagc

SEQ ID NO: 42205 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgacgatatcttcaagacagaactcattcattgggtgcggcaggcccctggccaggggctggagtggatcggatgggtgaaaacggtcaccggcgcggtgaactttgggtctccgaatttccgccagagagttagccttacacgggaccgcgatctgtttaccgctcacatggacattagaggactcacacaagatgacaccgccacatacttctgtgcccggcagaagtttgctcgcggcgatcagggctggttctttgacctgtgggggagaggaacccttatcgtggtctcctct

SEQ ID NO: 42206 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcgagcggacagaactcattcattgggtgcgccaggcccctggccaggggctggagtggatcggatgggtgaagacggtcaccggcgcggtgaactttgggtctccgaatttcagacaccgggttagccttacacgcgatagagacctgtttaccgctcatatggatattcggggactcacacagggcgacaccgccacatactattgtgtgcgccaaaaattcgaaagaggcgggcagggatggtactttgatctgtggggccgggggacccttatcgtcgtgtcctct

SEQ ID NO: 42207 - RNA, 375 nt, synthetic construct
  misc_feature 1..375: note = derived and/or modified sequence opt5 from anti-HIV-1_HeavyChain
  source 1..375: mol_type = other RNA
caggtgcaactggtccagagcggcgccgaggttaagaaacccggggcttccgtgaaggtgtcttgctggaccagcgaagacatcttcgagaaatccgaactcattcactgggtcagacaggcccctggacagggcctggagtggatcgggtgggtgaagacagttacgggagcggtgaactttggctctagcgatttccggcaacgcgtctcccttaccagagaccgggatctgtttacagctcatatggacattcgcgggctcacccagggagatacagccacctactattgtgccagacagaaattctacgctggcggccaggggtggtattttgacctgtggggacggggcacacttatcgtggtttctagc

SEQ ID NO: 42208 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaactcggagcttctgtcagagttagctgctggacctccgaagacatcttcgagcggacagaactgattcattgggtgcgccaggcccccggccaggggcttgagtggatcggatgggtgaaggcggtctctggcgctgtgaactacgggagcctggattttagacaccgggtttccctcacgcgcgacagagatctgttcaccgcccatatggacattcggggacttacacagggcgataccgccacatatttttgtgctcgccaaaaattctacaagggcgggcagggatggtattttgacctgtggggcagagggaccctcatcgtggtctctagc

SEQ ID NO: 42209 - RNA, 372 nt, synthetic construct
  misc_feature 1..372: note = derived and/or modified sequence opt5 from anti-HIV-1_HeavyChain
  source 1..372: mol_type = other RNA
caggcccacctggagcaaagcggctccggggtgaagaaacccggagcttctgtcagagttagctgctggacctccgaagacatcttcgagaagtctgaactcattcattgggtgcggcaggcccctggccaggggctggagtggatcggatgggtgaaaacagtcacgggcgcggtgaactttgctcaccagattagcgatcgcgtttcccttaccagagaccgggatctgttcacagcccatatggacatccgcgggctcacccaaggagatacagccacctactattgtgctagacagaagttttacgccggcggccaggggtggtatttcgacctgtggggacggggcacacttattgtggtctctagc

SEQ ID NO: 42210 - RNA, 375 nt, synthetic construct
  misc_feature 1..375: note = derived and/or modified sequence opt5 from anti-HIV-1_HeavyChain
  source 1..375: mol_type = other RNA
caggcccacctggagcaaagcggctccggggtgaagaaacccggagcttctgtcagagttagctgctggacctccgaagacatcttcggccggacagagctcattcattgggtgcgccaggcccctgggcagggactggaatggatcggctgggtgaagacggtctctggggcggtgaactttggaagcccgaatttcagacaccgggtttcccttacccgcgatagagacctgtttacagctcatatggatattcggggcctcacccagggcgacacagccacctacttctgtgcccgccaaaaatttgagagagggggacagggctggtatttcgatctgtgggggcggggaacacttatctgcgtgtctagc

SEQ ID NO: 42211 - RNA, 636 nt, synthetic construct
  misc_feature 1..636: note = derived and/or modified sequence opt5 from anti-HIV_5CIN_LightChain
  source 1..636: mol_type = other RNA
gagatcgtgctgacccagagccccggcacacaatccctctctcctggggaaagagccacgctgagctgccgggcttcccagtctgtcggaaacaataaacttgcctggtaccagcagcgcccgggccaagcgcccagactgctcatttatggggctagctcccggccttctggagttgccgaccgcttcagcggctccgggagcggaaccgattttacactgaccatctctagacttgagcccgaagacttcgccgtgtactattgtcagcagtacggccagtccctgagcacatttggccaagggaccaaagtggaggtcaagcggacagtggctgccccttctgttttcatttttcccccttccgatgaacagctcaaaagcggaaccgcttctgtggtctgcctgctgaacaatttctatccgcgcgaggccaaggtgcagtggaaagttgacaacgcgctccagtccggcaatagccaagagtccgtgacggaacaggattctaaggacagcacctactccctgagctctacacttaccctgtccaaggccgattatgagaaacacaaggtctacgcttgtgaagtgacacatcaggggctcagctctcccgtgaccaagagctttaacaga

SEQ ID NO: 42212 - RNA, 672 nt, synthetic construct
  misc_feature 1..672: note = derived and/or modified sequence opt5 from anti-HIV_5CIN_HeavyChain
  source 1..672: mol_type = other RNA
gtgcagctggtccaaagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggcagcgggggaaaacccatcggcgctttcgcccactgggggcagggaaccctggtgacagtctcttccgcgagcaccaaaggcccttctgtgtttcccctcgccccttccagcaagtctacatccgggggaaccgctgccctgggctgcctggttaaagactatttcccggaacccgtgacggtcagctggaactccggcgctctcacatctggggtgcatacctttcctgccgtgctgcaaagctccggactttacagcctgtcttccgtcgttacagtgcccagctctagcctcggcacccagacctatatttgtaatgtgaaccacaagccttccaatacaaaggtcgataaaaaggtggagccc

SEQ ID NO: 42213 - RNA, 678 nt, synthetic construct
  misc_feature 1..678: note = derived and/or modified sequence opt5 from anti-HIV_5CIL_HeavyChain
  source 1..678: mol_type = other RNA
gtgcagctggtccaaagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggcgacggggatctgggaaaacccatcggcgctttcgcccactgggggcagggaaccctcgtgacagtcagctctgcgtccaccaaaggccctagcgtgtttcccctggccccttcttccaagagcacatctgggggaaccgctgccctgggctgcctcgttaaagactatttcccggaacccgtgacggtctcctggaacagcggcgctctgacatccggggtgcatacctttcctgccgtgcttcaatctagcggactgtactccctcagctctgtcgttacagtgccctccagctctctgggcacccagacctatatttgtaatgtgaaccacaagcctagcaatacaaaggtcgataaaaaggtggagccc

SEQ ID NO: 42214 - RNA, 678 nt, synthetic construct
  misc_feature 1..678: note = derived and/or modified sequence opt5 from anti-HIV_5CIP_A-Chain
  source 1..678: mol_type = other RNA
gtgcagctggtccaaagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggctgggggtggctgggaaaacccatcggcgctttcgcccactgggggcagggaaccctcgtgacagtcagctctgcgtccaccaaaggccctagcgtgtttcccctggccccttcttccaagagcacatctgggggaaccgctgccctgggctgcctcgttaaagactatttcccggaacccgtgacggtctcctggaacagcggcgctctgacatccggggtgcatacctttcctgccgtgcttcaatctagcggactgtactccctcagctctgtcgttacagtgccctccagctctctgggcacccagacctatatttgtaatgtgaaccacaagcctagcaatacaaaggtcgataaaaaggtggagccc

SEQ ID NO: 42215 - RNA, 681 nt, synthetic construct
  misc_feature 1..681: note = derived and/or modified sequence opt5 from anti-HIV_5CIP_HeavyChain
  source 1..681: mol_type = other RNA
gtgcagctggtccaaagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggctgggggtggctgggaaaacccatcggcgctttcgcccactgggggcagggaaccctcgtgacagtcagctctgcgtccaccaaaggccctagcgtgtttcccctggccccttcttccaagagcacatctgggggaaccgctgccctgggctgcctcgttaaagactatttcccggaacccgtgacggtctcctggaacagcggcgctctgacatccggggtgcatacctttcctgccgtgcttcaatctagcggactgtactccctcagctctgtcgttacagtgccctccagctctctgggcacccagacctatatttgtaatgtgaaccacaagcctagcaatacaaaggtcgataaaaaggtggagcccaaa

SEQ ID NO: 42216 - RNA, 630 nt, synthetic construct
  misc_feature 1..630: note = derived and/or modified sequence opt5 from anti-HIV_4JKP_LightChain
  source 1..630: mol_type = other RNA
gagatcgtgctgacccagagccccgccacactctccctgtctcctggcgaaacggctattatcagctgcagaacctcccaatacgggtctcttgcctggtatcagcagcggccgggacaggcgccccgcctggtcatttacagcggctccacaagagctgccgggatccctgaccggttctctggaagccgctggggcgccgattataacctctccattagcaatctggagtctggggactttggagtttactattgtcaacagtacgagttctttggccagggcaccaaggtccaggtggatatcaaaagaacagtggctgccccctccgtgttcatctttcctcccagcgacgaacaacttaagtctgggaccgcttccgttgtgtgcctgctcaacaatttctatcctcgggaagccaaagtccagtggaaggtggataacgcgctgcagagcggaaattctcaggagtccgttacagagcaagacagcaaagattccacctactctctgagctccacgctcaccctgagcaaggccgactacgaaaagcacaaagtgtatgcttgtgaggtcacacatcagggcctttcttccccggtgaccaagagctttaaccgcggggaatgc

SEQ ID NO: 42217 - RNA, 678 nt, synthetic construct
  misc_feature 1..678: note = derived and/or modified sequence opt5 from anti-HIV_3TNN_E-Chain
  source 1..678: mol_type = other RNA
gaggtgcagctggtcgaaagcggcgggggactcgttcaacccggcgggtccctgagactttcttgcgccgctagcggattcaccttttccacatacgccatgtcttgggtgcggcaggcgcctggcaaggggctggagtgggtgagctccatcaacaattctggacgcaacacgttcagcgctgactccgtcaaaggcagatttaccattagccgggataattctaagaacacactcttcctggtgatgaatagccttcgcgccgaagacaccgccgtttattactgtgctaaagatctgagactcggcgggggatccgactattggggccaggggacactggtgaccgtctcttccgccagcacaaagggaccgtctgtgtttcccctggctccttccagcaaatccacctctggcgggacggccgcgctcggatgcctggttaaggattacttccccgagcctgtgaccgtcagctggaactccggcgcccttacaagcggcgtgcacacctttcccgctgtgctgcagtcttccgggctctatagcctgtctagcgtcgttacagtgccttcctctagccttggaacccaaacgtacatctgtaatgtgaaccataagccgtccaatacaaaagtcgacaagcgggtggaacccaaaagctgcgataagacccac

SEQ ID NO: 42218 - RNA, 705 nt, synthetic construct
  misc_feature 1..705: note = derived and/or modified sequence opt5 from anti-HIV_3BQU_B-Chain
  source 1..705: mol_type = other RNA
agaatcaccctgaaggagagcgggccccctctcgtgaaaccgacacagacgctgacccttacatgctccttctctggctttagcctgtccgacttcggagtcggcgttgggtggattcggcaaccccctggaaaggccctcgaatggctggctatcatttactctgatgacgataaacgctatagcccctcccttaacaccagactgacaatcaccaaggacacatctaaaaatcaggtggtgctcgtcatgacccgggtgagccctgttgatacggccacctacttttgtgcgcaccgcagaggccccacaaccctgttcggggtgcctattgctcggggaccggtcaacgccatggacgtgtggggccagggcatcacagttaccatctccagcacgtctacaaaggggccctccgtgtttcctctggcccccagctctaagtccaccgctggaggcgccgctgccctcgggtgcctggtcaaagattatttccctgagcccgtgacagtgagctggaatagcggagcgcttacctccggcgtccatacctttccggccgttctgcagagctccgggctctactctctgagctccgtggtgacagtcccttcttcttcccttggaacgcaaacctatacatgtaacgtgaatcacaagcccagcaacaccaaagttgacaagcgcgtggaacctaaatcttgc

SEQ ID NO: 42219 - RNA, 642 nt, synthetic construct
  misc_feature 1..642: note = derived and/or modified sequence opt5 from anti-HIV_3BQU_A-Chain
  source 1..642: mol_type = other RNA
gccctgcagctcacccaaagcccctcctctctgagcgcttccgtgggcgacagaatcacaattacgtgccgggcctctcagggggtcaccagcgcgcttgcttggtaccgccagaagcctggatccccgccccagctgctcatctatgatgcctctagcctggagtccggcgttcctagcagattctctgggtccggaagcggcacagaatttacccttacaatttctaccctgcggcccgaggacttcgccacatactattgtcaacagctccacttttaccctcataccttcgggggaggcacgcgcgtggatgtgagacggaccgtcgctgccccctccgtgtttatcttccctccgagcgacgaacagctgaaatctggcacagcttccgttgtgtgcctgctcaacaatttttatccccgcgaggccaaggtccagtggaaagtggataacgcgctgcaaagcggaaattcccaggaatctgttaccgagcaggacagcaaggattccacatacagcctttcttccaccctgacgctcagcaaagccgactatgagaagcacaaggtgtacgaatgtgaggtcacacatcaggggctgtctagccctgtgaccaaatccttcaacagaggcgaatgc

SEQ ID NO: 42220 - RNA, 387 nt, synthetic construct
  misc_feature 1..387: note = derived and/or modified sequence opt5 from anti-HIV_IgG_VR-Chain
  source 1..387: mol_type = other RNA
atggagacccccgcccagctcctgttcctgcttctgctctggctgcctgacacaacgggcgaaatcgtgcttacccaaagcccggggacactgtccctctctgctggagagagagccaccctgagctgccgggcgtcccagtctgtcagctcccgctacctggcttggtatcagcagaagcccggccaagcccctagactcctgatttacggggcctctagccgggctacaggaatccccgatcgcttttccggcagcgggtctggaaccgacttcacacttaccatttccagagttgaacctgaggattttgccggctattactgtcagcagtatgacaacagcgtgtgcacgttcggccaggggaccaaactggaaatcaagcgg

SEQ ID NO: 42221 - RNA, 348 nt, synthetic construct
  misc_feature 1..348: note = derived and/or modified sequence opt5 from anti-HIV_IgG_HeavyChain
  source 1..348: mol_type = other RNA
atgaagcacctgtggttctttctcctgcttgtggccgctcccagatgggtcctgagccaggttcaactccaggagtccggccctgggctggtgaaaccgtctgaaacccttagcctgacatgcacggtgtccggaggctctatcagctcccattactggtcttggattcggcagagccccgggaagggactccagtggatcggctatatttactattccgggagcaccaactactctccttccctgaaaagccgcgtcacaatctctgtggagacctccaagaatcaattcagcctgaaactcacatctatgaccgccgcggacacagctgtttattactgtgccaga

SEQ ID NO: 42222 - RNA, 714 nt, synthetic construct
  misc_feature 1..714: note = derived and/or modified sequence opt5 from anti-HIV_4P9M_HeavyChain
  source 1..714: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagaacctgacatccgatgacaccgccgtctatttctgtacaaccacaagcacctacgataaatggtctggacttcatcacgacggcgtgatggccttttccagctggggccaagggacgctgatctctgtttccgctgccagcaccaagggaccttccgtgttccccctcgctccttctagcaagtccacaagcggcgggaccgccgcgctgggatgcctggtcaaagattattttcccgaacctgtgacagtgtcttggaactccggcgccctcaccagcggggtccatacgttcccggctgttctgcagtctagcggactttactccctgtctagcgtggtgacagtcccctccagctctctcggcacccagacatatatctgtaatgtgaatcacaagccttccaacaccaaagttgacaagcgggtggagcccaaaagctgcgataagacc

SEQ ID NO: 42223 - RNA, 645 nt, synthetic construct
  misc_feature 1..645: note = derived and/or modified sequence opt5 from anti-HIV_4P9M_LightChain
  source 1..645: mol_type = other RNA
gacatccagatgacccaaagcccctccacactgtctgccagcattggcgatacggtgagaatctcctgccgggcttctcagagcattaccgggaactgggtcgcctggtaccagcagcgccctggaaaggcgccgagactcctgatctatcggggcgctgcccttctcgggggagttccctcccgcttctctggcagcgccgctgggacagactttaccctgacaattggaaatctgcaagccgaggatttcggcaccttttactgtcagcagtatgacacataccctggcaccttcgggcagggaacgaaagtggaagtgaagagaaccgtcgctgccccctccgtgtttatcttccctcccagcgatgagcaacttaaatctggcacagcgtccgttgtgtgcctgctcaacaatttttatcctcgggaagccaaggtccagtggaaagtggacaacgctctgcagagcgggaatagccaggagtccgttaccgaacaagatagcaaggactctacatactccctgagctccaccctcacgctgtctaaggccgattatgagaaacacaaggtgtacgcttgtgaggtcacacatcagggacttagctccccggtgaccaaatctttcaaccgcggcgaatgc

SEQ ID NO: 42224 - RNA, 558 nt, synthetic construct
  misc_feature 1..558: note = derived and/or modified sequence opt5 from anti-HIV_4P9H_C-Chain
  source 1..558: mol_type = other RNA
aagaaagtggtcctgggcaagaaaggggacaccgttgaactcacatgcacggccagccagaagaaatccatccaattccactggaagaactctaatcagattaagatcctgggaaaccagggcagctttcttaccaaagggccctccaagctgaatgatagagctgactctcggcgcagcctctgggatcagggaaacttccctctgattatcaaaaatcttacaattgaagactccgatacctacatctgtgaggtggaagaccaaaaggaggaagtgcagctgctcgtctttggcctgacagccaactctgatacccatctgctccaggggcagagcctgacacttaccctggagtccccgcccggaagctctccttccgtgcaatgcagaagcccccggggcaaaaatatccagggcgggaagacgctctctgtttcccagctggagcttcaggacagcggaacctggacatgtaccgtgctgcaaaaccagaagaaagtcgagttcaagattgatatcgtggttctcgcgtttcagaaagctattgacggccgc

SEQ ID NO: 42225 - RNA, 462 nt, synthetic construct
  misc_feature 1..462: note = derived and/or modified sequence opt5 from anti-HIV_4YBL_A-Chain
  source 1..462: mol_type = other RNA
gtgcccgtctggaaggacgccgataccacactgttctgcgctagcgacgccaaagcgcacgagacggaatgtcataacgtttgggctacccacgcctgcgtgcctacagatccgaatccccaggagatccatctcgaaaacgtgaccgagaattttaacatgtggaagaataacatggtcgaacaaatgcaggaggacgtgatttccctgtgggatcagtgtcttcagcctggcggggcccccaaaatctctttcgaccctattcccatccactactgcacccctgctggatatgttattctgaagtgtaatgataaaaactttaatggcacagggccgtgcaagaacgtgagctccgtccaatgtacacatggaatcaagcccgtggtttctagcggcgggggaaatatcaaagacaactggagatccgagctctacaagtataaagtggtccagattgaa

SEQ ID NO: 42226 - RNA, 1056 nt, synthetic construct
  misc_feature 1..1056: note = derived and/or modified sequence opt5 from anti-HIV_4R4N_V-Chain
  source 1..1056: mol_type = other RNA
atctggaaggacgccaacaccacactgttctgcgctagcgatgccaaagcgtacgacacggaggtgcacaatgtctgggctacccatgcctgtgttcccacagatccttccccgcaggaactcaagatggagaacgtgaccgaagagtttaatatgtggaaaaacaatatggtggaacaaatgcacacagacattatctctctgtgggatcagagccttaagccctgcgtccagctgaccggcgggtccgccctcacacaggcttgtcctaaagtgaccttcgagcccattcctatccattattgcgcccccgctggatacgccattctgaagtgtaacgacaaggagtttaatggcacggggctttgcaaaaacgtttctaccgtgcaatgtacacacggaatcagacctgtcgtgagcacccagctgctcctgaatggctccctggcggaagggaaggttatgatccggtctgagaacattacaaataacgtgaaaaatatcattgtccagctcaacgaaagcgtgaccatcaattgcacgcgcccgaacaacggaggctccggcagcgggggagatattagacaggcccattgtaatgtgtctggctcccaatggaacaagacactgcaccaggtcgttgagcagcttcggaaatattggaataacaataccatcattttcaactctagctccgggggagacctggagatcacaacccacagctttaattgcggcggggagttcttttactgtaacacctctggactcttcaattccacatgggtgaacggcacggctagcatcgaaaatggcaccattacactgccctgccgcatcaagcagattatcaacatgtggcaaagagtggggcaggccatttatgctcctcccatccagggagtcatccggtgcgtgtccaatattaccggccttatcctgacacgcgatgggggaggcaactctaatgaaaacgagacctttagacctgggggaggcgacatgcgggataactggcgcagcgaactctacaagtataaagttgtgaagattgag

SEQ ID NO: 42227 - RNA, 1065 nt, synthetic construct
  misc_feature 1..1065: note = derived and/or modified sequence opt5 from anti-HIV_4JKP_G-Chain
  source 1..1065: mol_type = other RNA
gtgtggaaggacgccgataccacactgttctgcgctagcgacgccaaagcgcacgagacggaatgtcataacgtctgggctacccacgcctgcgttcccacagatcctaatccgcaggagatccatctcgaaaacgtgaccgagaattttaacatgtggaagaataacatggtggaacaaatgcaggaggacgtcatttccctgtgggatcagtgtcttcagccctgcgtgaaactgacaggcgggtctgttatcaagcaagcctgtcctaaaattagcttcgaccccatccctattcactactgcacccccgctggatatgtgatcctcaagtgtaatgataagaactttaatggcacagggccttgcaaaaacgtctcctctgtgcagtgtacccatggaatcaagccggttgtgagcacgcagctgcttctgaatggctccctcgccgaggaagagattatcattagatctgaaaacctgaccaataacgctaaaacaatcattgtccacctgaataagagcgtggagatcaactgcacccggccctccaacgggggaagcggctctggcggggacattcgcaaagcctactgtgagatcaatggaacaaagtggaacaaggtgctcaaacaggtcaccgaaaagctgaaagagcacttcaataacaagacgatcatttttcaacctccctccggcggggatcttgaaatcacaatgcatcacttcaattgcagaggagagtttttctattgcaacaccacacagctgtttaataacacctgtattggcaatgaaaccatgaaagggtgcaacggaacaatcacgctcccttgtaagattaaacagatcatcaatatgtggcagggcaccggccaagcgatgtacgctcccccgattgacgggaagatcaactgcgttagcaatattacaggaatcctgcttacccgggatggcggggccaacaatacatctaacgagaccttccgccctggaggcgggaacattaaggacaattggagatccgagctgtataaatacaaggtggtgcagatcgaaggaagc

SEQ ID NO: 42228 - RNA, 723 nt, synthetic construct
  misc_feature 1..723: note = derived and/or modified sequence opt5 from anti-HIV_3BQU_D-Chain
  source 1..723: mol_type = other RNA
atgggctggagctggatcttcctgtttctcctgtccgggaccgccggagtgcactctggcgtccagcttcaacagagcgggcccgagctggttaagcctggagcttccgtgaaaatgtcttgcaaggccagcggctactccttcacagactattttatgcattgggtgaaacagtctcacggaaagagcctcgattggattgggtacatcaactgttatacgggcgcgaccaattactcccagaaattcaagggcaaggctacatttaccgtcgacacaagctctaacaccgcctatatgcaattcaattccctgacaagcgaagattctgccgtgtactattgcgctagaacctccattgggtacggaagctctccgccctttccttactggggccaggggacgcttgttaccgtgtccgccgctaaaacaacaccccctagcgtctatcccctggcccctggatccgcggcccagaccaactctatggtgaccctcggctgtctggttaaggggtacttcccggagcccgtgacggtcacatggaatagcggatccctgagctctggcgtgcatacctttcctgctgtgctccagtccgacctgtatacacttagctctagcgtcaccgttccctcctctcctcggcccagcgaaaccgtgacatgcaacgtggcccacccggcttccagcacgaaagtcgataagaaaatcgtgcctcgc

SEQ ID NO: 42229 - RNA, 699 nt, synthetic construct
  misc_feature 1..699: note = derived and/or modified sequence opt5 from anti-HIV_3BQU_C-Chain
  source 1..699: mol_type = other RNA
atgaccatgttcagcctggccctcctgctttccctgctcctgctttgcgtgtctgacagcggcgctgagacaacggtcacccagtcccccgcctctctgagcatgtccatcggggaaaaggttacaattagatgtatcacctctacagatattgacgatgacatgaactggtaccaacagaaacctggagagccgccccggctcctgatcagcgatggcaataccctgcgccctggggtgccctccagattttctagctccggatatggcacagacttcgtgtttaccattgaaaacatgctcagcgaggatgtcgcggactactattgcctgcagtctgataatcttccttacacgttcgggggaggcaccaacctggaaatcaagcgggctgacgccgcccccacagtgtccatctttcctccgagctctgagcagctcacctccggcggggctagcgttgtgtgtttcctgaataacttttatcccaaagatattaatgtcaagtggaaaatcgacggatccgagcgccaaaacggcgtgcttaattcttggacagatcaggacagcaaggactccacctacagcatgtcttccacgctgacactcaccaaggatgaatatgagagacacaacagctacacatgcgaagccacccataaaacctctacaagccctattgttaagtccttcaatcgg

SEQ ID NO: 42230 - RNA, 333 nt, synthetic construct
  misc_feature 1..333: note = derived and/or modified sequence opt5 from anti-HIV_Ig_LightChain
  source 1..333: mol_type = other RNA
gacgtggtcctgacccagagccccgcctccctcgctgtttctctgggccaaagagccacaatcagctgcaaggcgtcccagtctgtggattacgacggggatagctatatgaactggtaccagcagaaacctggacaaccgcccaagctgcttattcacgctgcctccaatctcgtgtctggcatgcctgcccggttcagcgggtccggaagcggcacggactttaccctgaacatccatcccgtcgaggaagaggatgctgccacatattactgtcagcagtctattgaagaccctcccaccttcgggggaggcacaaaacttgagatcaag

SEQ ID NO: 42231 - RNA, 342 nt, synthetic construct
  misc_feature 1..342: note = derived and/or modified sequence opt5 from anti-HIV_Ig_HeavyChain
  source 1..342: mol_type = other RNA
gacgtgcagctgcaacagagcggccccgggctcgtcaagccttcccagtctctgagccacacatgcaccgttacgggatactccatcacctctgattatgcctggaactggattagacagttcccgggcaataaacttgagtggatggggtacatcagcttttccggatctacaagctataacccctccctcaagagccggatttctatcacccgcgacacatccaaaaatctgttctttctgcaacttaacagcgtgaccacagaagataccgctacgtactattgtgccagaggcctgcctgactactgggggcagggaaccacactcaccgtgtcttcc

SEQ ID NO: 42232 - RNA, 1083 nt, synthetic construct
  misc_feature 1..1083: note = derived and/or modified sequence opt5 from anti-HIV_4P9H_G-Chain
  source 1..1083: mol_type = other RNA
gtgtggaaggacgccgataccacactgttctgcgctagcgacgccaaagcgcacgagacggaatgtcataacgtctgggctacccacgcctgcgttcccacagatcctaatccgcaggagatccatctcgaacaagtgaccgagaactttaatatgtggaagaacaatatggtggaacagatgcaggaggacgtcatttccctgtgggatcagtgtcttcaaccctgcgtgaaactgacaggcgggtctgttatcaagcaggcctgtcctaaaattagcttcgaccccatccctattcactactgcacccccgctggatatgtgatcctcaagtgtaacgataagaattttaacggcacagggccttgcaaaaatgtctcctctgtgcagtgtacccatggaatcaagccggttgtgagcacgcagctgcttctgaacggctccctcgccgaggaagagattatcattagatctgaaaatctgaccaacaatgctaaaacaatcattgtccatctgcaaaagagcgtggagatcaactgcacccggccctccaatgggggaagcggctctggcggggacattcgcaaagcctactgtgagatccagggaacaaagtggaacaaggtgctcaaacaggtcaccgaaaagctgaaagagcacttcaacaataagacgatcatttttcagcctccctccggcggggatcttgaaatcacaatgcaccacttcaactgcagaggagagtttttctattgcaataccacacaactgtttcagaacacctgtattggcaatgaaaccatgaaagggtgcaacggaacaatcacgctcccttgtaagattaaacagatcatcaatatgtggcaaggcaccggccaggcgatgtacgctcccccgattgacgggaagatcaactgcgttagccagattacaggaatcctgcttacccgggatggcggggccaataacacatctaatgagaccttccgccctggaggcgggaacattaaggacaattggagatccgagctgtataaatacaaggtggtgcagatcgaaggaagccatcaccaccatcaccat

SEQ ID NO: 42233 - RNA, 147 nt, synthetic construct
  misc_feature 1..147: note = derived and/or modified sequence opt5 from anti-HIV_Chain
  source 1..147: mol_type = other RNA
caggtgcaactggtccagagcggcgggcagatgaagaaacccggagagtccatgagaatctcttgccgggccagcggctacgagttcattgactgtaccctcaactggatccgcctggctcctgggaagagaccggaatggatggga

SEQ ID NO: 42234 - RNA, 180 nt, synthetic construct
  misc_feature 1..180: note = derived and/or modified sequence opt5 from anti-HIV_Chain
  source 1..180: mol_type = other RNA
ccctgctgtttcgcctacatcgctagacctctgccgcgggcccacattaaggagtatttttacaccagcggcaaatgctccaaccccgcggtggtcttcgttacacgcaagaatagacaggtgtgtgctaaccctgagaaaaagtgggtgcgggaatatatcaattctctcgaaatgagc

SEQ ID NO: 42235 - RNA, 249 nt, synthetic construct
  misc_feature 1..249: note = derived and/or modified sequence opt5 from anti-HIV_Chain
  source 1..249: mol_type = other RNA
ctggagtggatgggcagaatcattcccgccatcgacgatgtgacctacgctcagacattccgggggcgcgtcacgtttagcgccgacaagttcaccacaaccgcgtatatggatctcacaggactgagatccgaagacaccgctacatacttttgcgcccgggatcctcaagttaaccgcagaggcaattgtttcgaccactgggggcagggaacccttgtgacggtgtctagcgcctccaccaaaggc

SEQ ID NO: 42236 - RNA, 270 nt, synthetic construct
  misc_feature 1..270: note = derived and/or modified sequence opt5 from anti-HIV_Chain
  source 1..270: mol_type = other RNA
gacgtggtcatgacccagagccccctgtccctccctgttacactgggccaaccggcctctatcagctgcagatcctctcagagccttgtgtactcccacggggatacgtatctgaagtgtttccagcagcggcccggacaatctcctcgcagacccatttacaaagtgagcaaccgggactccggcgtccctgatcgctttagcgggtctggatccggcaccgacttcacactcaagatcagcagagtggaggctgaagatgttggggtg

SEQ ID NO: 42237 - RNA, 294 nt, synthetic construct
  misc_feature 1..294: note = derived and/or modified sequence opt5 from anti-HIV_Chain
  source 1..294: mol_type = other RNA
agctccttcgccatctcttgggtgagacaggctcccggccaagggctggagtggatgggaggcattatccctatttttgaagccaccagctacgcgcagaagttccaggaccggctcacaatcacgaccgatgagtccacaaccacagcttatatggacctgtctagccttcgctccgaagataccgccgtctactattgcgccagagctcagggggacattctgacagagggatactttgattattggggccaagggaccctcgttacggtgtctagcgcctccaccaaagga

SEQ ID NO: 42238 - RNA, 297 nt, synthetic construct
  misc_feature 1..297: note = derived and/or modified sequence opt5 from anti-HIV_Chain
  source 1..297: mol_type = other RNA
aacaccttcacaagccactacgtgcattgggtcagacaggcccccggccaagggctggagtggatgggaatgatcaatcctggcgggacgacccggtatgctccgaagtttcaggaccgcgttacactcaccagagatacatccacccggacagtgtacatggaactgcgctctcttagaagcgaggacaccgccgtgtattactgcgcgcggccccagtataacctgggacgcgaacctctcaatgtctggggccaggggacgatggtgaccgtttcctctgctagcacaaaagga

SEQ ID NO: 42239 - RNA, 297 nt, synthetic construct
  misc_feature 1..297: note = derived and/or modified sequence opt5 from anti-HIV_Chain
  source 1..297: mol_type = other RNA
atccggagcttctactggcactggattagacagtcccccggcaaggggctggagtggctcggatctgtgtttgacaacggcctgaccacacataatcctagccttaaatcccgcctgacgatctctgaagatccgagcagaaaccaaatttccctcaagctgcggtctatgaccgccgctgacacagccgtctattactgcgcgcgcggggattatgacatccttaccagctcctaccagttcgattattggggacagggcacactggttgctgtgagctctgcctccaccaaaggg

SEQ ID NO: 42240 - RNA, 300 nt, synthetic construct
  misc_feature 1..300: note = derived and/or modified sequence opt5 from anti-HIV_Chain
  source 1..300: mol_type = other RNA
cagagcgccctgacccaacccgctttcgtgtccggctctcctgggcagagcatcacactctcctgcacgctgggaaccgaggacgtctcttggtaccagcagagaccgaacagcgcgccccggcttattatctttgatgttaagaaacgcccttccgacgtgtctgatagattcagcggccacaattccgacacagccgcttttctgaccattagcgaactccggcccgaggatgaagccgactatttctgtacatcttggccttaccgctttgatagagggaccaaggtggacgtcgcc

SEQ ID NO: 42241 - RNA, 300 nt, synthetic construct
  misc_feature 1..300: note = derived and/or modified sequence opt5 from anti-HIV_Chain
  source 1..300: mol_type = other RNA
cagagcgccctgacccaacccgctttcgtgtccggctctcctgggcagagcatcacactctcctgcacgctgggaaccgaggacgtctcttggtaccagcagagaccgaacagcgcgccccggcttattatctttgatgttaagaaacgcccttccgacgtgtctgatagattcagcggccacaattccgacacagccgcttttctgaccattagcgaactccggcccgaggatgaagccgagtatttctgtacatcttggccttaccgctttgggagaggaaccaaggtggacgtcgcc

SEQ ID NO: 42242 - RNA, 300 nt, synthetic construct
  misc_feature 1..300: note = derived and/or modified sequence opt5 from anti-HIV_Chain
  source 1..300: mol_type = other RNA
cagagcgccctgacccaccccgctttcgtgtccggctctcctgggcaaagcatcacactctcctgcacgctgggaaccgaggacgtctcttggtaccagcagagaccgaacagcgcgccccggcttattatctttgatgttcgcaagagaccttccgaagtgtctgaccggttcagcggccataaatccgatacagccgcttttctgaccattagcgacctccgccccgaggatgaagccgagtatttctgtacatcttggccttacagatttgaccgggggacccgcctggatgtggcc

SEQ ID NO: 42243 - RNA, 300 nt, synthetic construct
  misc_feature 1..300: note = derived and/or modified sequence opt5 from anti-HIV_Chain
  source 1..300: mol_type = other RNA
cagagcgtgctgacccaacccgccttcgtctccggctctcctgggcagagcatcacaatttcctgcacggttggaaccacagacgtgtcttggtaccagcagagaccgaacagcgctccccggctcatcatttttgatgtgaagaaacgcccttccggcgtctctgacagattcagcgggtccagctctgataatgccgcgtttctgaccatcgctggacttcggcccgaggacgaagccgagtattactgtacatcctggccttatcgcttcggcagagggaccaaggtggatgttgga

SEQ ID NO: 42244 - RNA, 300 nt, synthetic construct
  misc_feature 1..300: note = derived and/or modified sequence opt5 from anti-HIV_Chain
  source 1..300: mol_type = other RNA
cagagcgtgctgacccaacccgccttcgtctccgcttctcctggccagagcatcacactctcctgcaacctggggacggactacgtttcttggtatcagcagagaccgagctccgcgccccggcttattatctttgatgtgaagaatcgcccttctggagtgagcgacagattctccggctacaacagcgataccgccgcttttctgacaatttctgggctccaacccgaggacgaagccgagtattactgtacctcctggccttataatttcggacccggcacaaaagtcgatgtgacc

SEQ ID NO: 42245 - RNA, 300 nt, synthetic construct
  misc_feature 1..300: note = derived and/or modified sequence opt5 from anti-HIV_Chain
  source 1..300: mol_type = other RNA
cagagcgtgctgacccaacccgcctccgtctctggcagccctgggcagtccatcaacatttcttgcgctggaagaagcgaccgggtttcctggtaccagcagcgcccgaatggcgtgcccaagctcctgcttttcgatgtgtatagacggccttctggggtcagcgaccgcttttccggaagccactctgatgacacagccttcctgacgatctccggcctccaaaccgatgacgaggcggattactattgtacaagccatccctacgcttttgggcctggaaccaaagtgaacgttctg

SEQ ID NO: 42246 - RNA, 300 nt, synthetic construct
  misc_feature 1..300: note = derived and/or modified sequence opt5 from anti-HIV_Chain
  source 1..300: mol_type = other RNA
cagagcgtgctgacccaacccgccttcgtctccggctctcctgggcagagcatcacactctcctgcacgctgggaaccgaggacgtttcttggtaccagcagagaccgaacagcgctccccggcttattatctttgatgtgaagaaacgcccttccgacgtgtctgatagattcagcggccacaattccgacacagccgcgtttctgaccattagcgaactccggcccgaggatgaagctgagtatttctgtacatcttggccttaccgctttgggagaggaaccaaggtcgacgtggcc

SEQ ID NO: 42247 - RNA, 306 nt, synthetic construct
  misc_feature 1..306: note = derived and/or modified sequence opt5 from anti-HIV_Chain
  source 1..306: mol_type = other RNA
cagagcgccctgacccaacccgcttccgtgtctggcagccctgggcagtccatcacaatttcttgcacggccgacagcgattacgtctcctggtatcagcagagaccgaactctgcgcccaagctcatcctgttcgacgttaatagccggccttccggagtgagcgatcgctactctggctccagaagcgggaacaccgcttctcttacaatttccggactgcaacgggaggacgaagccgattatttttgtaccccctggccttacgacttccgccccggcacaagagtgtttgtcctcgggcag

SEQ ID NO: 42248 - RNA, 306 nt, synthetic construct
  misc_feature 1..306: note = derived and/or modified sequence opt5 from anti-HIV_Chain
  source 1..306: mol_type = other RNA
cagagcgccctgacccaacccgctttcgtgtccggctctcctgggcagagcatcacactctcctgctctctgggaacggccgacgtcagctggtaccagcagagaccgaactccgcgccccggcttattatctttgatgttaagaaacgcccttctgacgtgagcgatagattctccggccacaatagcgacaccgctgcctttgtgacaatttctgagctgcggcccgaagatgaggccgaatatttctgtacctcctggccttaccgctttgggcccggaacaaaggtcgacgtggctagacaa

SEQ ID NO: 42249 - RNA, 306 nt, synthetic construct
  misc_feature 1..306: note = derived and/or modified sequence opt5 from anti-HIV_Chain
  source 1..306: mol_type = other RNA
cagagcgtgctgacccaacccgcctccgtctctggcagccctgggcagacaatctccatttcttgcagcggaacgttcggctccgactctgttagctggtaccagcagtttccgaactccgctcccaccctcatcattttcgatgtgcacagacggcctagcgggatctctacacgcttttccggaagcacctctggcgacacagcctccctgaccattagcacacttcatagagaggatgaagcgttctattactgtacctctcacccctatgactttgggggaggcacgtacgtgatcgtcctg

SEQ ID NO: 42250 - RNA, 306 nt, synthetic construct
  misc_feature 1..306: note = derived and/or modified sequence opt5 from anti-HIV_Chain
  source 1..306: mol_type = other RNA
cagagcgtgctgacccaacccgcctccgtctctggcagccctgggcagacaatctccatttcttgcagcggaacgttcggctccgactctgttagctggtaccagcagtatccgaactccgctcccaccctcatcatttttgatgtgcacagacggcctagcgggatctctacacgcttctccggaagcacctctggcgacacagcctccctgaccattagcacacttcatagagaggatgaagcgtactattactgtacctctcacccctatgactttgggggaggcacgtacgtgatcgtcctg

SEQ ID NO: 42251 - RNA, 306 nt, synthetic construct
  misc_feature 1..306: note = derived and/or modified sequence opt5 from anti-HIV_Chain
  source 1..306: mol_type = other RNA
cagagcgccctgacccaacccgcttccgtgtctggcagccctgggcagtccatcaacatttcttgcgccggaagaagcgaccgggtctcctggtaccagcagcgcccgaatggcgttcccaagctcctgatgttcgatgtgtatagacggccttctggggtgagcgaccgcttttccggaagccactctggcgatacagcgttccttacgatctccgggctgcaaaccgaggacgaagctgattactattgtacaagccatccctacgcctttggagccggcaccaaagtcaacgtgctcagacag

SEQ ID NO: 42252 - RNA, 306 nt, synthetic construct
  misc_feature 1..306: note = derived and/or modified sequence opt5 from anti-HIV_Chain
  source 1..306: mol_type = other RNA
gacatccagatgacccaaagcccctcctctctgagcgcctccgtgggcgatagagtctctattcactgccaggctgggcagggaatcggcagctccctcaactggtaccagcaaaagcctgggcgggccccgcgcctgcttgttcatggagcgtctaatctgcagagaggcgtgcccagccggttctccgggagcggatttcacacaacgttcaccctcacaatttcttccctgcagcctgacgatgtggctacctattggtgtgccgcccttgagtttttcggccccggcacaaaagtcgaaatc

SEQ ID NO: 42253 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcagcccgaggatatcgcgacctacttttgtcaggtgtatgagttcgtggtccctgggacaagacttgacctgaaacggaccgtggct

SEQ ID NO: 42254 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaagaggggttccggcgcggttctctggacgcagatggggccaagaatataacctcacaattaataacctgcagcccgaggatgtggctacctacttttgtcaggtgtatgagttcatcgtccctgggacacggcttgacctgaaacgcaccgtggcc

SEQ ID NO: 42255 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaagaggggttccgtctcggttcagcggacgcagatggggccaagaatataacctcacaattaataacctgcagcccgaggatatcgcgacctacttttgtcaggtgtatgagttcgctgtgcctgggacacggcttgacctgaaacgcaccgtcgcc

SEQ ID NO: 42256 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcaggcggaggatatcgctacctacttttgtcaggtgtatgagttcgccgtgcccgggacaagacttgacctgaaacggaccgtcgcc

SEQ ID NO: 42257 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcagcccgaggatatcgcgacctacttttgtcaggtgtatgagttcattgtgcctgggacaagacttgacctgaaacggaccgtcgct

SEQ ID NO: 42258 - RNA, 309 nt, synthetic construct
  misc_feature 1..309: note = derived and/or modified sequence opt5 from anti-HIV_Chain
  source 1..309: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaacaggggttccgtctagattcaccggacggcgctggggccaagaatataacctcacaattaataacctgcagcccgaggatatcgcgacctacttttgtcaggtgtatgagttcattgtgcctgggacaagacttgacctgaaacggaccgtcgct

SEQ ID NO: 42259 - RNA, 312 nt, synthetic construct
  misc_feature 1..312: note = derived and/or modified sequence opt5 from anti-HIV_Chain
  source 1..312: mol_type = other RNA
gacatccagatgacccaaagcccctcctctctgagcgcctccgtgggcgataaggtcacaattacgtgccagacctctgctgggtacctcaactggtatcagcagagacggggacgcgcccctaaactgcttatgtacgacggcagcagactggttacaggggtgccgtcccggttctctggacgcagatggggcacccaatataatctcacaatcgggagcctgcagcccgaggatgtggcgacctactattgtcaggtctacgaatttttcggacctggcacacggcttgacctgaagcgcaccgtggct

SEQ ID NO: 42260 - RNA, 312 nt, synthetic construct
  misc_feature 1..312: note = derived and/or modified sequence opt5 from anti-HIV_Chain
  source 1..312: mol_type = other RNA
gacatccagatgacccaaagcccctcctctctgagcgcctccgtgggcgataaggtcacaattacgtgccagacctctgctgggtacctcaactggtatcagcagagacggggacgcgcccctaaactgcttatgtacgacggcagcagactggttacaggggtgccgtcccggttctctggacgcagatggggcacccaatataatctcacaatcgggagcctgcagcccgaggatattgcgacctactattgtcaggtgtacgaatttttcggacctggcacacggcttgacctgaagtccaccgtcgct

SEQ ID NO: 42261 - RNA, 312 nt, synthetic construct
  misc_feature 1..312: note = derived and/or modified sequence opt5 from anti-HIV_Chain
  source 1..312: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaagaggggttccggcgcggttctctggacgcagatggggccaagaatataacctcacaattaataacctgcagcccgaggatgtggctacctacttttgtcaggtgtatgagttcatcgtccctgggacacggcttgacctgaaacgcaccgtggccgcc

SEQ ID NO: 42262 - RNA, 312 nt, synthetic construct
  misc_feature 1..312: note = derived and/or modified sequence opt5 from anti-HIV_Chain
  source 1..312: mol_type = other RNA
tgcaccgtgagcggcgggtccatcatttcttactattggaactggatcagacagagccccggaaagggcctggagtggctcgggtacattttcgacggaggccgggccaattataacccttccctgcgctctagacttacaatgagcgtcgatacgtccaaaaatcaaatctctctgaaggttaaaagcgtgaccgctgccgactccgcgatttactattgtgctcggctcgatggggaagcctttcgctactatttcgacagctggggacagggcacactggtgaccgtctcttccgccagcacaaagggc

SEQ ID NO: 42263 - RNA, 312 nt, synthetic construct
  misc_feature 1..312: note = derived and/or modified sequence opt5 from anti-HIV_Chain
  source 1..312: mol_type = other RNA
gtgagcggcgggagattctccaactacggactgtcttgggtccggcaggcccccggccaagggctcgagtggatgggacgcatcgttcctgctattaatagagccaagtatgcgcagaaatttcagggccgggtgatcctgaccgctgacaagattacagatacggcctacatggaacttcgcagcctgagatccgaggacaccgccatcttctattgcgctcgggatccgcagattgaaatccgcgggaacgcctttgacatctggggacaaggcacagtggtcaccgtgtctagcgcttccacaaaaggc

SEQ ID NO: 42264 - RNA, 315 nt, synthetic construct
  misc_feature 1..315: note = derived and/or modified sequence opt5 from anti-HIV_Chain
  source 1..315: mol_type = other RNA
agcgacatctccgtggcccccggcgagaccgctagaatttcttgcggggaaaagagcctgggatcccgggccgtccagtggtaccaacaccgcgcgggccaggctccttctctcatcatttataacaatcaggatagaccgagcgggatccccgagcggttctccggatctcctgacagcccctttggcacaacggccaccctgacaattacctccgttgaagccggggatgaggctgactactattgtcatatctgggatagccgcgtgcctacaaaatgggtgttcggaggcggcaccacacttaccgtcctg

SEQ ID NO: 42265 - RNA, 315 nt, synthetic construct
  misc_feature 1..315: note = derived and/or modified sequence opt5 from anti-HIV_Chain
  source 1..315: mol_type = other RNA
agctccatgtctgtgagccccggcgagaccgccaagatctcctgcgggaaagaatctattggaagcagagctgtccagtggtaccaacagaagtccggccagcctccgtctctgatcatttataacaatcaggaccggcccagcggggttcctgagcgcttctccgccacacccgattttggagcgggcacgaccgctacactcaccatcacaaacgtggaagccgacgatgaggccgactactattgtcacatttacgatgctagagggggaaccaattgggtgttcgaccggggcgccacactgaccgtcctt

SEQ ID NO: 42266 - RNA, 315 nt, synthetic construct
  misc_feature 1..315: note = derived and/or modified sequence opt5 from anti-HIV_Chain
  source 1..315: mol_type = other RNA
agcttcgtgtccgtcgcccccggccagaccgctagaatcacatgcggggaggaatctctgggaagccggtccgttatttggtaccaacagcgccctggccaggccccgtctctcatcatttataacaataacgacagacccagcgggatccctgagcggttttccggatctcccggcagcacgttcgggaccacagcgaccctgacaattacctccgtggaagctggagatgaggccgactactattgtcacatctgggatagccgcagacctacaaattgggtgtttggcgaaggcaccacgcttaccgtcctg

SEQ ID NO: 42267 - RNA, 315 nt, synthetic construct
  misc_feature 1..315: note = derived and/or modified sequence opt5 from anti-HIV_Chain
  source 1..315: mol_type = other RNA
agcttcgtgtccgtcgcccccggccagaccgctagaatcacatgcggggaggaatctctgggaagccggtccgttatttggtaccaacagcgccctggccaggccccgtctctcatcatgtataacaatcacgacagacccagcgggattcctgagcggttttccggatctcccggcagcacgttcgggaccacagcgaccctgacaatcacctccgtggaagctggagatgaggccgactactattgtcatatttgggatagccgcagacctacaaactgggtgtttggcgaaggcaccacgcttaccgtcctg

SEQ ID NO: 42268 - RNA, 315 nt, synthetic construct
  misc_feature 1..315: note = derived and/or modified sequence opt5 from anti-HIV_Chain
  source 1..315: mol_type = other RNA
gacatccagatgacccaaagcccctcctctctgagcgcctccgtgggcgataaggtcacaattacgtgccagacctctgctgggtacctcaactggtatcagcagagacggggacgcgcccctaaactgcttatgtacgacggcagcagactggttacaggggtgccgtcccggttctctggacgcagatggggcacccaatataatctcacaatcgggagcctgcagcccgaggatattgcgacctactattgtcaggtgtacgaatttttcggacctggcacacggcttgacctgaagtccaccgtcgctgcc

SEQ ID NO: 42269 - RNA, 315 nt, synthetic construct
  misc_feature 1..315: note = derived and/or modified sequence opt5 from anti-HIV_Chain
  source 1..315: mol_type = other RNA
gacatccagatgacccaaagcccctcctctctgagcgcctccgtgggcgatagagtctctattaactgccaggctgggcagggactcggcagctccctgaattggtaccagcaaaagcctgggcgggccccgaaacttctggttcacggagcgtctaacctccagcgcggcgtgcccagcagattctccgggagcggatttcatacaacgttcaccctgacaatctcttcccttcagcctgacgatgtggctacctatttttgtgccgccttccagtggtttggccccggcacaaaggtcgagattaaacggacc

SEQ ID NO: 42270 - RNA, 318 nt, synthetic construct
  misc_feature 1..318: note = derived and/or modified sequence opt5 from anti-HIV_Chain
  source 1..318: mol_type = other RNA
tgcaccgtgagcggcgggtccatctctagcgccggatactattggacatggattagacagcaccccggcaaggggctggagttcatcggatacatttattacatcggcacgacctattacaacccttccctcaaatctcggctgacaattagcatcgacacctccaagaatcaattttctcttaaactgagctccgtcacagctgccgataccgcgatctattactgtgctcgcgactacacagccagagggcggcatttctttgattattggggacagggcgccctcgttaccgtgagctctgcttccacgaagggc

SEQ ID NO: 42271 - RNA, 321 nt, synthetic construct
  misc_feature 1..321: note = derived and/or modified sequence opt5 from anti-HIV_Chain
  source 1..321: mol_type = other RNA
agctccctgcccctctctctggcccctggcgctaccgccaagatcccgtgcggggagaaaagcagaggatcccgggcggtgcagtggtaccaacagaagcccggccaggctcctacacttattatctataacaatcaggaccgccccgccggggtctctgaaagatacagcggaaaccctgatgttgccattggcgtgacggctaccctgacaatctcccgggtggaggccggggacgaagctgagtattactgtcactattgggattctcgcagccccatttcctgggtcttcggaggctggacccaactcacagtgctg

SEQ ID NO: 42272 - RNA, 321 nt, synthetic construct
  misc_feature 1..321: note = derived and/or modified sequence opt5 from anti-HIV_Chain
  source 1..321: mol_type = other RNA
agctccctgcccctctctgtggcccctggcgctaccgccaagatcgcgtgcggggagaaatccttcgctagcagagccgtccagtggtaccaacagaagccgggacaggcccccgttctgattatctataacaatcaggaccggcctgctggcgtgtctgaacgctttagcgggacacccgatgtgggattcggctccacggccacccttacaatttctagagtcgaggctggggacgaagccgattactattgtcacaaatgggacagccggtcccctctgagctgggtgtttggaggcggcacccaactcacagttctg

SEQ ID NO: 42273 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccattggcgatagagtgacaatcacgtgccgggcttctcaggacattgccaactacctcaattggtatcagaagaaaagcgggacccctccgaagctgcttatcttcgcggctacaaacctgcaccgcggagtctcccccagatttaccggctctgggcatggaacacacttcagcctcaccattacaaatgttcagcatgaggattttggcaactacttctgtcaacagtcctttgccaccgtggggagcttcggacagggcacgtgggtggacatccgg

SEQ ID NO: 42274 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccattggcgatagagtgacaatcacgtgccgggcttctcaggacattgccaactacctcaattggtatcagaagaaaagcgggacccctccgaagctgcttatcttcgcggctacaaacctgcaccgcggagtctcccccagatttaccggctctgggcatggaacacacttcagcctcaccattacaaatgttcagcatgaggattttggccactacttctgtcaacagtcctttgccaccgtggggagcttcggacagggcacgtgggtggacatccgg

SEQ ID NO: 42275 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccgtgggcgatagagtcacaattacgtgccgggcttctcaggacatcgccaactacctcaattggtatcagaagaaaagcgggacccctccgaagctgcttattttcgcggctacaaacctgcaccgcggagtttcccccagattttctggcagcgggtccggaacccatttcagcctcacaatcaccaatgtgcagtacgaggattttgccaactatttctgtcaacactcttttggcacaattgggaccttcggacagggcacgtgggtggacatccgg

SEQ ID NO: 42276 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccattggcgatagagtgacaatcacgtgccgggcttctcaggacattgccaactacctcaattggtatcagaagaaaagcgggacccctccgaagctgcttatcttcggagcgacaaacctgcaccatggcgtctctccccgcttttccgggagcggacacggcacccatttctccctcacaattaccaatgttcagcacgaggattttgctaactacttctgtcaacagagctttcagacagtggggtctttcggacagggcacctgggtggacatcaga

SEQ ID NO: 42277 - RNA, 321 nt, synthetic construct
  misc_feature 1..321: note = derived and/or modified sequence opt5 from anti-HIV_Chain
  source 1..321: mol_type = other RNA
gaaatcgtgctgacccagagccccgccacactctccctgtctcctggcgaaacggctattatcagctgcagaacctcccaatctgggagccttgcctggtaccagcagcggccgggacaggcgccccgcctggtcatttattccggctctacaagagctgccgggatccctgaccggttcagcggatcccgctggggcgccgattacaacctcagcatttctaatctggagtccggggactttggagtttattactgtcaacagtatgagttctttggccagggcaccaaggtccaggtggatatcaaaagaacagtggct

SEQ ID NO: 42278 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccattggcgatagagtgaacatcacatgccaggcttctcgggacacggggagcgccctcaattggtaccagcagaaggtcggacgccctccgagactgcttatttccgcggtttctaacctgggcgctggggtgcccagccggttctccggacgcagaagcggcacccaatctacactcaccatcaatacactgcagcctgaagatattgccacctatttttgtcagcactacgagttctttgggcccggaacaaaagtggacatcaagcggaccgtcgcc

SEQ ID NO: 42279 - RNA, 321 nt, synthetic construct
  misc_feature 1..321: note = derived and/or modified sequence opt5 from anti-HIV_Chain
  source 1..321: mol_type = other RNA
gacatccagatgacccaaagcccctcctctctgagcgcctccgtgggcgatagagtcacaattacgtgccaggctgggcagggaatcggctctagcctccagtggtaccaacagaagcctgggaaagccccgaagctgcttgttcacggagcgtccaacctgcatcggggcgtgccctctcgcttcagcgggtccggatttcacaccacattcagcctcaccatttctggcctgcagagagacgattttgctacatatttctgtgccgtgcttgagtttttcggccctgggaccaaagtcgaaatcaagcggacagtggcc

SEQ ID NO: 42280 - RNA, 324 nt, synthetic construct
  misc_feature 1..324: note = derived and/or modified sequence opt5 from anti-HIV_Chain
  source 1..324: mol_type = other RNA
agctacgtgagacccctgtccgtcgccctcggcgagaccgcttctatcagctgcgggcggcaggccctgggatcccgcgcggttcaatggtatcagcacagacctggccaggctccgattcttctgatctacaacaatcaggaccggccctctgggattcctgaacgcttcagcggaacacccgatatcaactttggcacgagagccaccctcacaatttccggggtggaggccggagacgaagctgattattactgtcatatgtgggactctcggagcggcttctcctggagctttggcggggccacccgcctgacagtgctt

SEQ ID NO: 42281 - RNA, 324 nt, synthetic construct
  misc_feature 1..324: note = derived and/or modified sequence opt5 from anti-HIV_LightChain
  source 1..324: mol_type = other RNA
gacatcctgatgacccagagcccctccctcctgtctgccagcgtgggcgatagagtcacaattacgtgcaaggcttcccaagacgtttctaccgccgtggcgtggtaccagcagaaacctgggaaggctccgaaacttctgatctattgggccagcacacggcacaccggagtgccctcccgcttcacaggctctgggagcggaaccgattttacactcaccatttccagactgcaggccgaggacttcgctctttactattgtcaacagcattacacgaccccttggacatttggcgggggaaccaaggtcgaaatcaaacgg

SEQ ID NO: 42282 - RNA, 324 nt, synthetic construct
  misc_feature 1..324: note = derived and/or modified sequence opt5 from anti-HIV_LightChain
  source 1..324: mol_type = other RNA
gacatcgtgatgacccagagcccctccctgctctctgccagcgtcggcgatagagttacaattacgtgcaaggcttcccaagacgtgtctaccgccgtggcgtggtaccagcagaaacctgggaaggctccgaaactgcttatctattgggccagcacacggcacaccggagtcccctcccgcttctctggcagcgggtccggaacagattttaccctgacaattagctctctccagcctgaggacttcgccctgtactattgtcaacagcattacaccacgccctggacctttggcgggggaacaaaggtggaaatcaaaaga

SEQ ID NO: 42283 - RNA, 324 nt, synthetic construct
  misc_feature 1..324: note = derived and/or modified sequence opt5 from anti-HIV_Chain
  source 1..324: mol_type = other RNA
gacatccagatgacccaaagcccctcctctctgagcgcctccgtgggcgatacagtcacgattaactgccagaccaataaggggtacctcaactggtatcagcagagacggggacgcgctcctaaactgcttatgtacgacggctctaagctggttacaggggtgccgagcagattctccggacggcgctggggcacccaatataatctcacaatcgggtctctgcagcccgaggatattgccacctactattgtcaggtgtacgaatttttcggacctggcacaagacttgacctgaaacggaccgtcgcggctcccagcgat

SEQ ID NO: 42284 - RNA, 333 nt, synthetic construct
  misc_feature 1..333: note = derived and/or modified sequence opt5 from anti-HIV_Chain
  source 1..333: mol_type = other RNA
ctgagcgcctacgtgggcgacagagtcaccatcacatgccgggcttcccagaacattaatacgtatctcaactggtaccaacagcgccccgggaaggcccctaagctgcttatctatgcggcttctaccctgcagagcggagttccgtccagattctctggcagcgggtccggaacagattttaccctcacaatttctaatctggagaccgaagacttcgccgtgtactattgtcagcaaacatacagctccgtgacctttggccaggggacgaaacttgagacccggcgcacagtcgccgctcccagcgtgttcatctttcctccctctgat

SEQ ID NO: 42285 - RNA, 333 nt, synthetic construct
  misc_feature 1..333: note = derived and/or modified sequence opt5 from anti-HIV_Chain
  source 1..333: mol_type = other RNA
gagatcgtgctgacccagagccccgccacactctccctgtctcctggcgaaagagctacgcttagctgccgggcctcccaaggggtcaacttcgttgtgtggtaccagcagaagcgcggacaggcgccgagactgctcatttatggcaattctgaccgggtgcccggggtccctgatcgctttagcgctagaggatccggcaccgagttctctctggtgatcagctccgttgaacccgacgattttgccctttactattgtcaagagtacagctctacaccttataacttcgggcccggaacccgggtggaccgcaaaagaacagtcgccgct

SEQ ID NO: 42286 - RNA, 336 nt, synthetic construct
  misc_feature 1..336: note = derived and/or modified sequence opt5 from anti-HIV_HeavyChain
  source 1..336: mol_type = other RNA
gaggtgaagctggaagagagcggcgggggactcgtccagcccggcgggtccagaaaactgtcttgcgccgctagcggattcaccttttcctctttcggcatgcactgggttcggcaagcccctgaaaaggggcttgagtgggtggcgtacatcagctccggatctagcacactgcattatgctgacacggtgaaaggccgctttaccatttccagagataacccgaagaatacactcttcctgcagatgaaacttcccagcctgtgttacggcctcctggggtctcggaacctgtcccaccgcctcctgagccagaatgacacccctatctgcctt

SEQ ID NO: 42287 - RNA, 336 nt, synthetic construct
  misc_feature 1..336: note = derived and/or modified sequence opt5 from anti-HIV_Chain
  source 1..336: mol_type = other RNA
gagatcgtgctgacccagagccccgccacactctccctgtctcctggcgaaagagctacgcttagctgccgggcctcccaaggggtcaacttcgttgtgtggtaccagcagaagcgcggacaggcgccgagactgctcatttatggcccctctgaccgggctcctggggtgcccgatcgctttagcgccagaggatccggcaccgagttctctctggtcatcagctccgtggaacctgacgattttgccctttactattgtcaagagtacagctctacaccctataatttcgggaccggaacacgggttgaccgcaaaagaaccgtggctgcccct

SEQ ID NO: 42288 - RNA, 336 nt, synthetic construct
  misc_feature 1..336: note = derived and/or modified sequence opt5 from anti-HIV_Chain
  source 1..336: mol_type = other RNA
cagaccctgagcctcacatgctccgtgtctggcgggagcatctcctctgccggatactattggggctggattagacaacaccccgggaagggactggagtggatcggccatatttactatagcgggaacacgaattacaacccttcccttaaatctcggctgagcatgtccgtcgaaaccagcaagaatcagttctctctcaacctggcttccgttacagccgcggacaccgctgtgtatttttgtgcccgcgattacagcgccgctggaagacaccttttcgactcttggggccagggcatcctggtgacagtctccagcgcctctaccaaaggg

SEQ ID NO: 42289 - RNA, 336 nt, synthetic construct
  misc_feature 1..336: note = derived and/or modified sequence opt5 from anti-HIV_LightChain
  source 1..336: mol_type = other RNA
gacatcgtgatgacccagcaaacacccctgacgctcagcattaccatcggccagcctgcctccatttcttgcaagagctcccagtctctgcttgatagcgacgggaaaacatacctgaactggctcctgcagagaccgggacaatcccccaagcggcttatctattggatgtctaaactggatagcggcgtccctgaccgcttcaccgggtccggaagcggcacagattttaccctcaagatttctagagttgaggctgaagacctgggggtgtactattgttggcagggaacacacttcccctggacctttggcggcgggacgaaactggagctc

SEQ ID NO: 42290 - RNA, 339 nt, synthetic construct
  misc_feature 1..339: note = derived and/or modified sequence opt5 from anti-HIV_LightChain
  source 1..339: mol_type = other RNA
gacatcgtgattacccagagcacaaagttcatgtccacgtctgtcggcgatagagttagcattacctgcaaagcctcccaagacgtgtctacagctgtggcctggtaccagcagaagcccgggcagagccctaaactgctcatctattgggcgtccacccggcacacaggagtcccggatcgctttaccggctctgggagcggaacagactacaccctgacgatctccagagtgcaagctgaggatcttgccctgtattactgtcagcagcattataccacaccctggaccttcggcgggggaacaaagctcgaaattaaacggaccgttgccgctcct

SEQ ID NO: 42291 - RNA, 339 nt, synthetic construct
  misc_feature 1..339: note = derived and/or modified sequence opt5 from anti-HIV_Chain
  source 1..339: mol_type = other RNA
gacatccagatgacccaaagcccctcctctctgagcgccagagtgggcgatacagtcacgtttacctgccaggctaacgggtacctcaattggtatcagcagcggcgcggaaaggcccctaaactgcttatttacgacggctccaagctggagagaggggttccgtctcggttcagcggacgcagatggggccaagaatataacctcacaatcaataacctgcagcccgaggatattgcgacctacttctgtcaggtgtatgaatttgctgtgcctgggacacggcttgacctgaaacgcaccgtcgccgccccctccgtgttcatctttccttctgat

SEQ ID NO: 42292 - RNA, 339 nt, synthetic construct
  misc_feature 1..339: note = derived and/or modified sequence opt5 from anti-HIV_Chain
  source 1..339: mol_type = other RNA
cagagcgtgctgacccaacccgcctccgtctctggcagccctgggcagtccatcacaatttcttgcacgggaaccaacagcgacgttggctactcctatgtgtcttggttccagcagcacccggggaaggtgcccaagctcctgatctacgatgtcagcagacggtccagcggagtgtctaatcgcttttccggcagcagatctgggaacacagcttcccttaccattagcggactgcgggccgaggacgaagcggattattactgtggctctttcacaacctccctcacactggtttttggcgggggaaccaaacttgctgtgctggtcagcccttcc

SEQ ID NO: 42293 - RNA, 339 nt, synthetic construct
  misc_feature 1..339: note = derived and/or modified sequence opt5 from anti-HIV_Chain
  source 1..339: mol_type = other RNA
agcctgtccgcctctgtgggcgacagagtcaccatcacatgccgggctagcgagtccatttctttctacctcaactggtatcagcaaaagcccgggaaagcccctgaactgcttatcttcgcgacgagcaccctgcactccggagttccgtctcgcttcagcggctccgggagcggaacagattttaccctcacaatttcttccctgcagcttgaggacttcgctacctactattgtcagcagtctagctccacaccctttaccttcggcgggggaacgaaggtggaaatcaaaagaaccgtggccgcccctagcgtctttatttttcccccttctgat

SEQ ID NO: 42294 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcagcccgaggatatcgcgacctacttttgtcaggtgtatgagttcattgtgcctgggacaagacttgacctgaaacggaccgtcgctgccccctctgtgtttatcttccctcccagcgat

SEQ ID NO: 42295 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaagaggggttccgtctcggttcagcggacgcagatggggccaagaatataacctcacaattaataacctgcagcccgaggatatcgcgacctacttttgtcaggtgtatgagttcgctgtgcctgggacacggcttgacctgaaacgcaccgtcgccgccccctccgtgtttattttccctccctctgat

SEQ ID NO: 42296 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaagaggggttccgtctcggttcagcggacgcagatggggccaagaatataacctcacaattaataacctgcagcccgaggatatcgcgacctacttttgtcaggtgtatgagttcgtggtccctgggacacggcttgacctgaaacgcaccgtggctgccccctccgtttttattttccctccctctgat

SEQ ID NO: 42297 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgccagagtgggcgatacagtcacgtttacctgccaggctaacgggtacctcaattggtatcagcagcggcgcggaaaggcccctaaactgcttatttacgacggctccaagctggagagaggggttccgtctcggttcagcggacgcagatggggccaagaatataacctcacaatcaataacctgcagcccgaggatattgcgacctacttctgtcaggtgtatgaatttgctgtgcctgggacacggcttgacctgaaacgcaccgtcgccgccccctccgtgttcatctttcctccctctgat

SEQ ID NO: 42298 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatgtacgacggctctacactggaacgcggggttccggcgagattcagcggacggcgctggggccaagaatataacctcaccatcaataacctgcagcccgaggatgtggctacatacttttgtcaggtgtatgagttcattgtccctgggaccagacttgacctgaagcggacagtggccgccccctccgtttttatcttccctccctctgat

SEQ ID NO: 42299 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcaggcggaggatatcgctacctacttctgtcaggtgtatgagttcgccgtgcccgggacaagacttgacctgaaacggaccgtcgccgctccttctgtgtttatttttccccctagcgat

SEQ ID NO: 42300 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgcctccgtgggcgatacagtcacgtttacctgccaggctaacgggtacctcaattggtatcagcagagacggggaaaggcccctaaactgcttatttacgacggctctcgcctggagagaggggttccgagccggttctccggacgcagatggggccaagaatataacctcacaatcaataacctgcagcccgaggatattgcgacctacttctgtcaggtgtatgaatttgctgtgcctgggacacggcttgacctgaagcgcaccgtcgccgccccctctgtgttcatctttcctcccagcgat

SEQ ID NO: 42301 - RNA, 342 nt, synthetic construct
  misc_feature 1..342: note = derived and/or modified sequence opt5 from anti-HIV_Chain
  source 1..342: mol_type = other RNA
gacatccagatgacccacagcccctcctctctgagcgcctccgtgggcgatacagtcacgattacctgccaagctaacgggtacctcaattggtatcagcagagacggggaaaggcccctaaactgcttatctacgacggctctaagctggaaacaggggttccgagccgcttcaccggaagacggtggggccaggaatataacctcacaattaataacctgcaacccgaggatatcgcgacctacttttgtcaggtgtatgagttcattgtgcctgggacacgccttgacctgaaaagaaccgtcgctgccccctccgtgtttatcttccctccctctgat

SEQ ID NO: 42302 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgccagagtgggcgatacagtcacgattacctgccaggctaacgggtacctcaattggtatcagcagcggcgcggaaaggcccctaaactgcttatctacgacggctccaagctggaaacaggggttccgtctagattcaccggacggcgctggggccaagaatataacctcacaattaataacctgcagcccgaggatatcgcgacctacttttgtcaggtgtatgagttcattgtgcctgggacaagacttgacctgaaacggaccgtcgctgcccccagcgtgtttatcttccctccctccgat

SEQ ID NO: 42303 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgccagagtgggcgatacagtcacgtttacctgccaggctaacgggtacctcaattggtatcagcagcggcgcggaaaggcccctaaactgcttatttacgacggctccaagctggagagaggggttccgtctcggttcagcggacgcggctgggggcaagaatataacctcacaatcaataacctgcagcccgaggatattgcgacctacttctgtcaggtgtatgaatttgctgtgcctggaacaagacttgacctgaaacggaccgtcgccgccccctccgtgttcatctttcctccctctgat

SEQ ID NO: 42304 - RNA, 342 nt, synthetic construct
  misc_feature 1..342: note = derived and/or modified sequence opt5 from anti-HIV_Chain
  source 1..342: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcagcccgaggatatcgcgacctacttttgtcaggtgtatgagttcgtggtccctgggacaagacttgacctgaaacggaccgtggctgccccctctgtttttattttccctcccagcgat

SEQ ID NO: 42305 - RNA, 342 nt, synthetic construct
  misc_feature 1..342: note = derived and/or modified sequence opt5 from anti-HIV_Chain
  source 1..342: mol_type = other RNA
agccagtccgtggtcacccaagagccctctctgacagttagccctggcgggacggtgaccctcacatgcggaccgtccaccggcgccgtgacatctgggttctacccccactggtttcagcagaagcctggacaggctcccagagccctgatctatagcacctccaacaaatactcttggacccctgcgcggttcagcggctcccttctcgggggaaaggctgtcctgacactgagcgacgtgcaacccgatgacgaagccgagtattactgtcttctgctcctgtattacggcggcccttggatttttgggggaggcacgaaactgaccgttctcgtgtct

SEQ ID NO: 42306 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgataaggtcacaattacgtgccagacctctgctgggtacctcaactggtatcagcagagacggggacgcgcccctaaactgcttatgtacgacggcagcagactggttacaggggtgccgtcccggttctctggacgcagatggggcacccaatataatctcacaatcgggagcctgcagcccgaggatgtggcgacctactattgtcaggtctacgaatttttcggacctggcacacggcttgacctgaagcgcaccgtggctgccccctccgtttttattttccctcccagcgat

SEQ ID NO: 42307 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccagacaaccaaggggtacctcaactggtatcagcagagacggggacgcgctcctaaactgcttatgttcgacggctctaagctggttacaggggtgccgagcagattttccggacggcgctggggcacccaatacaatctcacaatcgggtctctgcagcccgaagatcttgccacctattactgtcaggtgtatgagttctttggacctggcacgagactggacctcaaacggaccgtcgcggctcccagcgtgttcatttttcctccctccgat

SEQ ID NO: 42308 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccagacaaacaaggggtacctcaattggtatcagcagagacggggacgcgctcctaaactgcttatgtgtgacggctctaagctggttaccggggtgccgagcagattctccggacggcgctggggcacacaatacaacctcaccatcgggtctctgcagcccgaggatattgccacatattactgccaggtgtatgaatttttcggacctggcaccagacttgacctgaaacggacggtcgcggctcccagcgtgtttatcttccctccctccgat

SEQ ID NO: 42309 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgccagagtgggcgataaggtcacaattacgtgccagacctccgctgggtacctcaactggtatcagcagcggcgcggcagagcccctaaactgcttatgtacgacggatctcggctggttacaggggtgccgagccgcttctccggaagacggtggggcacccaatataatctcacaatcgggtctctgcagcccgaggatattgcgacctactattgtcaggtgtacgaatttttcggacctggcacacgccttgacctgaagagaaccgtcgctgcccccagcgtgtttatcttccctccctccgat

SEQ ID NO: 42310 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccagacaaacaaggggtacctcaattggtatcagcagaaaagaggacgggctcctaagctgcttatgtacgacggctctaaactggttaccggggtgccgagccgcctctccggaagacggtggggcacacaatataacctgaccatcgggtctcttcagcccgaagatattgccacatactattgtcaggtgtacgagttctttggacctggcacccgcctggacctcaagagaacggtcgcggctcccagcgtgttcatctttcctccctccgat

SEQ ID NO: 42311 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccagacaaacaaggggtacctcaattggtatcagcagagacggggacgcgctcctaaactgcttatgtacgacggctctaagctggttaccggggtgccgagcagactctccggacggcgctggggcacacaatataacctgaccatcgggtctcttcagcccgaagatattgccacatactattgtcaggtgtacgagttctttggacctggcaccagactggacctcaaacggacggtcgcggctcccagcgtgttcatctttcctccctccgat

SEQ ID NO: 42312 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccacacaaacaaggggtacctcaattggtatcagcagagacggggacgcgctcctaaactgcttatgttcgacggctctaagctggttaccggggtgccgagcagattttccggacggcgctggggcacacagtacaacctcaccatcgggtctctgcaacccgaggatattgccacatattactgtcaggtgtatgaagtcttcggacctggcaccagacttgacctgaaacggacggtggcggctcccagcgtttttatcttccctccctccgat

SEQ ID NO: 42313 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattaactgccagaccaataaggggtacctcaactggtatcagcagagacggggacgcgctcctaaactgcttatgtacgacggctctaagctggttacaggggtgccgagcagattctccggacggcgctggggcacccaatataatctcacaatcgggtctctgcagcccgaggatattgccacctactattgtcaggtgtacgaatttttcggacctggcacaagacttgacctgaaacggaccgtcgcggctcccagcgtgtttatcttccctccctccgat

SEQ ID NO: 42314 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgccagagtgggcgataaggtcacaattacgtaccagacctccgctgggtatctcaactggtaccagcagcggcgcggcagagcccctaaactgcttatgtatgacggatctcggctggttacaggggcgccgagccgcttctccggaagacggtggggcacccaatacaatctcacaatcgggtctctgcagcccgaggatattgctacctattactgccaggtgtatgaatttttcggacctggcacacgccttgacctgaagagaaccgtggccgcccccagcgtctttatcttccctccctccgat

SEQ ID NO: 42315 - RNA, 345 nt, synthetic construct
  misc_feature 1..345: note = derived and/or modified sequence opt5 from anti-HIV_Chain
  source 1..345: mol_type = other RNA
gacatccagatgacccaaagcccctcctctctgagcgcctccgtgggcgatacagtcacgattacctgccagacaaacaaggggtacctcaattggtatcagcagagacggggacgcgctcctaaactgcttatgtacgacggctctaagctggttaccggggtgccgagcagattctccggacggcgctggggcacacaatataacctcaccatcgggtctctgcagcccgaggatattgccacatactattgtcaggtgtacgaatttttcggacctggcaccagacttgacctgaaacggacggtcgcggctcccagcgtgtttatcttccctccctccgat

SEQ ID NO: 42316 - RNA, 345 nt, synthetic construct
  misc_feature 1..345: note = derived and/or modified sequence opt5 from anti-HIV_Chain
  source 1..345: mol_type = other RNA
gtgaccctgagcctctcccccggcgagagagccacactgtcttgccgggctagccagacgatctccaacaattaccttgcctggtatcaacagaagcctgggcaggcgccgcgcctgctcatttacggagcttctagcggcgccaccgggctgcccgacagattctccggatctggcagcgggacagattttacccttacaatctcccggctggaacctgaggacttcgccgtctattactgtcaccagtatgctctcagcccctggacctttggacgcggcacaaaagttgaaattaagagaaccgtggccgctccttctgtgttcatctttcccccttccgat

SEQ ID NO: 42317 - RNA, 345 nt, synthetic construct
  misc_feature 1..345: note = derived and/or modified sequence opt5 from anti-HIV_Chain
  source 1..345: mol_type = other RNA
accctgagcgcctccgtgggcgacagagtcacaatcacgtgccgggcttctcagagcattaacaattacctcaactggtatcaacagaagcccgggaaagcccctaagctgcttatctacgcggcttcctctctgcagagcggagttccgtcccgcttctctggcagcgggtccggaaccgattttacactcaccattagctctctgcagcccgaggacttcgtgacatattactgtcaacagacctattccaatcctagaatgtttggccaggggacaaaagtggaaatcaagcggaccgtcgccgcccccagcgtgttcatttttcctccctctgatgagcag

SEQ ID NO: 42318 - RNA, 345 nt, synthetic construct
  misc_feature 1..345: note = derived and/or modified sequence opt5 from anti-HIV_Chain
  source 1..345: mol_type = other RNA
cagagcgccctgacccaagctccctccgcctctggcacacctgggcagagagtgacgatcagctgctccggaggcgggtctaacattggaggcaatctcgtcagctggtaccagcacttcccgggggcggctcccaagctgcttatctatcggaacgaccagcgcccttccggagttcccgatagattttctgccagcaaatccggcaccagcgcctctctggctatttccggcctccggagcgacgatgaggccacatacttctgtgctgcctatgactctaccctgtcccttcgcctgtttgggggaggcacaaccctcgcggtgctgagccaacctaaggcc

SEQ ID NO: 42319 - RNA, 345 nt, synthetic construct
  misc_feature 1..345: note = derived and/or modified sequence opt5 from anti-HIV_Chain
  source 1..345: mol_type = other RNA
aagcccagccagaccctgtccctcacatgcacggtgtctggcgggagcatctcctctgccggatactattggacctggattagacaccatcctggcaaagggctggagttcatcggatacatttatcacatcggcacaccgtactataaccccagccttaagtcccggctgaccatttctatcgacacaagcaaaaatcaattttccctcaagctgagctctgtcaccgctgccgatacagcgatctactattgtgctcgcgactacaccgccagagggcggcatttctttgattactggggacagggcgcccttgttacggtgtccagcgcttctaccaaaggc

SEQ ID NO: 42320 - RNA, 345 nt, synthetic construct
  misc_feature 1..345: note = derived and/or modified sequence opt5 from anti-HIV_Chain
  source 1..345: mol_type = other RNA
cccagcgagaccctgtccctcacatgcagagtgtctggcgccagcatctccaacttctactggacgtggattcggcagcctgctgggaagggactggaatggatcggccgcctttattctagcgacaaaaccaattacaacccgtccctgaatgggagagtcacaatgtctctcgataccagcaagaaccaattttccctgcggcttacaagcatgaccgacgccgatacagcgatttattactgtgctcgcgagaaaggacagtgggttaccctgcccccttattacttcgactcttggggccaggggatcctcgtgacggtgtccagcgcctctaccaaggga

SEQ ID NO: 42321 - RNA, 348 nt, synthetic construct
  misc_feature 1..348: note = derived and/or modified sequence opt5 from anti-HIV_Chain
  source 1..348: mol_type = other RNA
ggccccgccaccctgagcgtgtcccctggggagagagctacactctcttgccgggccagccagtccctgcgcaacaatcttgcgtggtaccaacagaagacgggacagtctccgagactgctcatctatgctgtcagcacccgggccacaggcattccccctcgcttctccgggggaggctctgggaccgaatttacactgaccatcgacagccttcagtccgaggatttcgccgtttacttttgtcaacagtatgacagcccccagtggacattcggacagggcaccaaagtggaaattaagagaacggtggctgccccttctgtctttatcttccctccctccgat

SEQ ID NO: 42322 - RNA, 348 nt, synthetic construct
  misc_feature 1..348: note = derived and/or modified sequence opt5 from anti-HIV_Chain
  source 1..348: mol_type = other RNA
gcccccgtgaccctgagcgcttccgtcggcgacacagttacgattacctgcagagcctctcagcctatcgcgacattcctcaactggtaccaacacaagccggggcaggctcccaaactgcttatctatgccgccagcacctttcagcggggagctccttcccgctactctggcagcgggtccggaacagatttcaccctgacaattaattctctccagcccgaggacctggccacctattactgtcaacagacgtttaccgatcctgtgacattcggccaggggaccagacttgaaatcaagcggacagtggctgcccccagcgtctttattttccctccgtccgac

SEQ ID NO: 42323 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggggatggctcgcctggtaccaccagcgccctggcaaggcgccgagactgcttatctatcgggggtcccgcctgctcggaggcgtcccctctagattcagcgggtccgctgccggaacagactttaccctgacaattgccaaccttcaggctgaggatttcggcaccttttactgtcaacagtatgacacataccctggcaccttcgggcagggaacgaaagttgaagtgaagcggaccgtggccgctcccagcgtcttt

SEQ ID NO: 42324 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggaactgggtcgcctggtaccagcagcgccctggaaaggcgccgagactcctgatctatcggggcgctgcccttctcgggggagttccctcccgcttctctggcagcgccgctgggacagactttaccctgacaattggaaatctgcaaaccgaggatttcggcacattttactgtcagcagtatgacacctaccctggcacgttcgggcagggaaccaaagtggaagtgaagagaacagtcgccgctccctccgtgttt

SEQ ID NO: 42325 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggaactgggtcgcctggtaccagcagcgccctggaaaggcgccgagactcctgatctatcggggcgctgcccttctcgggggagttccctcccgcttcagaggctctgccgctgggacagactttaccctgacaattggaaatctgcaagccgaggatttcggcaccttttactgtcagcagtatgacacataccctggcaccttcgggcagggaacgaaagtggaagtgaagcggaccgtcgctgcccccagcgtgttt

SEQ ID NO: 42326 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcgtgggcgatacggtcagaatttcctgccgggcttctcagagcatcaccgggggatggctcgcctggtaccaccagcgccctggcaaggcgccgagactgcttatttatcgggggtcccgcctgctcggaggcgttccctctagattcagcgggtccgctgccggaacagactttaccctgacaatcgccaaccttcaggctgaggatttcggcaccttttactgtcaacagtatgacacataccctggcaccttcgggcagggaacgaaagtggaagtgaagcggaccgtcgccgctcccagcgtgttt

SEQ ID NO: 42327 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggaactgggtcgcctggtaccagcagcgccctggaaaggcgccgagactcctgatctatcggggcgctgcccttctcgggggagttccctcccgcttctctggcagcgccgctgggacagactttaccctgacaattggaaatctgcaagccgaggatttcggcaccttttactgtcagcagtatgacacataccctggcaccttcgggcagggaacgaaagtggaagtgaagagaaccgtcgctgccccctccgtgttt

SEQ ID NO: 42328 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggggatgggtcgcctggtaccaccagcgccctggcaaggcgccgagactcctgatctatcgggggtcccgccttctgggaggcgttccctctagattcagcgggtccgctgccggaacagactttaccctcacaattggcaacctgcaggccgaggatttcggcaccttttactgtcaacagtatgacacataccctgggaccttcggacagggcacgaaagtggaagtgaagcggaccgtcgctgcccccagcgtgttt

SEQ ID NO: 42329 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcgtgggcgatacggtcagaatttcctgccgggcttctcagagcatcaccgggggatggctcgcctggtaccaccagcgccctggcaaggcgccgagactgcttatttatcgggggtcccgcctgctcggaggcgttccctctagattcagcgggtccgctgccggaacaggctttaccctgacaatcgccaaccttcaggctgaggacttcggcaccttttactgtcaacagtatgatacataccctgggaccttcggacagggcacgaaagtggaagtgaagcggaccgtcgccgctcccagcgtgttt

SEQ ID NO: 42330 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcgtgggcgggacggtcagaatttcctgccgggcttctcagagcatcaccggaggctggctcgcctggtaccaccagcgccctgggaaggcgccgagactgcttatttatcggggatcccgcctgctcggcggggttccctctagattcagcggatccgctgccggcacagattttaccctgacaatcgccaaccttcaggctgaggacttcggcaccttttactgtcaacagtatgatacataccctgggaccttcggacagggcacgaaagtggaagtgaagcggaccgtcgccgctcccagcgtgttt

SEQ ID NO: 42331 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggaactgggtcgcctggtaccaccagcgccctggaaaggcgccgagactcctgatctatcggggcgctgcccttctcgggggagttccctcccgcttctctggcagcgccgctgggacagactttaccctgacaattggaaatctgcaggccgaggatttcggcaccttttactgtcaacagtatgacacataccctggcaccttcgggcagggaacgaaagtggaagtgaagagaaccgtcgctgccccctccgtgttt

SEQ ID NO: 42332 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgatgatctcctgcagagcttctcagagcattaccgggggatggctcgcctggtaccaccagcggcctggcaaggcgccgcgcctgcttatctatagagggtccaaactgctcggaggcgtcccctctcggttcagcgggtccgctgccggaacaggctttaccctgacaattggcaaccttcaggccgaggacttcgggaccttttactgtcaacagtatgatacataccctggaaccttcggccaggggacgaaggttgaagtgaaacgcaccgtggctgcccccagcgtcttt

SEQ ID NO: 42333 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcgtgggcgatacggtcagaatttcctgccgggcttctcagagcatcaccgggggatggctcgcctggtaccaccagcgccctggcaaggcgccgagactgcttatttatcgggggtcccgcctgctcggaggcgttccctctagattcagcgggtccgctgccggagccgactttacactgaccatcgctaaccttcaggccgaggatttcggcacattttactgtcaacagtatgacacctaccctggcacattcgggcagggaaccaaagtggaagtgaagcggacggtcgctgcccccagcgtgttt

SEQ ID NO: 42334 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggggatggctcgcctggtaccaccagcgccctggcaaggcgccgagactgcttatctatcgggggtcccgcctggtcggaggcgttccctctagattcagcgggtccgctgccggaacagactttaccctcacaattggcaacctgcaggccgaggatttcggcaccttttactgtcaacagtatgacacataccctgggaccttcggacagggcacgaaagtggaagtgaagcggaccgtcgctgcccccagcgtgttt

SEQ ID NO: 42335 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggggatggctcgcctggtaccaccagcgccctggcaaggcgccgagactgcttatctatcgggggtcccgcctgctcggaggcgtcccctctaaattcagcgggtccgctgccggaacagactttaccctgacaattgccaaccttcaggctgaggatttcggcaccttttactgtcaacagtatgacacataccctggcaccttcgggcagggaacgaaggttgaagtgaaaagaaccgtggccgctcccagcgtcttt

SEQ ID NO: 42336 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcacgggcgataccgtgagaatttcctgccgggcttctcagagcatcacagggaactgggtcgcctggtaccagcagcgccctggaaaggcgccgagactcctgatttatcggggcgctgcccttctcgggggagttccctcccgcttcagaggctctgccgctgggaccgactttacactgaccatcggaaatctgcaagccgaggatttcggcacattttactgtcagcagtatgacacctaccctggcacgttcgggcagggaaccaaagtggaagtgaagcggacagtcgctgcccccagcgtgttt

SEQ ID NO: 42337 - RNA, 351 nt, synthetic construct
  misc_feature 1..351: note = derived and/or modified sequence opt5 from anti-HIV_LightChain
  source 1..351: mol_type = other RNA
gacatccagatgacccaaagcccctccacactgtctgccagcattggcgatacggtgagaatctcctgccgggcttctcagagcattaccgggaactggctcgcctggtaccaccagcgccctggaaaggcgccgagactgcttatctatcggggctcccgcctgctcgggggagtcccctctagattcagcggctccgctgccgggacagactttaccctgacaattgccaatcttcaggctgaggatttcggaaccttttactgtcaacagtatgacacataccctggcaccttcggccaggggacgaaagttgaagtgaagcggaccgtggccgctcccagcgtcttt

SEQ ID NO: 42338 - RNA, 351 nt, synthetic construct
  misc_feature 1..351: note = derived and/or modified sequence opt5 from anti-HIV_Chain
  source 1..351: mol_type = other RNA
atcattctgttcctcgtggccaccgctacaggcagctgggcccagtccgcgctgacgcaacccagatctgtcagcgggtcccttggacagtctgttaccatcagctgcacaggctcctctagcgacgtggggcggtacaactatgtgtcctggtaccagcaccatcctggaaaggctccgaaactgatgattagcgatgtcaataagcgcccctctggcgtgcctgacagattttccgggagcaaatctggaaacaccgcctccctcacaatcagcggcctgcaggccgaggatgaaaccgactattactgttgctcttatgctggctcctacatttgggttttcggggga

SEQ ID NO: 42339 - RNA, 351 nt, synthetic construct
  misc_feature 1..351: note = derived and/or modified sequence opt5 from anti-HIV_Chain
  source 1..351: mol_type = other RNA
cccgtgaccctgagcgcctccgtcggcgacagagttacaatcacgtgccgggcttctgaggatattagcaagtacctcaactggtatcagcacaaacctgggaaggccccgaaactgcttatctacaccgcgtcctctctggaaacaggagtgcccagccgcttctccggctctgggagcggaaccgacttttccctcacaattagctctctgcaacctgatgacttcgctacctattactgtcagcagtcctatacaagctctgtgacctttggccaggggacgagagtcgaggtgaagcggaccgttgccgccccctccgtgttcatctttcctcccagcgatgaacaa

SEQ ID NO: 42340 - RNA, 351 nt, synthetic construct
  misc_feature 1..351: note = derived and/or modified sequence opt5 from anti-HIV_Chain
  source 1..351: mol_type = other RNA
gtggaggaacccggcagctccgtcaaggtttcttgcaaagccagcgggggatcctctaccgcttacggctatagctgggtgagacaggcccctgggcaaggattcgagtggatgggccggatcattccgttttacgggatcattacatatgcgcccaagttccagggacgcgtgacgatcaccgctgacagatccacatctaccgtctacatggaactgacacggctcacctttgccgatacagccctgttcttttgtgctcgcgactatggcgatcctagaaacggctactatttcgacagctgggatcaggggctttggctgaccgtgtccagcgcctctacgaaagga

SEQ ID NO: 42341 - RNA, 351 nt, synthetic construct
  misc_feature 1..351: note = derived and/or modified sequence opt5 from anti-HIV_Chain
  source 1..351: mol_type = other RNA
caggtgagactggagcaaagcggcgccgctgtccggacccccggggcctccgttacactctcttgccaggcgagcggatacaagttcgtgaactatatcattcactgggtgcgccagagacctggcctggcttttgaatgggtcgggatgatcgacccgtaccggggacgcccctggtccgcccattctttcgagggcagacttagcctgtcccgggatgtgtctatggaaattctctatatgacgctgaccagccttcgctccgacgatacagccacctacttttgtgctagagccgaggctgaaagccagtctcactcccggcctatcattagcacatctggggcccgc

SEQ ID NO: 42342 - RNA, 351 nt, synthetic construct
  misc_feature 1..351: note = derived and/or modified sequence opt5 from anti-HIV_Chain
  source 1..351: mol_type = other RNA
gtgcacctggaggtccagctccaacagagcggccccgaactgaagaaacctggggagaccgttaagatctcctgcaaagcctctgtgtacacattcacggaatatccgattcattgggtgaagcaggctcccggaaaaggctttaagtggatggggtggatcaacacctacagcggagagcctacatatgccgacgatttcaagggcagatttgcgttctcccttgaaacctctgctagcacagcctacctgcagattaattccctcaaaaacgaggacaccgccacatatttttgtgcttctctggggcgggattactggggacaaggccagggcaccacgcttaccgtc

SEQ ID NO: 42343 - RNA, 354 nt, synthetic construct
  misc_feature 1..354: note = derived and/or modified sequence opt5 from anti-HIV_Chain
  source 1..354: mol_type = other RNA
ctgagcgtgtccctcggcgagagagccaccatcaactgcaagtctagccagtccattctgtactctagcgacaaaaagaattatcttgcttggtaccaacagaaaatcgggcagccccctaagctgctcctgtattgggcctccacacgggaatctggcattccggatcgcttcagcggatccgggagcggatctgactttacgcttaccatctccagcctgcagcccgaggatgtcgcggtttactattgtcaacagtactatatttctcctttcacatttggccccgggaccaaagtggacctcaagagaacagtggctgccccttccgtcttcatctttccccctagcgat

SEQ ID NO: 42344 - RNA, 354 nt, synthetic construct
  misc_feature 1..354: note = derived and/or modified sequence opt5 from anti-HIV_Chain
  source 1..354: mol_type = other RNA
cagagcgtgctgacccaacccccttccgcctctggcgctccggggcagagagtcacaatcagctgctccggaggcccctctaacgttgggggaaattacgtgtattggtaccggcagttccctggcacggcccccaagctcctgattcttcgcgacgatcagagacctagcggggtgcccgaccggttttccgcgtctaaaagcggaaactccgctagcctggccatctctggcctccgccctgatgacgaggccttctatttttgtgctacctacgattccgacggcagcattagactgttcgggggaggcacagcccttaccgtcctgtctcaaccgaaggctgccccctcc

SEQ ID NO: 42345 - RNA, 354 nt, synthetic construct
  misc_feature 1..354: note = derived and/or modified sequence opt5 from anti-HIV_Chain
  source 1..354: mol_type = other RNA
aaggcccccgctaccctgagcctctcccctggcgagagagccacactgtcttgccgggcgagccagtccgtggggtctgaccttgcttggtaccaacagaaaccgggacaggctccccgcctgctcatctatgatgccagcaacagagccacggccattcctgctcggttctccggctctgggagcggaaccgacttcacactgtccatcagctctcttgaacccgaggatttcgccgtctacttttgtcagcaacgctatgacaagattaccttcggccaggggacaagactggaaatccagcggaccgttgcggccccttccgtgtttatttttccccctagcgatgagcag

SEQ ID NO: 42346 - RNA, 354 nt, synthetic construct
  misc_feature 1..354: note = derived and/or modified sequence opt5 from anti-HIV_Chain
  source 1..354: mol_type = other RNA
caggtgcaactggtccagagcggcgccgaggctaagagacccggggactccgttaaagtgtcttgcaaggccagcggatacaccttcacagaatattacatccactgggtgcggcagacgcctggccaggggtttgagtggatgggaattatcaccccgggcgcggggaacacaacctatgctcaaaaattccagggacgcattacagtcaccagagatacatccgccgccaccgtgtacatggaactctctaatctgacgagcgaggacaccgctgtttatttttgttcccggggcgtgtctttctggggccaggggacacttgtcaccgtgagctccgccagcacaaaggga

SEQ ID NO: 42347 - RNA, 354 nt, synthetic construct
  misc_feature 1..354: note = derived and/or modified sequence opt5 from anti-HIV_HeavyChain
  source 1..354: mol_type = other RNA
gaggtgaagctgcagcaaagcggcgccgaactcgtcagacccggggcttccgttaaaatgtcttgcaaggccagcggataccggttcacctcctataacatgcactgggtgaaacagacacctcgccagggcctggagtggatcggggcgatttacccgggaaatggcgacacgtcttataaccagaagtttaaagggaaggctacccttacagtggataagagctcctctaccgcctacatgcaactgagctccctcacaagcgaagactctgccgtctatttctgtgctagaggacggctgtcccttggctttgattactggggccaggggagcaccctgacagtgtcttcc

SEQ ID NO: 42348 - RNA, 357 nt, synthetic construct
  misc_feature 1..357: note = derived and/or modified sequence opt5 from anti-HIV_Chain
  source 1..357: mol_type = other RNA
caggtgcaactggtccagagcggcaccgccgttaagagacccggggcttccgtgcgggtgtcttgccaggccagcggatacacattcatcgaccactttatttattggtggcgccaggcgcctggccaagggctcgagtggctgggatggatcaacccgcttacgtcccagccctcttaccctagcagattccagggccggctgaccctcacacgcgatacctttgacgaaatgctgtatatggatcttagagggctgcggtccgacgatacaggaatttacttctgtgctcgcagacattctgactattgcgattttgacatctggggcagcggcacccagattatcgtctccagc

SEQ ID NO: 42349 - RNA, 357 nt, synthetic construct
  misc_feature 1..357: note = derived and/or modified sequence opt5 from anti-HIV_Chain
  source 1..357: mol_type = other RNA
caggtgcaactggtccagagcggcaccgccgttaagagacccggggcttccgtgcgggtgtcttgccaggccagcggatacacattcacggactattttatctactggtggcgccaggcgcctggccaagggctcgagtggctgggatggattaacccgcttacctcccagccctcttatcctagcagattccagggccggctgacactcacccgcgatacatttgacgaaatgctgtacatggatcttagagggctgcggtccgacgataccggaatctatttctgtgctcgcagacactctgactactgcgattttgacatttggggcagcggcacacagatcattgtctccagc

SEQ ID NO: 42350 - RNA, 357 nt, synthetic construct
  misc_feature 1..357: note = derived and/or modified sequence opt5 from anti-HIV_Chain
  source 1..357: mol_type = other RNA
cagagcgtgctgacccaacccagatccgtctctggcagccctgggcagtccgttacaatctcttgcacgggaaccagctccgacgtgggcgggtacaactatgtgtcttggtaccagcagcacccgggaaaggcccccaaaacaatgattttcgatgtcaccaagcggcctagcggcgtgcccgaccgcttttccgggagcaaatctggaaatacagcttccctcaccatcagcggcctgcaagccgaggatgaagcggactattactgttcttcctatgctggcagaaacacattctacgtttttgggaccggaacgaccgtgacagtccaggtgagcccttctcagccccctccg

SEQ ID NO: 42351 - RNA, 357 nt, synthetic construct
  misc_feature 1..357: note = derived and/or modified sequence opt5 from anti-HIV_Chain
  source 1..357: mol_type = other RNA
gagatcgtgctgacccagagccccggcacactctccctgtctcctggggaaagagccacgcttagctgccgggcttcccaatctgtcagctccaactacctggcctggtatcagcagaagccgggacaggcgccccgcctcctgatttacggcgcttctagcagagccaccgggatccctgaccggttctccggaagcggctctgggacagattttaccctttccattagccgcctggagcccgaagacttcgccgtttattactgtcaacagtatggaacatcttcctgcacctttggccagggcacaaaactcgagatcaagagaaccgtggctgcccctagcgtgttcattttt

SEQ ID NO: 42352 - RNA, 357 nt, synthetic construct
  misc_feature 1..357: note = derived and/or modified sequence opt5 from anti-HIV_Chain
  source 1..357: mol_type = other RNA
ctgagcgcctccgtgggcgacagagtcaccatcacatgccgggcttctcagagcattgatcgctacctcaactggtatcaacagaagcccgggaaagcccctaagctgcttatctacgcggcttcctctctgcacacggacgttccgagcagattctccggatctggcgccgggacctattttacactcaccattacaagcctgcagcccgaggatttcgccacctactattgtcagcaatcccatagcccttcttttggacaggaatcctacagcatcacattcggccaggggacccggcttgagattaaacgcacggtggctgccccctctgtgtttatcttccctccctccgac

SEQ ID NO: 42353 - RNA, 357 nt, synthetic construct
  misc_feature 1..357: note = derived and/or modified sequence opt5 from anti-HIV_Chain
  source 1..357: mol_type = other RNA
aacttcatgctgacccaggcccccagcgcttccggcgcccctgggcaaagagtgacaatctcttgcagcggaggcccgtccaatgtcgggggaaactacgtttattggtaccggcagtatcccggcacggcgcctaagctcctgattcttcgcgacgatcagagaccctctggggtgcctgaccggtttagcgcttccaaatctggaaatagcgcctccctggccatcagcgaactccgccccgatgacgaggctttctacttttgtgccacctatgattctgacggctccattagactgttcggcgggggaacagctcttaccgtgctgagccagcctaaggccgcgccgtctgtc

SEQ ID NO: 42354 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccattggcgatagagtgaacatcacatgccaggcttctcgggacacggggagcgccctcaattggtaccagcagaaggtcggacgccctccgagactgcttatttccgcggtttctaacctgggcgctggggtgcccagccggttctccggacgcagaagcggcacccaatctacactcaccatcaatacactgcagcctgaggatattgccacctatttttgtcagcactacgagttctttgggcccggaacaaaagtggacatcaagcggaccgtcgccgctccttccgtgttcatctttccccctagcgatgaacag

SEQ ID NO: 42355 - RNA, 360 nt, synthetic construct
  misc_feature 1..360: note = derived and/or modified sequence opt5 from anti-HIV_Chain
  source 1..360: mol_type = other RNA
cagagcgtgctgacccaacccgcctccgtctctggcagccctgggcagtccatcacaatttcttgcacgggaaccagcaacgacgttggcgggcagaatttcgtgtcctggtaccagcaacacccgggaacagctccccagctcctgatctatgatgtgaccaacagacctgccggcgtctctagccggttttccgggagcaagtctggaaatacagcgtcccttaccattagcggcctgcgcacagaggacgaagctgattactattgtgcctctttcaccatcctcaacggcgtggactacgtttttgggacgggaaccaaagtgacagtcctgctttcccccagccagccttatctg

SEQ ID NO: 42356 - RNA, 360 nt, synthetic construct
  misc_feature 1..360: note = derived and/or modified sequence opt5 from anti-HIV_Chain
  source 1..360: mol_type = other RNA
aacttcatgctgacccagcccgccagcgtgtccggctctcctgggcaaagcatcacactctcctgcacgggaaccacatctgacgtcagagatagcaattttgtttcctggtaccaacaggtgccgggcaaggctcccaaactgattatctatgacgtgtctgcccggcctagcggggtctccttccgctttagcggatctaagtccggcaacaccgcgagccttacaatttctgggctgcaggctgaggatgaagccctctactattgttccagcttcacccccacaaataccctggtgtttggaggcggcacgaaacttaccgttctggggcagcctaaggccgctccctctgtgaca

SEQ ID NO: 42357 - RNA, 360 nt, synthetic construct
  misc_feature 1..360: note = derived and/or modified sequence opt5 from anti-HIV_Chain
  source 1..360: mol_type = other RNA
cagagcgccctgacccaaccccctgctgcctccggcgcgccggggcagagagtgacaatctcttgcagcggaggcgggtccaacgtcggaggcaatctcgtttcttggtaccagcagttccccggggctgcccctaagctgattcttcaccgggacggacaacgccccagcggcgtgcctgatagattttccgcctctaaaagcggcacgtccgctagcctgaccatctctgggctccggtccgacgatgaggccacatatttctgtgctgcctacgacagcgcggtgtctctgcccgtctttggaggcgggaccaaacttacagtgctgtcccagcctaaggccgctccgctcgttacc

SEQ ID NO: 42358 - RNA, 360 nt, synthetic construct
  misc_feature 1..360: note = derived and/or modified sequence opt5 from anti-HIV_Chain
  source 1..360: mol_type = other RNA
cagctggtgctcacccaaccccctagcgtctccggcacaccggggcagaacgttacgatctcttgcagcggaggcgggtcccacgtgggaggcaatctggtgtcttggtaccagcatttccccggggccgctcctaaacttctgattcacagagacaaccagcggcccagcggagtccctgatcgcttttccgccctcaagtctggcaatagcgcgtccctggctatcagcggccttagatctgacgatgaggccttctatttttgtgccgtgtacgactccagcctgtctctcgggctgttcggaggcgggaccaagctgacagttctctcccaacccaaagctgcccctagcgtgacc

SEQ ID NO: 42359 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccgtgggcgatagagtctctattcactgccaggctgggcagggaatcggcagctccctcaagtggtaccagcaaaaatctgggcgggcccctcgcctgcttgttcatggagcgagcaacctgcagagaggcgtgccgtcccggttcagcgggtctggatttcacacaacgttcaccctcacaatttccagcctgcagcccgacgatgtggctacctattggtgtgccgtccttgagtttttcggccctggcacaaaggtggaaatcaaacgcaccgttgccgctccctctgtgtttattttccctccctccgacgagcag

SEQ ID NO: 42360 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccgtgggcgatagagtcacaattacgtgccaggcttctcaggggatcggaagctccctccagtggtaccaacagaagcctggccgggccccgaaactgcttgttcacggggcgtctaacctgcatcgcggagtgcccagcagattctccggcagcgggtttcacacctctttcacactcaccatttccagcctgcagcctgacgatgtggctacatatttttgtgccgtccttgagttctttggacccggcaccaaggtggaaatcaaacggacagttgccgctccttctgtgttcatttttcccccttccgacgagcag

SEQ ID NO: 42361 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccgtgggcgatagagtctctattaactgccaggctgggcagggaatcggcagctccctcaattggtaccagcaaaagcgggggaaagcccctaagctgcttgttcacggagcgtctacactgcagcgcggcgtgccgagcagattctccgggagcggatttcatacgaccttcacactcaccatttcttccctgcagcccgacgatgtggctacatatttttgtgagagcttccagtggtttggccctggcaccaaagtcgaaatcaagcggacagtggccgccccctctgttttcatttttcctccctccgacgagcaa

SEQ ID NO: 42362 - RNA, 360 nt, synthetic construct
  misc_feature 1..360: note = derived and/or modified sequence opt5 from anti-HIV_Chain
  source 1..360: mol_type = other RNA
tacatccagatgacccaaagcccctcctctctgagcgcctccattggcgacagagtgacaatcacgtgccaggctgggcagggaattggctctagcctcaactggtatcagcaaaagcctgggaaagccccgaagctgcttgtccacggagcgtccaatctgcagcggggcgtttctagccgcttctccgggagcggatttcataccacattcaccctcacaatctcttccctgagacccgaggatgtgggcacctacttttgtgaagtgtatgagttcattggccctgggacaaaagtcgacatcaagcggaccgtggctgcccccagcgtttttatcttccctccctctgatgaacag

SEQ ID NO: 42363 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgcctgccagcgtgggcgatacagtcacgattacctgccaggctgggcagggaatcggctcctctctccagtggtaccaacagagaccggggcgggcccccaacctgcttgtttatgacgcgagcaatctgcagcgcggagtgccttccagattcacaggcaccgggtttcacacaaccttcacactcaccattcggggactgcgccccgaggattttggcacgtacttctgtgcttctcttgaatttttcggccctgggaccaaggtggacatcaaaagaacagtcgccgcccccagcgtgtttattttccctccgtccgatgagcag

SEQ ID NO: 42364 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccgtgggcgatagagtcacaattacgtgccaggcttctcaggggatcggaagctccctccagtggtaccaacagaagcctggccgggccccgaacctgcttgttcacggggcgtctaatctgcatcgcggagtgcccagcagattctccggcagcgggtttcacaccacattctctctcaccatttccggactgcagcgggacgattttgctacatatttctgtgccgtgcttgagtttttcggccctggcaccaaagtcgacatcaagcgcacagtggccgctcccagcgtttttattttccctccctctgatgaacag

SEQ ID NO: 42365 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgtgtccgtcggcgatagagtttctattacatgccgggccacgcaggggatcggaaacagcctcaattggtaccagcagaagcctggcaaagctccgaaggtgctgatttatgggaccacaaaacttcacggaggcgtgccctcccgcttctctgggggaggcagcggctccaccgggacactgaccatcgacagcctccaacctgaggatattgccacatacttctgtcagctgttcgaatttttcggacccggcaccaaggtcgagatcaaaagaacggtggcggctccttctgtttttatctttcccccttccgacgaacag

SEQ ID NO: 42366 - RNA, 360 nt, synthetic construct
  misc_feature 1..360: note = derived and/or modified sequence opt5 from anti-HIV_Chain
  source 1..360: mol_type = other RNA
gacatccagatgacccaaagcccctcctctctgagcgcctccgtgggcgatagagtcacaattacgtgccaggctgggcagggaatcggctctagcctcaactggtaccagcaaaagcctgggcgggccccgaaactgcttgtttatggagcgtccaatctgcagcgcggcgtgccctctagattcagcgggtccggatttcacaccacattcaccctcacaattagctctctgcagcctgaggactttgctacctacttctgttccgtgtatgaatttcttggccccggcacaaaggtcgagatcaaacggaccgtggccgcccctagcgttttcatttttcccccttctgatgaacag

SEQ ID NO: 42367 - RNA, 360 nt, synthetic construct
  misc_feature 1..360: note = derived and/or modified sequence opt5 from anti-HIV_Chain
  source 1..360: mol_type = other RNA
cccatgttccagcctggccaaagcgggggagtggtcgttcagtccggcgagtctctgcacctcagctgcgaagcctccgggtttaagttcgcttctcagatgatgcattgggtgagacacgtgccgggacggggcctggagtgggtcgcccttatcagctgggacgggtccggaaaactgtttgcggattctgtgcgcggcagattcaccattcatcggtggaacgaccgcaatagcctctacctggatgttaagaacgtgagacccgaagacgctgccatctattactgtacacggaatggctttgatgtctgggggcagggcattcttgtgacggtttccagcgcctctaccaaagga

SEQ ID NO: 42368 - RNA, 363 nt, synthetic construct
  misc_feature 1..363: note = derived and/or modified sequence opt5 from anti-HIV_HeavyChain
  source 1..363: mol_type = other RNA
gaggtgaagctggtcgaaagcggcgggggactcgttcagcccggcgggtccctgagactttcttgcgccgctagcggattcaccttttcctctttcggcatgcactgggtgcggcaagcccctgagaaagggctggaatgggtggcgtacatcagctccggatctagcacactccattatgctgacacggtcaagggccgctttaccatttccagagataacagcaaaaattctctgtaccttcagatgaacctgctccgggccgaggacacagccgtgtattactgtgctcgcggctccagaaatctgagccaccggctgctctcttattgggggcagggaaccctggttacagtgtccagc

SEQ ID NO: 42369 - RNA, 363 nt, synthetic construct
  misc_feature 1..363: note = derived and/or modified sequence opt5 from anti-HIV_HeavyChain
  source 1..363: mol_type = other RNA
gaggtgcagctggtcgaaagcggcgggggactcgttcaacccggcgggtccctgagactttcttgcgccgctagcggattcaccttttcctctttcggcatgcactgggtgcggcaggcccctgggaagggactggagtgggtgagctacatctcctctggcagctccacactccattatgcggacacggtcaagggccgctttaccattagcagagataactctaaaaattccctgtaccttcagatgaacagcctgcgggctgaagacacagccgtgtattactgtgcccgcgggtctagaaatctctcccaccggctgctgagctattggggacagggcaccctcgttacagtgtcttcc

SEQ ID NO: 42370 - RNA, 363 nt, synthetic construct
  misc_feature 1..363: note = derived and/or modified sequence opt5 from anti-HIV_Chain
  source 1..363: mol_type = other RNA
gacatccagatgacccaaagcccctcctctctgagcgcctccgtgggcgatagagtcacaattacgtgccaggcttctcaggggatcagcaactccctcaattggtaccagcaaaagcctggaaaagccccgcggctgcttatttatggcacctctacactgcagcgcggggttcccagcagattctccggaagcggctctgggacccggtttacagtgaccatcaactccctccagcctgaggacattgcgacatacttctgtcagcacaatgaatttttcggacgcggcaccaaggtggatatcaaaagaacggtcgctgcccccagcgtgtttatcttccctccctctgacgagcaactg

SEQ ID NO: 42371 - RNA, 363 nt, synthetic construct
  misc_feature 1..363: note = derived and/or modified sequence opt5 from anti-HIV_Chain
  source 1..363: mol_type = other RNA
gacatccagatgacccaaagcccctcctctgtgagcgcctccgtcggcgatagagttacaattacgtgccaggcttctcgggacaccgataacagcctgacatggtaccagcagaagcctgggcgcccgcccaaactcctgatctatcacgtggtgaatcttggacctggcgtcccctccagattctctgggagcgcctccagcgcgacccaatctacactgattatctccgactttcagcctgatgacgtggctacctacttctgtcagaactatgagtttttcggacccggcacaaaggttgaaattaaacggaccgtggccgcccctagcgtctttatcttcccgccctctgatgagcag

SEQ ID NO: 42372 - RNA, 363 nt, synthetic construct
  misc_feature 1..363: note = derived and/or modified sequence opt5 from anti-HIV_Chain
  source 1..363: mol_type = other RNA
gagatcgtgctgacccagagccccggcacactctccctgtctcctggggaaagagccacgcttagctgccgggcttcccaatctgtcagctccaacaatctggcctggtaccagcagaagccgggacaggcgccccgcctcctgatgtctggcgctagctccagagccaccgggattcctgaccggttcagcggatctggctccgggacagattttacccttacaatcagccgcctggagcccgaagacttcgccgtttatcactgtcaacagtacggatcttcccctcccacctttggccagggcacaaaagtggagattaagagaaccgtggctgcccctagcgtcttcatctttccgccc

SEQ ID NO: 42373 - RNA, 363 nt, synthetic construct
  misc_feature 1..363: note = derived and/or modified sequence opt5 from anti-HIV_Chain
  source 1..363: mol_type = other RNA
gacatccagatgacccaaagcccctcctctctgagcgcctacgtgggcgatagagtcacaattacgtgccgggcttcccagaacatcaatacctatctcaactggtaccagcagcgccctgggaaggccccgaaactgcttatttatgcggcttctacactgcaaagcggagttccctccagattctctggcagcgggtccggaaccgactttacactcaccatcagcaatctggagacagaagatttcgccgtgtactattgtcagcagacctaccggtctgtgacgtttggccaggggaccaaacttgagattaagcgcacagtcgccgctccttccgtgttcatctttccccctagcgac

SEQ ID NO: 42374 - RNA, 363 nt, synthetic construct
  misc_feature 1..363: note = derived and/or modified sequence opt5 from anti-HIV_Chain
  source 1..363: mol_type = other RNA
gacatccagatgacccaaagcccctcctctctgagcgcctccgtgggcgatagagtcacaattacgtgccaggctgggcagggaatcggctctagcctccagtggtaccaacagaagcctgggaaagccccgaagctgcttgttcacggagcgtccaacctgcatcggggcgtgccctctcgcttcagcgggtccggatttcacaccacattcagcctcaccatttctggcctgcagagagacgattttgctacatatttctgtgccgtggtcgagtttttcggccctgggaccaaagtggacatcaagcggacagttgccgctccctccgtgtttattttccctcccagcgatgaacagctt

SEQ ID NO: 42375 - RNA, 363 nt, synthetic construct
  misc_feature 1..363: note = derived and/or modified sequence opt5 from anti-HIV_Chain
  source 1..363: mol_type = other RNA
caggtgcaactggtcgagagcggcgccgaactcagaaagcccggggagtccctggaaatctcttgcaaagctagcggatactccttctctagccactggattggctgggcccggcagatgcctgggaagggacttgagtggatgggcatcatttatccgggggactccaacaccatctactctcccagctttcagggacaggttacaatttccgcggataaaagcatcaatacggcttatctgcaatggtcttccctcaaggccagcgacaccgccatgtacttctgtgcttctaactatcatgattacttttattggggccagggcacactggtgaccgtgtccagcgcctctacaaaaggg

SEQ ID NO: 42376 - RNA, 363 nt, synthetic construct
  misc_feature 1..363: note = derived and/or modified sequence opt5 from anti-HIV_Chain
  source 1..363: mol_type = other RNA
ttcgtgcagctggtcgagagcggcgggggagttgtgcaacccggcacctccctcagactgtcttgcacaacgagcgggtttatcttctccgactacggaatgcactgggtgcggcaggccgctggcaaggggcttgaatgggtcgccgtgatttggcatgatggatctaaccgcttttatgcggacagcgttaaaggcagattcaccatctcccgggataattctaagaacgctgtgtacctggagatgaataacctccgcgtcgaagacacagccctgtattactgtgccagaaccagcatggatattgactattggggccaggggacacctgtgaccgtttccagcgcttctacaaaagga

SEQ ID NO: 42377 - RNA, 363 nt, synthetic construct
  misc_feature 1..363: note = derived and/or modified sequence opt5 from anti-HIV_Chain
  source 1..363: mol_type = other RNA
gagcccatgttccagcctggccaaagcgggggagtggtcgttcagtccggcgaatctctgcacctcagctgcgaggcctccgggtttaagttcgcttctcagatgatgcattgggtgagacacgtgccgggacggggcctggaatgggtcgcccttatcagctgggacgggtccggaaaactgtttgcggattctgtgcgcggcagattcaccattcatcggtggaacgaccgcaatagcctctacctggatgttaagaacgtgagacccgaggacgctgccatctattactgtacacggaatggctttgatgtctgggggcagggcattcttgtgacggtttccagcgcctctaccaaagga

SEQ ID NO: 42378 - RNA, 366 nt, synthetic construct
  misc_feature 1..366: note = derived and/or modified sequence opt5 from anti-HIV_Chain
  source 1..366: mol_type = other RNA
agccagcacctggtgcaatccggcacccaggtcaagaaacccggggcctctgttagaatcagctgccaggcttccggatactctttcacagactatgtgctccattggtggcggcaggcccctggccaagggctggagtggatgggatggattaagccggtgtacggcgcgcgcaactatgctagacggtttcaggggcgcatcaatttcgatagagacatttaccgggaaatcgcctttatggatcttagcggactgcgctccgacgatacggccctctatttctgtgctagagacggctctggcgatgacaccagctggcacctggatccctgggggcagggaacacttgtcattgtgtccgcc

SEQ ID NO: 42379 - RNA, 366 nt, synthetic construct
  misc_feature 1..366: note = derived and/or modified sequence opt5 from anti-HIV_Chain
  source 1..366: mol_type = other RNA
gacatccagatgacccaaagcccctcctctctgagcgcctccgtgggcgatagagtcacaattacgtgccgggcttctcagagcatctcccgctacctcaactggtatcagcagaagcctgggaaagccccgaagctgcttatttacgcggcttctagcctgcaaggaggcgttccctccagattcagcgggtctggatccggcaccgacttcacactcaccatcagctctctgcagcctgaggatttcgccacatattactgtcagcagtccagctctaaaccctttaccttcgggggaggcacaaaggtggaaattaaacggaccgtggccgctccttccgtctttatctttccccctagcgac

SEQ ID NO: 42380 - RNA, 366 nt, synthetic construct
  misc_feature 1..366: note = derived and/or modified sequence opt5 from anti-HIV_Chain
  source 1..366: mol_type = other RNA
gagatcgtgctgacccagagccccggcacactctccctgtctcctggggaaagagccacgcttagctgccgggcttcccaatctattagctccaactacctggcctggtatcagcagaagccgggacaggcgccccgcctcctgatctacggcgcttctaccagagccacagggattcctgaccggttcagcggatccggcagcgggaccgatttcacactttctatctcccgcctggagcccgaagacattgccgtctattactgtcaccaatatggaagctctcagagattcggccagggcaccaaagttgagatcaagcggacagtggctgccccttccgtgtttatctttccccctagcgat

SEQ ID NO: 42381 - RNA, 366 nt, synthetic construct
  misc_feature 1..366: note = derived and/or modified sequence opt5 from anti-HIV_Chain
  source 1..366: mol_type = other RNA
gagatcgtgatgacccagagccccgccacactgtccgtctctcctggcgacagagctacgctcagctgccgggcctcccaatctgttagcaccaacctggcgtggtaccagcagaagccggggcaggctccccgccttctgatttatggagcctccacaagagccaccggcatccctgctacattctctgggagcggatttgccaccgagttcacactcaccatttccagcctgcaatctgaagattttgctgtgtactattgtcagcagtacaataactggccccctgccttcggccaggggacgaaagtggaaatcaagcggaccgtcgcggccccctccgtgtttattttccctccgagcgac

SEQ ID NO: 42382 - RNA, 366 nt, synthetic construct
  misc_feature 1..366: note = derived and/or modified sequence opt5 from anti-HIV_Chain
  source 1..366: mol_type = other RNA
gacatccagatgacccaaagccccgcctccctgtctgctagcgtgggcgatagagtcacaattacgtgccgggcctcccaggggatctctcactacctcgcgtggtatcagcagaagcctggaaaagttccgcgcctgcttatttacgctgccagcagactgcaatccggcgtgacctctcggttcagcgggtccggaagcggcacagagtttaccctcacaatctcttccctgcttcccgaagacgccgctgtgtatttctgtcagaagtacgataccgaccctatgacatttgggcagggaacccgcctggagattaaaagaacggtcgccgctcccagcgtgttcatctttcctccctctgat

SEQ ID NO: 42383 - RNA, 366 nt, synthetic construct
  misc_feature 1..366: note = derived and/or modified sequence opt5 from anti-HIV_Chain
  source 1..366: mol_type = other RNA
cagagcgccctgacccaacccccttccgcttctggcgccccggggcagagagtgacaatcagctgctccggaggcccctctaacgtcgggggaaattacgtttattggtaccggcagttccctggcacggcgcccaacctcctgattcttcgcgacgatcagagacctagcggggtgcccgaccggttttccgcttctaagagcggaaattccgccagcctggccatctctggcctccgccctgatgacgaggctttctatttttgtgccacctacgattccgacggcagcattagactgttcgggggaggcacaacccttacagtgctgtctcaaccgaaagctgccccctccgtcaccctcttt

SEQ ID NO: 42384 - RNA, 366 nt, synthetic construct
  misc_feature 1..366: note = derived and/or modified sequence opt5 from anti-HIV_Chain
  source 1..366: mol_type = other RNA
gacatccagatgacccaaagcccctcctctctgagcgcctccgtgggcgatagagtcacaattaactgccaggctgggcagggaatcggctctagcctcaattggtaccagaagaaacctgggcgggccccgaagctgcttgttcacggagcgtccaacctgcaacgcggcgtgccctctagattcagcgggtccggatttcatacgaccttcacactcaccattagctctctgcagcctgacgatgtggctacatatttttgtgccgtcttccagtggtttggccccggcaccaaagtggacatcaagcggacagttgccgctccttccgtgttcatttttccccctagcgatgagcagcttaaa

SEQ ID NO: 42385 - RNA, 366 nt, synthetic construct
  misc_feature 1..366: note = derived and/or modified sequence opt5 from anti-HIV_Chain
  source 1..366: mol_type = other RNA
gacatccagatgacccaaagcccctcctctctgagcgcctccgtgggcgatagagtcacaattacgtgccaggcttctcaggggatcggaagctccctccagtggtaccaacagaagcctggccgggccccgaacctgcttgttcacggggcgtctaaactgcatcgcggagtgcccagcagattctccggcagcgggtttcacaccacattctctctcaccatttccggactgcagcgggacgattttgctacatatttctgtgccgtgcttgagtttttcggccctggcaccaaggtcgaaatcaaacgcacagtggccgctcccagcgtttttattttccctccctctgacgagcagctgaag

SEQ ID NO: 42386 - RNA, 366 nt, synthetic construct
  misc_feature 1..366: note = derived and/or modified sequence opt5 from anti-HIV_Chain
  source 1..366: mol_type = other RNA
caggtgcacctggtccaaagcggcgccgaggttaagaaacccggggcttccgtgaaggtgtcttgcaaagtcagcggatacaccctctccgaactgtctatccattgggtgagacagggccctgggcggggacttgagtggatggccaacttcgacccggaagatggcgagacaatttatgcgccccagtttcaggggcgcgttacgctgaccgaagacacaagcaccgatacagcttacatgcaactcacctccctgagatctgaggacacagccgtgtattactgtgccaccgatcggtatacggacaccggacgctggggccctggcacacttgtcaccgtgagctccgctagcacaaagggg

SEQ ID NO: 42387 - RNA, 366 nt, synthetic construct
  misc_feature 1..366: note = derived and/or modified sequence opt5 from anti-HIV_Chain
  source 1..366: mol_type = other RNA
caggtgcaactggtcgagagcggcgggggactcatccagcccggcgggtccctgagactttcttgcgaagccagcggattcgctgttggcgacattaactacatgtcctgggtgcggcaggcccctgggaagggactggagtgggtgtctgtcctctatagcggcggctcctctcagtacgcggatagcgtgaaagggcgctttaccatctccagagacaatagccggaacacactgtatcttcaaatggataatctgcgcgctgaagacacggccgtttactattgtgccagaggactccgggtgtacttcgatctgtggggccaggggattctggtcaccgtgtcttccgctagcacaaaggga

SEQ ID NO: 42388 - RNA, 366 nt, synthetic construct
  misc_feature 1..366: note = derived and/or modified sequence opt5 from anti-HIV_Chain
  source 1..366: mol_type = other RNA
caggtgcaaatggtcgccagcggcgggggactggttaagcccggcgggtccctcagactgtcttgcgaggctagcggattcaccttttccgactactatatgtcttgggtgcggcaggcccctggcaaagggcttgaatggatcagctacattacatccggaggcaacgcgctgtattacgctgattctgtgaagggccgcttcacgatcagcagagacaatgccaaaaactccctctatctgcagatgaatagccttcgggccgaggataccgctgtctactattgtgcccgcgacctgctccacgctcatgattttgggagacagggaacactggtgaccgtttcttccgccagcacaaagggc

SEQ ID NO: 42389 - RNA, 366 nt, synthetic construct
  misc_feature 1..366: note = derived and/or modified sequence opt5 from anti-HIV_Chain
  source 1..366: mol_type = other RNA
cagctgcaactcgtggagagcggcgggggagtcgttcagcccggcagatccctgcggctttcttgcgccgctagcgggttcaccttttccacatacacgatgcactgggtgcgccaggcccctggaaagggcctggaatgggtggcggtcatctcttatgacgggaccaacaaatactatgctgatagcgtgaagggaagattcacaatttcccgggacaattctaaaaacaccctctacctgcagatgaatagccttcgcggcgaggatacagccgtttattactgtgccagatccccgagctattactttgactactggggccaagggaccctggtgacagtctctgctgcctccaccaaggga

SEQ ID NO: 42390 - RNA, 369 nt, synthetic construct
  misc_feature 1..369: note = derived and/or modified sequence opt5 from anti-HIV_Chain
  source 1..369: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagagtcagcctgacgcggcaggcctcctgggatttcgacacctattctttttacatggatcttaaagccgtgcgcagcgacgatacagctatttatttctgtgccagacaacggtccgacttttgggatttcgacgtttggggaagcggcacccaggtgacagtctcttcc

SEQ ID NO: 42391 - RNA, 369 nt, synthetic construct
  misc_feature 1..369: note = derived and/or modified sequence opt5 from anti-HIV_Chain
  source 1..369: mol_type = other RNA
caggtgcaactgctccagagcggcgccgtcgttaccaagcccggggcttccgtgagagtgtcttgcgaggccagcggatacaaaatccgggactatttcattcactggtggcgccaggcgcctggccaggggctgcaatgggtcggatggatcaacccgcagacaggccagcccaatattcctagaccctttcaggggcgggtgacgcttacccgccatgcttcctgggatttcgacacattttctttctacatggatctgaaggccctcagaagcgacgataccgccatctatttttgtgctcggcgcagatccgactactgcgatttcgacgtttggggatctggcacacacgtgaccgtcagctcc

SEQ ID NO: 42392 - RNA, 369 nt, synthetic construct
  misc_feature 1..369: note = derived and/or modified sequence opt5 from anti-HIV_Chain
  source 1..369: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaagggactcagatccgacgatacagccatttatttttgtgctcggcaacgctctgactactgggatttcgacgtgtggggcagcggcacccaggttacagtgtccagc

SEQ ID NO: 42393 - RNA, 369 nt, synthetic construct
  misc_feature 1..369: note = derived and/or modified sequence opt5 from anti-HIV_Chain
  source 1..369: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagactttttcaggggcgggtctccctgacgcgccatgcctcttgggatttcgacacctttagcttctacatggatctcaaggccgtgagatccgacgatacagctgtttatttttgtgcccggcagcgctctgactactgggatttcgacgtgtggggaagcggcacccaagtcacagtgtccagc

SEQ ID NO: 42394 - RNA, 369 nt, synthetic construct
  misc_feature 1..369: note = derived and/or modified sequence opt5 from anti-HIV_Chain
  source 1..369: mol_type = other RNA
caggtgagactgctccaaagcggcgccgctgtcaccaagcccggggcctccgttcgggtgtcttgcgaggcgagcggatacgaaatccgcgactatttcattcactggtggagacaggctcctggccaggggctgcagtgggtgggatggatcaacccgaaaacaggccaacccaataaccctcggcagtttcaggggcgcgtctcccttacgagacaggcctcttgggatttcgacagctactccttttatatggatctgaaggccctccggtctgacgataccggagtgtacttctgtgctcgccaaagaagcgactattgggattttgacgtttggggctccggcacacaggtgaccgtcagctct

SEQ ID NO: 42395 - RNA, 369 nt, synthetic construct
  misc_feature 1..369: note = derived and/or modified sequence opt5 from anti-HIV_Chain
  source 1..369: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaaggccctcagatccgacgatacagctgtgtatttttgtgcccggcaacgctctgactactgggatttcgacgtttggggaagcggcacccaggtgacagtctccagc

SEQ ID NO: 42396 - RNA, 369 nt, synthetic construct
  misc_feature 1..369: note = derived and/or modified sequence opt5 from anti-HIV_Chain
  source 1..369: mol_type = other RNA
gaggtgcagctggtcgaaagcggcgggggactcatccaaagaggcgggtccctgcggctttcttgcgttgccagcggattccccgtgtccgacaaccacatgtcttgggtgcgccaggctcctggcaaggggctggagtgggtcagcattatctactccgatggaggcacctattacgccgactctgtgaaaggcagatttacaattagccgggataattccaagaacacggtttatctccagatgaatagcctgcgcgcgaccgacacagctgtgtactattgtgccagagatccggggttccattacggacttgacgtctggggccaggggaccacagtgaccgtttcttccgccagcacaaaagga

SEQ ID NO: 42397 - RNA, 369 nt, synthetic construct
  misc_feature 1..369: note = derived and/or modified sequence opt5 from anti-HIV_Chain
  source 1..369: mol_type = other RNA
caggtgcaactgcaggagagcggccccgggctcctgagacctcttgaaaccctgtccctcacatgctctgtcagcggaggctccatccgggggtacttctggtcttgggttcgccagccggccggaagaggcctggagtggattgggcggatctatagctccggaacgacccgctttaacccctctcttaagagcagagtgcggctgtccattgacacagctaaaagcgaagtgtctctcaatatcacctccgtcacagccgcggatagcgcttcttacttctgtgccggcacctcccctgtgcacggcgggctggacctgtggggactcggcctgcgcgttacagtgagctctgcctccaccaagggg

SEQ ID NO: 42398 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccggcacactctccctgtctcctggggaaagagccacgcttagctgccgggcttcccaatctgtcagctccaacctggcctggtacgcgcagaagccgggacaggctccccgcctcattatctatggcgcctctagcagagcctccgctattcctgaccggttccgcgggagcggatctggcaccgattttacactgaccatctccagacttgagcccgaagacttcgccgtttactattgtcagcaatacgatgacgctcctattacatttgggcacggaacccggctggagatcaaacgcacagtggccgcgcccagcgtgttcatctttcctccgtctgatgaa

SEQ ID NO: 42399 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccggcacactctccctgtctcctggggacagagccgctcttagctgccgggcctccgaaacgctgtctggaaacagcctcgcgtggtaccaacagaagcgcggccagccgcccagactgcttattttcgctgcctcctctcgggccaccgggatccctgagcgctttagcggaggcgggtccggaacagatttcaccctgacaattaccagactcgaacccgaggactttgctgtctatttctgtcagcaatacgttgatgcccctatcacatttggccagggcacccggctggaaattaaacgcacggtggctgcccccagcgtgttcatctttcctccgtctgac

SEQ ID NO: 42400 - RNA, 369 nt, synthetic construct
  misc_feature 1..369: note = derived and/or modified sequence opt5 from anti-HIV_Chain
  source 1..369: mol_type = other RNA
gacatccagatgacccaaagcccctcctctctgagcgcctccgtgggcgatagagtcacaattacgtgccgggcttctcaggacatcaccacatacctcgcctggctgcagcagaagcctgggaaagcgcccaagagccttatttattccgcttctaccgttcaaagcggagtgccgtcccgcttcagcggctctgggtccggaacagagtttaccctgacaatcagcggcctccagcctgaagatttcgccacctactattgtcagcagtacaactattaccccattacgtttgggctgggaaccagacttgagatcaaacggacagtggccgctccttctgtcttcatctttcccccttccgacgaa

SEQ ID NO: 42401 - RNA, 369 nt, synthetic construct
  misc_feature 1..369: note = derived and/or modified sequence opt5 from anti-HIV_Chain
  source 1..369: mol_type = other RNA
gacatccagatgacccaaagcccctcctctctgagcgcctccattggcgatagagtgacaatcacgtgccgggctaaccagcacattcgctctttcctcaattggtaccagcagacccctgggaaggccccgaaactgcttatctatgcggctagcacactgcaaagaggagtcccctcccggttttctggcagcgggtccggaaccgacttcacactcaccattacaagcctggagcgcgaagatcttgccacctactattgtcagcagacgtacacctctcctatcacatttggccaggggaccagactggagatcaagcggacagttgccgctccctccgtgttcatttttcctcccagcgacgaa

SEQ ID NO: 42402 - RNA, 369 nt, synthetic construct
  misc_feature 1..369: note = derived and/or modified sequence opt5 from anti-HIV_Chain
  source 1..369: mol_type = other RNA
agcgagatcgtgctgacccagtcccccgccacactctctctgagccctggcgaatccgctacgctttcttgcagagccagccaatccctgtctagctccctcgcgtggtaccagcagaagccggggcaggctccccggctgcttatttatgacaccagcgatcgcgccacaggaatccctgccagattctctggccgggggtccggaaccgactttacactgaccattagctctctcgagcccgaagatttcgctgtctactattgtcaacagcgctccaactgggccatcacatttggccaggggaccagactggagattaaacggacggttgctgcccctagcgtgttcatctttcccccttctgac

SEQ ID NO: 42403 - RNA, 369 nt, synthetic construct
  misc_feature 1..369: note = derived and/or modified sequence opt5 from anti-HIV_Chain
  source 1..369: mol_type = other RNA
caggtgctgagcgtctccggcacccccgggcaaagagttatcatttcttgcagcggaacatcctctaacgtgggcgggaatctcgtgagctggtaccagcatctgcctggagccgctccgcggcttctgatccaccgcgacgatcagagaccctccggcgtccctgaccggttctctgggagcaagtccggaaacagcgcctctctcgtgatttccggcctgcgcagcgatgacgaggcggattatttttgtgctgcctacgactctacgttctcccttcccgtttttggcgggggaaccagactgacagtgctcagccagcctaaagccgctccctctgtcaccctgtatgccccttccagcgaagag

SEQ ID NO: 42404 - RNA, 369 nt, synthetic construct
  misc_feature 1..369: note = derived and/or modified sequence opt5 from anti-HIV_Chain
  source 1..369: mol_type = other RNA
gacatccagatgacccaaagcccctcctctctgagcgcctccgtgggcgatagagtcacaattacgtgccaggctgggcagggaatcggctctagcctccagtggtaccaacagaagcctgggaaagccccgaagctgcttgttcacggagcgtccaacctgcatcggggcgtgccctctcgcttcagcgggtccggatttcacaccacattcagcctcaccatttctggcctgcagagagacgattttgctacatatttctgtgccgtgcttgagtttttcggccctgggaccaaagtcgaaatcaagcggacagtggccgctccctccgtttttattttccctcccagcgacgagcagctgaaatct

SEQ ID NO: 42405 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccgccacactctccctgtctcctggcgaaagagctacgcttagctgccgggcctcccaagggctgaacttcgtcgtttggtaccagcagaagcgcggacaggcgccgagactcctgattcacgctccctctgaccgggcccctggcgtgcccgatcgcttcagcgccagagggtccggaaccgacttctctcttgtgatcagctccgtcgagcctgatgactttgctatttattactgtcaagaatatagctctacaccctacaatttcggccctgggacccgggtggatcgcaaaagaacagttgccgctccgtccgtgtttatctttccccctagcgacgagcag

SEQ ID NO: 42406 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccacaacgctctccctgtctcctggcgaaagagccacccttagctgccgggcttcccaaggggtcaacctggttgtgtggtaccagcagaagcgcggacaggccccgagactcctgatttatggcccctctgaccgggcgcctggggtgcccgatcgcttcagcgctagaggatccggcacagagttttctcttgtcatcagctccgtggaacctgacgatttcgccctgtactattgtcaagagtacagctctaccccctataattttgggacaggaacccgggttgaccgcaaaagaacagtggccgctccttccgtcttcatttttccgcccagcgatgaacag

SEQ ID NO: 42407 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccgccacactctccctgtctcctggcgaaagagctacgcttagctgccgggcctcccaaggggtcaacttcgttgtgtggtaccagcagaagcgcggacaggcgccgagactgctcatttatggcccctctaatcgggctcctggggtgcccgaccgcttcagcgccagaggatccggcaccgagttctctctggtcatcagctccgtggaacctgatgactttgccctttactattgtcaagagtacagctctacaccctataacttcgggcctggaacccgggttgatcgcaaaagaacagtggctgccccgtccgtctttatttttccccctagcgacgaacag

SEQ ID NO: 42408 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccgccacactctccctgtctcctggcgaaagagctacgcttagctgccgggcctcccaagggctgaacttcgtcgtttggtaccagcagaagcgcggacaggcgccgagactcctgattcacggcccctctcatcgggctcctggggtgcccgaccgcttcagcgccagaggatccggcaccgagttctctcttgtgatcagctccgtcgaacctgatgactttgccatttattactgtcaagagtatagctctacaccctacaatttcgggcctggaacccgggtggatcgcaaaagaacagttgctgccccgtccgtgtttatctttccccctagcgacgaacag

SEQ ID NO: 42409 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccgccacactctccctgtctcctggcgaaagagctacgcttagctgccgggcctcccaagggctgaacttcgtcgtttggtaccagcagaagggaggccaggcgccgcgcctcctgattcacgggcccaccgacagagctcctggagtgcccgatcggttctctgcccgcggcagcgggacagagttctcccttgtgatctctagcgtcgaacctgacgattttgccctgtattactgtcaagagtattccagcaccccctacaatttcggacctggcacaagagtggaccggaaacgcaccgttgctgccccgtctgtgtttatttttcccccttccgatgaacag

SEQ ID NO: 42410 - RNA, 369 nt, synthetic construct
  misc_feature 1..369: note = derived and/or modified sequence opt5 from anti-HIV_Chain
  source 1..369: mol_type = other RNA
gagatcgtgctgacccagagccccgccacactctccctgtctcctggcgaaagagctacgcttagctgccgggcctcccaagggctgaacttcgtcgtttggtaccagcagaagcgcggacaggcgccgagactcctgattcacgctccctctggccgggcccctggggtgcccgaccgcttcagcgccagaggatccggcaccgagttctctcttgtgatcagctccgtcgaacctgatgactttgctatttattactgtcaagagtatagctctacaccctacaatttcgggcctggaacccgggtggatcgcaaaagaacagttgccgctccgtccgtgtttatctttccccctagcgacgaacag

SEQ ID NO: 42411 - RNA, 369 nt, synthetic construct
  misc_feature 1..369: note = derived and/or modified sequence opt5 from anti-HIV_Chain
  source 1..369: mol_type = other RNA
caggtgcaactggtccagagcggcgccgaggttaagaaacccgggtcctctgtgaaggtgagctgcaaaacctccggaggctctttcagcaactacgctttttcctgggtcagacaggcccctggggaaggactcgagtggatgggccggatcattccgatcttcgggacagcgaagtatacgcagaaactgcaaggacgcgtgaccattacagctgacaagtttacctctacagtttacatggaacttagctccctgagaagcgaggataccgccatctattactgtgcctctctccaccagggccccattggctatacaccttggcatccccctccccgggctcctctggggcagtccgtgtgcgga

SEQ ID NO: 42412 - RNA, 369 nt, synthetic construct
  misc_feature 1..369: note = derived and/or modified sequence opt5 from anti-HIV_Chain
  source 1..369: mol_type = other RNA
caggtgcaactggtcgagagcggcgggggactcgttcagcccggcgggtccctgagaatctcttgcagcgccaccggattcacattttccacgcacgctatgcattgggtgcggcaggcccctggcaaggggcttgaatacgtgtctgcgattaacagcaatggacgctccgctttctatgccgactctgtcaaaggcagagtgaccatcagccgggataactccaagaatacactgtttctccagatgaccagcctgcgcgccgaggacacagctgtttactattgtgtgaaaggcccgcttctgagatacctcgattcttgggggcaaggaaccctggtcacagtgtccagcgcctctaccaagggc

SEQ ID NO: 42413 - RNA, 369 nt, synthetic construct
  misc_feature 1..369: note = derived and/or modified sequence opt5 from anti-HIV_Chain
  source 1..369: mol_type = other RNA
gaggtgcagctggtcgaaagcggcgggggactcgttcaacccggcgggtccctgagaatctcttgcagcgccaccggattcacattttccacgcacgctatgcattgggtgcggcaggcccctggcaaggggcttgagtacgtgtctgcgattaacagcaatggacgctccgctttctatgccgactctgtcaaaggcagagtgaccatcagccgggataactccaagaatacactgtttctccagatgaccagcctgcgcgccgaagacacagctgtttactattgtgtgaaaggcccgcttctgagatacctcgattcttgggggcagggaaccctggtcacagtgtccagcgcctctaccaagggc

SEQ ID NO: 42414 - RNA, 369 nt, synthetic construct
  misc_feature 1..369: note = derived and/or modified sequence opt5 from anti-HIV_Chain
  source 1..369: mol_type = other RNA
gaggaaagcggccccgggctggtgaagccttcccagaccctctctctgacatgcagcgtctccggagactctgttagctccggcgggtacttctggtcttggatcagacaacacccgacgaaaggacttgagtgtctgggctatgtgtactataccgggaacacatactataatcccagcctcaagtcccctcccaccattgaagtggccatggctaacaatcaggtcagcctgaaacttggatctgtgacagccgcggataccgctgtttactattgcgcccggatcaagcgctttagaggcggcaactacttcgacacatgggggcatggactgctcgtgaccgtctccagcgcctctacgaaaggc

SEQ ID NO: 42415 - RNA, 369 nt, synthetic construct
  misc_feature 1..369: note = derived and/or modified sequence opt5 from anti-HIV_Chain
  source 1..369: mol_type = other RNA
caggtgcaactgcaggagagcggctccgggctcgtcaagccctctggaaccctgagccttacatgcgccgtttccaacggccctatctctagcgggaattggtggtcctgggtgagacagacgccggaaaaaggactggagtggattggcgaagtgtaccactctgggagcaccaaccataatccctccctcaagagccgggctacaatcctggtcgacaaatctaagaaccagttctcccttaatctgcgcagcgtgaccgccgcggatacagctgtttattactgtgccagagtgcggggatcttggaactttgactattggggccaaggcattctcgtcaccgtgtccagcgcctctacaaaaggg

SEQ ID NO: 42416 - RNA, 369 nt, synthetic construct
  misc_feature 1..369: note = derived and/or modified sequence opt5 from anti-HIV_HeavyChain
  source 1..369: mol_type = other RNA
gaggtgcagctgcaacagagcggcaccgtcctcgccagacccggggcttccgttaagatgtcttgcaaggccagcggatacacattcacgtcctattggatgcactgggtgaagcagcggcctggccaggggctggaatggatcggagcgatttacccgggcaactctgacaccagctataatcaaaaatttaaggggaaagctaaacttacagccgtgacctccgcctctacagcttacatggagctgagctccctcaccaacgaagatagcgccgtctattactgtacacgctggccccattattacggaggctctagatactatttcgactactggggccaggggaccacgctgaccgtgtccagc

SEQ ID NO: 42417 - RNA, 372 nt, synthetic construct
  misc_feature 1..372: note = derived and/or modified sequence opt5 from anti-HIV_Chain
  source 1..372: mol_type = other RNA
gtggtccagctggttgagagcggcgggggactcgtgcaacccggcgggtccctgagactttcttgcgccgctagcggattcgcctttcggtcctactggatgtcttgggtgcgccaggcgcctggcagagggctggaatgggtcgctaatatcaagcaggacggaagcgagaaatattacgccgattccgtgaagggccggttcaccatttctcgcgacaatacgaaaaacagcctctatctgcagatgaactcccttagagccgaagatacagctgtgttttactgtgccagccggggcgaccgctatgggccgatcgattactggggacaaggcaccctggttacagtctcttccgctagcaccaagggg

SEQ ID NO: 42418 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgagatcaagaaacccggggaatccctcaagatttcttgcaaagctagcggatacaccttcaacgactattggatcggctgggttagacagatgcctgggaagggactggagtggatgggcatcttttacccggatgactccgattctaattatagcccctccttccaggggcgggtgacaatttctgccgacaaaagcattacgaccgcgtaccttcaatggtccacactgaaggctagcgattctgccatgtatttttgtgcccgcctcctgggagactccggcgctttcgatatctggggccaggggaccatggtgatcgtcagctctgcctccacaaaggga

SEQ ID NO: 42419 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgggggactcgttaagcccggcgggtccctgagactttcttgcgccgctagcggattcaccttttcctcttacagcatgaactgggtgcggcaggcccctggcaaagggctggagtgggtgtcctctatcagctcctctagctcctatatttactatgcggacagcgtcaagggacgcttcacaatctctagagataatgctaaaaactccctctacctgcagatgaatagccttcgggccgaagacacggccgtgtattactgtgctcgcgagggctcttattactacggcatggatgtttgggggcaaggaaccacagtgaccgtctccagcgcctccacaaagggc

SEQ ID NO: 42420 - RNA, 372 nt, synthetic construct
  misc_feature 1..372: note = derived and/or modified sequence opt5 from anti-HIV_Chain
  source 1..372: mol_type = other RNA
gagatcgtgctgacccagagccccgccacactctccgtctctcctggcgaaagagctacgctgagctgccgggccgggcaatccgtttctagcgaccttgcgtggtaccagcacaagccgggacaggctccccgcctgctcatttatgatgcctccaaaagagccaccggcatccctgctcggttctctgggagcggatccggcacagactttaccctgacaattagctctcttgagcccgaagatttcgccgtgtactattgtcagcatcgcaccaactggcctccctccatcacatttgggcaaggaaccagactggagattaagcggacggtggctgcccctagcgtcttcatctttccgccctctgac

SEQ ID NO: 42421 - RNA, 372 nt, synthetic construct
  misc_feature 1..372: note = derived and/or modified sequence opt5 from anti-HIV_Chain
  source 1..372: mol_type = other RNA
gagatcgtgctgacccagagccccggcacactctccctgtctcctggggaaagagccacgcttagctgccgggcttcccaatctgtcagctcccgctacctggcctggtatcagcagaagccgggacaggcgcccagactcattatctacgacgcttctagccgggcctccggcattcctgatcgcttcagcgggtctggatccgagaccgactttacactgaccatcacaagacttgaacccgaggatttcgccgtttattactgtcaactgtatggcaccagccctaaatttacattcgggcagggaaccaagctcgaaattaaacggacggtggctgccccctctgtgtttatcttccctccgtccgac

SEQ ID NO: 42422 - RNA, 372 nt, synthetic construct
  misc_feature 1..372: note = derived and/or modified sequence opt5 from anti-HIV_Chain
  source 1..372: mol_type = other RNA
gagatcgtgctgacccagagccccggcacactctccctgtctcctggggaaagagccacgcttagctgccgggcttcccaatctgtcagcaacaattacctggcctggtatcagcagaagccgggacaggcgccccgcctcctgatttacggcgcttcctctagagccaccgggatccctgaccggttcagcggatccggcagcgggacagattttacccttacaatttctcgcctggagcccgaagacttcgccgtttattactgtcaacagtatgctacctccagcctctacacatttggacagggcaccaaactggagatcaagagaacggtggccgctccttctgtgttcatttttcccccttccgat

SEQ ID NO: 42423 - RNA, 372 nt, synthetic construct
  misc_feature 1..372: note = derived and/or modified sequence opt5 from anti-HIV_Chain
  source 1..372: mol_type = other RNA
cccgccaccctggctgtgagccctggcgagagagccacaatctcctgcaagtctagccagaacctcctgtactccgcgaataaccaacactctcttgcttggtatcagcagcggccggggcagccccctaaactgctcctgtactgggccagcacgcgcctttccggagtccccgacagattctctggcagcgggtccggaaccgatttcacactgaccattagcaatctccaagccgaagacgttgctgtgtattactgtcagcagtattactctcctccccctacattcggccaggggaccaaggtggagatccggcgcacagtcgccgctccgtccgtgtttatttttccccctagcgatgaacaactg

SEQ ID NO: 42424 - RNA, 372 nt, synthetic construct
  misc_feature 1..372: note = derived and/or modified sequence opt5 from anti-HIV_Chain
  source 1..372: mol_type = other RNA
cagcccgtgctgacccaacctccgagcgcctccggcgctcccgggcagagagtcacaatctcttgcagcggaggcccttccaacgttgggggaaattacgtgtattggtaccggcagttccccggcacggcccctaacctcctgattcttcgcgacgatcagagaccctctggggtgcctgaccggtttagcgcgtccaagtctggaaatagcgcttccctggccatcaccggcctccgcccggatgacgaggccttctatttttgtgctacatacgatagcgacggctctattagactgttcgggggaggcaccgcccttacagtcctgtcccaacccaaagctgcccctagcgtgaccctctttccccct

SEQ ID NO: 42425 - RNA, 372 nt, synthetic construct
  misc_feature 1..372: note = derived and/or modified sequence opt5 from anti-HIV_Chain
  source 1..372: mol_type = other RNA
aacttcatgctgacccagccccctagcgcctccggcgctccggggcaaagagtgacaatctcttgcagcggaggcccctccaatgtcgggggaaactacgtttattggtaccggcagtttcctggcacggcccccaatctcctgattcttcgcgacgatcagagaccttctggggtgcccgaccggttcagcgcgtccaagtctggaaacagcgcttccctggccatcagcggcctccgccctgatgacgaggccttttatttctgtgctacctacgattctgacggctccattagactgtttgggggaggcacaacccttacagtgctgagccagccgaaagccgctccctctgtcaccctcttccctccc

SEQ ID NO: 42426 - RNA, 372 nt, synthetic construct
  misc_feature 1..372: note = derived and/or modified sequence opt5 from anti-HIV_Chain
  source 1..372: mol_type = other RNA
gacatccagatgacccaaagccctccctccctgtctgccagcgtgggcgatagagtcacaattacgtgccaggcttcccaggacatcaacaatttcctcaactggtaccagcaaaagccggggaaagcgccccggctgcttatttatgatgcctctaatctggagagcggagtttcctctcgctttagcggctccagaagcgggaccgacttcacactcaccatctcttccctgcttcctgaagatattgctacatacagctgtcagcagtattctaacctgccctacaccttttcccagggaacaaagctcgagatcaaacggaccgtggccgcccctagcgtgttcatctttcccccttctgacgaacaa

SEQ ID NO: 42427 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcaccgccgttaagagacccggggcttccgtgcgggtgtcttgccaggccagcggatacacattcatcgaccactttatttattggtggcgccaggcgcctggccaagggctcgagtggctgggatggatcaacccgcttacgtcccagccctcttaccctagcagattccagggccggctgaccctcacacgcgatacctttgacgaaatgctgtatatggatcttagagggctgcggtccgacgatacaggaatttacttctgtgctcgcagacattctgactattgcgattttgacatctggggcagcggcacccagattatcgtctccagcgcctctacaaaaggg

SEQ ID NO: 42428 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccaggcgtacggatataagttcaccgaccaccttatttactggtggcggcaggctcctggccaagggctggagtggatcggatggattaaaccggaaacaggccagcccagctattcctacaagtttcaggggcgcgtttctctcacgagagataccttccaggagatcctgtttatggaccttcggggactgcgcagcgatgacacagccatttatttctgtgccagacggcattccgattactgcgactttgatgtgtggggctctggcagccaagtgatcgtctccagcgcttctaccaaaggg

SEQ ID NO: 42429 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccagacctacggatataagttcacagaccaccttatttactggtggcggcaggcgcctggccaagggctggagtggatgggatggatcaaaccggaaacgggccagcccagctattcctaccgctttcaggggagagtttctctcacccgggatacattcgaggaaattgtgtttatggacctgcgcggacttagaagcgatgacaccgctatctatttctgtgcccggcgccattccgattactgcgactttgatgtgtggggctctggcagccaggtcattgtgtccagcgcctctacaaagggg

SEQ ID NO: 42430 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccagacctacggatataagttcacagaccaccttatttactggtggcggcaggcgcctggccaagggctggagtggatcggatggattaaaccggaaacgggccagcccagctattcctaccgctttcaggggagagtttctctcacccgggatacattcgaggaaatcgcttttatggacctgcgcggacttagaagcgatgacaccgccatttatttctgtgcccggcgccatacagattactgcgtgtttgacgtgtggggctccggctctcagatcatcgtcagctccgctagcaccaagggg

SEQ ID NO: 42431 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcaccgccgttaagagacccggggcttccgtgcgggtgtcttgccaggccagcggatacacattcacggactattttatctactggtggcgccaggcgcctggccaagggctcgagtggctgggatggattaacccgcttacctcccagccctcttatcctagcagattccagggccggctgacactcacccgcgatacatttgacgaaatgctgtacatggatcttagagggctgcggtccgacgataccggaatctatttctgtgctcgcagacactctgactactgcgattttgacatttggggcagcggcacacagatcattgtctccagcgcctctaccaaaggg

SEQ ID NO: 42432 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccgttagaatctcttgccaggcgtacggatataagttcaccgaccacctgatttactggtggcggcaggctcctggccaagggcttgagtggatcggatggattaaaccggaaacaggccagcccagctatgcctacaagtttcaggggcgcgtgacgctgaccagagatacattcgaggaaatccattttatggacctccggggagtgcgcaacgatgacaccgccacatatttctgtgctagacggcactccgattactgcgactttgatgtctggggctctggcagccaggtgattgtttcctctgccagcaccaaaggg

SEQ ID NO: 42433 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccgttagaatctcttgccagacctacggatataagttcacagaccacctgatttactggtggcggcaggcgcctggccaagggcttgagtggatcggatggattaaaccggaaacgggccagcccagctattcctaccgctttcaggggagagtgtctctgacccgggatacattcgaggaaatcgtgtttatggacctccgcggactgagaagcgatgacaccgctatttatttctgtgcccggcgccattccgattactgcgactttgatgtctggggctctggcagccaggtgcttgtttccagcgcctctacaaagggg

SEQ ID NO: 42434 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccagacctacggatataagttcacagaccaccttatttactggtggcggcaggcgcctggccaagggctggagtggatcggatggattaaaccggaaacgggccagcccagctattcctaccgctttcaggggagagtttctctcacccgggatacattcgaggaaatcgtgtttatggacctgcgcggacttagaagcgatgacaccgctatttatttctgtgcccggcgccattccgattactgcgactttgatgtgtggggctctggcagccaggtcctggtgtccagcgcctctacaaagggg

SEQ ID NO: 42435 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccgttagaatctcttgccagacctacggatataagttcacagaccacctgattcattggtggcggcaggcgcctggccaagggcttgagtggatcggatggattaaaccggatacgggccagcccagctactcctctcgctttcaggggagagtgagcctgacccgggacacattcgaagagatcgtgtttatggatctccgcggactgagatccgacgataccgctatttatttctgtgcccggcgccactctgactactgcgattttgacgtctggggcagcggctcccaggtgcttgttagctctgcctccacaaagggg

SEQ ID NO: 42436 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccagacctacggatataagttcacagaccaccttatttactggtggcggcaggcgcctggccaagggctggagtggatcggatggattaaaccggaaacgggccagcccagctattcctaccgctttcaggggagagtttctctcacccgggatacattcgaggaaatcgtgtttatggacctgcgcggacttagaagcgatgacaccgctatttatttctgtgcccggcgccattccgattactgcgactttgatgtgtggggctctggcagccaggtcatcgtgtccagcgcctctacaaagggg

SEQ ID NO: 42437 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccagacctacggatataagttcacagaccaccttatttactggtggcggcaggcgcctggccaagggctggagtggatcggatggattaaaccggaaacgggccagcccagctattcctaccgctttcaggggagagtttctctcacccgggatacattcgaggaaatcgtgtttatggacctgcgcggacttagaagcgatgacaccgctatttatttctgtgcccggcgccattccgattactgcgactttgatgtgtggggcggcgggtctcaggtcatcgtgagctccgccagcacaaaggga

SEQ ID NO: 42438 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccttacctacggatataagttcacagaccacctgatttactggtggcggcaggcgcctggccaggggctcgagtggatcggatggattaaaccggaaacgggccaacccagctattcctaccgctttcaggggagagtttctctgacccgggatacattcgaggaaatcgtgtttatggaccttcgcggactgagaagcgatgacaccgctatttatttctgtgcccggcgccattccgattactgcgactttgatgtgtggggctctggcagccaggtcatcgtgtccagcgcctctacaaagggg

SEQ ID NO: 42439 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccaccctcaagaaacccggggcttccgttagaatctcttgccaggcctacggatataagttcacagaccacctgattcattggtggcggcaggcgcctggccaagggcttgagtggatcggatggattaaaccggaaacgggccagcccagctacgcttataagtttcaggggcgcgtgtccctgaccagagatacattcgaggaaatcctctttatggacctgcggggacttcgctctgatgacaccgccatttacttctgtgccagacggcacagcgattattgcgacctggatgtgtggggcggcgggacacagctcctggtctcctctgctagcaccaaagga

SEQ ID NO: 42440 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccgttagaatctcttgccaggcgtacggatataagttcaccgaccacctgatttactggtggcggcaggctcctggccaagggcttgagtggatcggatggattaaaccggaaacaggccagcccagctattcctacaagtttcaggggcgcgtgacgctgaccagagatacattcgaggaaatccattttatggacctccggggactgcgctatgatgacaccgccacatacttctgtgccagacggcactctgattattgcgactttgatgtgtggggcagcggctcccaggtctctgtgagctccgctagcaccaaaggg

SEQ ID NO: 42441 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccaggcgtacggatataagttcaccgaccaccttatttactggtggcggcaggctcctggccaagggctggagtggatcggatggattaaaccggaaacaggccagcccagctattcctacaagtttcaggggcgcgtttctctcacgagagataccttccaggagatcctgtttatgaaccttcggggactgcgcagcgacgatacagccatttatttctgtgccagacggcattccgactactgcgattttgacgtgtggggctctggcagccaaatcctcgtgtccagcgcttctaccaaaggg

SEQ ID NO: 42442 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcaccgccgttaagaaacccggggcttccgtgagagtgtcttgccaggccagcggatacacattcacggactattttatctactggtggcggcaggcgcctggccaagggctcgagtggctgggatggattaacccgcgcacctcccagccctcttatccttacagattccagggccgggtcacacttacccgcgatatctttgaagagatgctgtatatggacctcagagggctgcggagcgatgacacaggaatttacttctgtgctcgcagacactccgattattgcgactttgatatctggggctctggcacccagattatcgtgagctccgccagcacaaagggg

SEQ ID NO: 42443 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgctctcaagaaacccggggcctccctgagaatctcttgccaggcgtacggatataagttcaccgactaccttattcactggtggcggcaggctcctggccaagggctggagtggatcggatggattaaaccggaaacaggccagcccagctattcctacaagtttcaggggcgcgtttctctcacgagagataccttcgaggaaatcctgtttatggaccttcggggactgcgcagcgatgacacagccatttatttctgtgccagacggcattccgattactgcgactttgatgtgtggggcggcgggtctcaggtgctcgtcagctccgctagcaccaaagga

SEQ ID NO: 42444 - RNA, 372 nt, synthetic construct
  misc_feature 1..372: note = derived and/or modified sequence opt5 from anti-HIV_Chain
  source 1..372: mol_type = other RNA
gaggtgcagctgctcgaaagcggcggggccctggtccaacccggaggctcccttagactgtcttgcgctgccagcgggttcaccttttccacatctagcatgtcctgggttcggcaggcgcctggaaagggcctcgagtgggtgtctgctatcgggagcggacgcggctccacgttctacgccgacagcgtgaaaggcagatttaccatttctcgggataactccaagaatacactgagccttcagatgaactctctgaccgccgaagacacagctacctattactgtacaaaaaccgggggactcctgcgcttcccggaggtctggggcaaggggacgaccgtgacagtttccagcgcctctaccaaagga

SEQ ID NO: 42445 - RNA, 372 nt, synthetic construct
  misc_feature 1..372: note = derived and/or modified sequence opt5 from anti-HIV_Chain
  source 1..372: mol_type = other RNA
gaggtgcagctggtcgaaagcggcgggggactcgttaagcccggcgggtccctgagactttcttgcgccgacagcggattcacctttcggtcctactctatgcactgggtgcgccaagctcctggcaaagggctggcctgggtgagctccatctctagcacatccaactatatttactatgcggatagcgtcaagggaagattcacgatctctcgggacaatgctaaaaactccctctacctgcagatgaatagccttcgcgccgaggataccgccgtgtattactgtgctagaacatttattaccgcctcttggttcgactcctggggccagggcacactggttaccgtgagctctgcttccacaaagggg

SEQ ID NO: 42446 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgaggttaagaaacccggggcttccgtgaaggtgtcttgcaaagccagcggatacaccttcacaaactatggcgtctcctgggtgagacaggcgcctgggcagggactcgaatggatgggctggatctctccgtacagcgggaatacgaactatgctcaacggctgcaggaccgcgttaccatgacaaccgatacatccaccaatacagcctacatggagcttagatctctgcggagcgacgataccgccgtgtattactgtgctgcccgctcctattactactatagcatggacgtctggggacagggcacgaccgtgacagtttcttccgctagcaccaagggc

SEQ ID NO: 42447 - RNA, 372 nt, synthetic construct
  misc_feature 1..372: note = derived and/or modified sequence opt5 from anti-HIV_Chain
  source 1..372: mol_type = other RNA
caggtgcaactggtccagagcggcgccgagctcaagaaacccgggtcctctgttaaggtgagctgcaaggcttccggaggcaccttctctaactacgccatcaattgggtgagacaggcgcctgggcagggatttgaatggatgggcgggattatcccgctgttcgctacacccacgtatgcccaaaaatttcagggacgggtccgcattaccgccgacgatagcacatccaccgcttacatggagctttctagcctgagatccgacgatacagccgtgtatttctgtgctcggcctaacgttgtgcgcagcgccctcgactactggggccagggcaccctggtcacagtgtcttccgcgagcaccaaaggg

SEQ ID NO: 42448 - RNA, 372 nt, synthetic construct
  misc_feature 1..372: note = derived and/or modified sequence opt5 from anti-HIV_Chain
  source 1..372: mol_type = other RNA
caggtgcaactggtcgagagcggcgggggagttgtgcagcccggcaagtccctcagactgtcttgcgccgctagcgggttcaccttttccacacacgccatgcattgggtgcggcaggcgcctggaaaaggccttgactgggtcgctgtgatctctcacgatggggacaaccagtactatgccgatgccgttaagggacgcttcacgattagcagagacgattcccgggacaccgtgtttctgcaaatgaactctctccgcacagaagataccggcgtctactattgtgctgccgacagctccggcagcaattggttcgattactgggggcagggaatcctggtgacagtttcttccgctagcaccaaaggc

SEQ ID NO: 42449 - RNA, 375 nt, synthetic construct
  misc_feature 1..375: note = derived and/or modified sequence opt5 from anti-HIV_Chain
  source 1..375: mol_type = other RNA
caggtgcggctgagccaatccggcgggcagatgaagaaacccggagagtctatgcggctcagctgccgcgcctccggctacgagttcctgaactgtcctatcaattggattagacttgctccggggcggcgccccgaatggatgggatggctgaagcctagaggcggggccgtcaactatgcgcggaaatttcagggacgcgttaccatgacaagagacgtgtactctgatacggctttcctcgaactgcggagccttacctccgacgatacagccgtgtatttttgcacccgcggcaagtactgtacagccagagactattacaattgggatttcgagcactggggcagaggggctcccgtcaccgtgtctagc

SEQ ID NO: 42450 - RNA, 375 nt, synthetic construct
  misc_feature 1..375: note = derived and/or modified sequence opt5 from anti-HIV_Chain
  source 1..375: mol_type = other RNA
gaggtgcagctggtccaaagcggctccgacgttagaaagcccggggccaccgtgacagtgtcttgcaaagctgatgaagacgaggatgacttcacggcctacaactattttatgcactgggtccggcaggcgcctggacatggcctcgaatggatcgggtggattaatccgcgcaccggacagcccaaccacgctaagcagttccaaggcagagtgacactgacccgggagcgcagcacatccaccgtttttatgaaacttacaaatctgagactcgatgacaccgccgtgtacttctgtgcccggcctctgcgcgggggagatacgtggcattatcactcttggggcagaggcaccagccttacagtctcctct

SEQ ID NO: 42451 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcgggggactcgttcagcccggcgagtccctgagactttcttgcaccgccagcgggttcacattttcctcttacaacatgaattgggtgcggcaggctcctggaaagggcctggaatggatcagctatatttccgacaaatctaagaacaaatactatgccgatagcgtgcgcgggagattcacgatctcccgggacaatgcgcaaaacagcctctttctgcagatgtcttcccttcgcgatgaggacaccgctgtctactattgtacaagagaaggaccgcagcggagcttctactttgattattggggccagggcattcaagtgaccgtttcttccgccagcacaaagggg

SEQ ID NO: 42452 - RNA, 375 nt, synthetic construct
  misc_feature 1..375: note = derived and/or modified sequence opt5 from anti-HIV_Chain
  source 1..375: mol_type = other RNA
gaggtgcagctggtcgaaagcggcgccgaggttaagaaacccgggtcctctgtgaaggtgagctgcaaggcttccggaggcaccttctctagctactccatctcttgggtcagacaagcccctgggcagggactcgaatggatgggcgggattatcccgatttttgcgacaacgcactatggacagaaattccagggccggatcaaaattaccgctgacaagagcacatccaccgcctacatggagctgagccgccttagatctgaagatacagccgtgtattactgtgctcgggaccgcgagttttatttctacggcatggatgtttgggggcaaggaaccacagtgaccgtctccagcgcctctacgaagggc

SEQ ID NO: 42453 - RNA, 375 nt, synthetic construct
  misc_feature 1..375: note = derived and/or modified sequence opt5 from anti-HIV_Chain
  source 1..375: mol_type = other RNA
cagctgcaactccaggagagcggccccgggctggtgaagccttgggaaacccttgtcctgacatgctccgtttctggaggcagcatctcctctggggactactattggggatggattagacagagcccgggcaaagggcccgagtggatcggaaacattttctactcctctggcaatacgtattacaacaccagcctcaagtcccgggtgacaatcagcgtggatgtctctaaaaatcgcttttccctgaaacttaccagcatgacagccgctgacaccgccgtgtattactgtggcagactgtctaacaaggggtggttcgatccttggggacagggcacactcgtttccgtgagctctgcgtccaccaagggg

SEQ ID NO: 42454 - RNA, 375 nt, synthetic construct
  misc_feature 1..375: note = derived and/or modified sequence opt5 from anti-HIV_Chain
  source 1..375: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcgatacagactttacccttacaatttcttccctggagcccgaagatttcgccgtttattactgtcaacagcgcggaatctggcctctccagattacctttggccaggggacaagactggagatcaaacggaccgtggctgcccccagcgtgttcatctttcctccgtctgacgaa

SEQ ID NO: 42455 - RNA, 375 nt, synthetic construct
  misc_feature 1..375: note = derived and/or modified sequence opt5 from anti-HIV_Chain
  source 1..375: mol_type = other RNA
agcgagatcgtgctgacccagtcccccggcacactctctctgagccctggggaaagagccacgctttcctgccgggcttctcaaagcgtctcctctagctacctggcctggtatcagcagaagccggttcaggcgccccgcctcctgatttacggagcttccagcagagccaccggcatccctgaccggttctctgggtccggaagcggcacagattttacccttacaatttctcgcctggagcccgaagacttcgccgtgtattactgtcaacagtatgggaccctccaccctagaacatttggacagggcaccaaagtggagatcaagcggacggtcgctgccccctccgtgttcatttttcctccgagcgat

SEQ ID NO: 42456 - RNA, 375 nt, synthetic construct
  misc_feature 1..375: note = derived and/or modified sequence opt5 from anti-HIV_Chain
  source 1..375: mol_type = other RNA
agccaggccgtggtcacccaacccccttccgtttctggcgctccggggcagagagtgacaatcagctgctccggaggcccctctaacgtcgggggaaatctggtgtactggtataagcagttccctggcacggcccccaaactcctgattcggcgcgacgatcagagacctagcggggtgcccgaccggttttccggatctaagagcggcaactccgcgagccttgctatctctggcctgcgccctgatgacgaggccttctacttttgtgccacctatgattcccacgggagcattagactcttcggaggcgggacactgcttaccgttctgtctcaaccgaaagctgccccctccgtgacactctttcctccc

SEQ ID NO: 42457 - RNA, 375 nt, synthetic construct
  misc_feature 1..375: note = derived and/or modified sequence opt5 from anti-HIV_Chain
  source 1..375: mol_type = other RNA
gacatccagatgacccaaagcccctccacactggccgcttctattggcgggacggtgagagtcagctgccgggcctcccagtctatcaccggaaactgggttgcgtggtaccagcagcgccctggcaaggctccgagactcctgatttatcgcggggccgcccttctgggaggcgtgcccagccggttctccgggtctgctgccggaacagattttaccctcacaatcggcaatctgcaagctgaggacttcggcaccttttactgtcagcagtatgatacataccctgggaccttcggacagggcacgaaagtggaagtcaagagaaccgtggccgcgcccagcgtttttattttccctccctccgacgagcaa

SEQ ID NO: 42458 - RNA, 375 nt, synthetic construct
  misc_feature 1..375: note = derived and/or modified sequence opt5 from anti-HIV_Chain
  source 1..375: mol_type = other RNA
gagatcgtgatgacccagagccccgacacactgtccgtctctcctggcgaaagagccacgctcagctgccgggcttcccaatctgttaacagcaatctggcctggtaccagcagaagccggggcaggcgccccgccttctgatttatggagcttccaccagagccacagccgtgcctgctcggttctctggcagcgggtccggaaccgagtttacactcaccatcagctctctgcaatccgaagatagcgccgtgtactattgtcagcagtactatcagtggctttcttacacattcggccaagggaccaaactggagattaagcgcacggtcgctgccccctccgtgtttatcttccctcccagcgacgaacag

SEQ ID NO: 42459 - RNA, 375 nt, synthetic construct
  misc_feature 1..375: note = derived and/or modified sequence opt5 from anti-HIV_Chain
  source 1..375: mol_type = other RNA
agacaggtgcaactggtccagagcggcgccgctctcaagaaacccggggcctccctgcggatctcttgccaggcgtacggatataagttcaccgaccaccttatttactggtggcgccaggctcctggccaagggctggagtggatcggatggattaaaccggaaacaggccagcccagctattcctacaagtttcaggggagagtttctctcacgcgggataccttccaggagatcctgtttatggaccttcgcggactgagaagcgatgacacagccatttatttctgtgcccggcgccattccgattactgcgactttgatgtgtggggctctggcagccaaatcctcgtgtccagcgcttctaccaaaggg

SEQ ID NO: 42460 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcgccgctctcaagaaacccggggcctccgttagaatctcttgccaggcgtacggatataagttcaccgactacctgattcactggtggcggcaggctcctggccaagggcttgagtggatcggatggattaaaccggaaacaggccagcccagctattcctacaagtttcaggggcgcgtgacgctgaccagagatacattcgaggaaatcctctttatggacctgcggggacttcgctctgatgacaccgccatttatttctgtgccagacggcatagcgattactgcgactttgatgtgtggggctccggctctcaggtcatcgtgagctccgctagcacaaaaggggcc

SEQ ID NO: 42461 - RNA, 375 nt, synthetic construct
  misc_feature 1..375: note = derived and/or modified sequence opt5 from anti-HIV_Chain
  source 1..375: mol_type = other RNA
gaggtgcagctggtcgaaagcggcgggggactcgttaagcccggcgggtccctgagactttcttgcgccgctagcggattctccttttctgagcactacatgagctggatccggctggcccctggcaaagggctcgaatggctgtcctatatttctagctccacccgcacaacgtacagcgcggactctgtgagaggacggttcaccatctcccgcgatacagctaagcaacttctgtttctccatatgagctctctgagagccgaggacaccgccgtgtattactgtgtccggctgtatggcggcattaacgggtggttcgatcagtggggacagggcacactcgtgtccgttagctctgcttccaccaaaggg

SEQ ID NO: 42462 - RNA, 375 nt, synthetic construct
  misc_feature 1..375: note = derived and/or modified sequence opt5 from anti-HIV_Chain
  source 1..375: mol_type = other RNA
caggtgcaactggtccagagcggccccgggctcgttaagccttccgagaccctgtctcttacatgcagcgtgtccaacggatctatcagctccggcgggtactattggtcttggctgagacagttcccgggaaaaggcctcgaatggattgggagcatccactacacgggacggaccttttataatccctccctgatgggccgcacagcccttagcatggacacctctaacaatcagttctccctgaaggtgagctctgtcacagctgccgataccgcgctctactattgtgctagagagctgcaatggatgtttgtggttgacccttggggccaggggacactggtgaccgtctccagcgcctctacgaaagga

SEQ ID NO: 42463 - RNA, 375 nt, synthetic construct
  misc_feature 1..375: note = derived and/or modified sequence opt5 from anti-HIV_Chain
  source 1..375: mol_type = other RNA
caggtgcaactgcaggagagcggccccgggctcgtcaagccttccgaaaccctgtctcttacatgcagcgtttccaacggatctatcagctccggcgggtactattggtcttggctgagacagttcccgggaaaaggcctcgagtggattgggagcatccactacacgggacggaccatgtataatccctccctgatgggccgccctgcccttagcatggacacatctaacaatcagttttccctgaagctcagaagcgtgaccgctgccgatacagcgctgtacttctgtgctcgggacctgcaatggatttttgtggtcgatccctggggccaggggaccctcgtgacagtttcttccgccagcaccaaagga

SEQ ID NO: 42464 - RNA, 375 nt, synthetic construct
  misc_feature 1..375: note = derived and/or modified sequence opt5 from anti-HIV_Chain
  source 1..375: mol_type = other RNA
gaggtgcagctgctcgaaagcggcgggggactggtccaacccggcgggtcccttagactgtcttgcgccgttagcggattcacctttggcgggcacgctgtgtcctgggtgcggcaggcccctggaaagggcctcgagtggctgtctcagatcagcggcacagggtcccgcacggactacgcggatgctgtcaaaggaagattcaccgtgtctcgggacaatagcaagaaaacagtttatcttcagatgaactccctgcgcgtggaagataccgccctcttttactgtgccacaagaagcccgggcgggggatatgctttcgacatttggggccaaggggccatggtcaccgtgtcttccgctagcacaaaggga

SEQ ID NO: 42465 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcgccgaggttaagaaacccgggtcctctgtgaaggtgagctgcaaagtctccttcttttctaactacggaatcagctgggtgagacagcggcctggccaggggctcgaatggatgggacgcattatcccggctattgacgatatgacctatgcccaaacattcagaggccgggttacgttttccgcggacaagttcaccacaaccgcttacatggagctgacagggcttacctttgaagatacagccacctatttctgtgcccgcgacccccaggtgaatagacggggaaactgctttgatcactggggccagggcacgctggtcaccgtgtctagcgcttccacaaaaggg

SEQ ID NO: 42466 - RNA, 375 nt, synthetic construct
  misc_feature 1..375: note = derived and/or modified sequence opt5 from anti-HIV_Chain
  source 1..375: mol_type = other RNA
caggtgcaactgcaggagagcggccccgggctcgtcaagccttccgaaaccctgtctcttacatgcacggttagcggaggctccatctcttactattactggagctggattagacagccgcccgggaaaggactggagtggatcggcgacatttattactccgggaccacagattataacccttctctcaagagccgggtgaccatctccgtggacacaagcaaaaatcagttctctctgaaactttccagcgtcaccgccgctgatacagccgtgtactattgtgcgcgcagacggggacaacgcctgctcgcttactttgactactggggccagggctctctggttaccgtgtccagcgcctctacgaagggg

SEQ ID NO: 42467 - RNA, 375 nt, synthetic construct
  misc_feature 1..375: note = derived and/or modified sequence opt5 from anti-HIV_Chain
  source 1..375: mol_type = other RNA
caggtgcaactgcaggaaagcggccccgggcctgtcaagccgtccgaaaccctctctctgacatgcacggttagcggaggctccatgatctcttactattggagctggattagacagccccctgggaaaggacttgagtggatcggctacattttcaccaacgggcggacaacctattccccctctctgcgcagcagagtgacaatctccctcgacaccagcacaaatcacttttctctgcggcttaagtccgtgaccgccgctgatacggccatttactattgtgcgcgcctggacggagaggctttcagatactatctcgatctgtggggccagggcaacctggtcaccgtgagctctgcctccacaaaaggg

SEQ ID NO: 42468 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcgccgaggttaagaaacccggggcttccgtgaaggtgtcttgcaaacctagctccaacaccttcacatctcactacatccattgggtcagacaggccccgggacagggcctcgaatggatggggatgattaatcccggaggcagcacgcggtatgcgcctaagtttcaagggcgcgtgaccctgacaagagacacctccacacggaccgtttacatggagctttctagcctgcgctccgaagatacagctgtgtattactgtgccagaccccagtataacctcggacgggaccctctggatgtctggggccttggcaccatggtgacggttagctctgcctccaccaaaggg

SEQ ID NO: 42469 - RNA, 375 nt, synthetic construct
  misc_feature 1..375: note = derived and/or modified sequence opt5 from anti-HIV_Chain
  source 1..375: mol_type = other RNA
caggtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatcaaccactctggaagcacgaattataacccctccctgaagtctcgggttaccattagcgtggacacatccaaaaatcaatttagccttaagctgtcttccgtgaccgccgcggatacagctgtctactattgtgcccgcctccctatcggcagcggctggtacgggagagactattggggacagggcaccctggtgacagtttcttccgccagcaccaaaggg

SEQ ID NO: 42470 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcgccgaggttaagaaacccggggcttccgtgaaggtgtcttgcaaagccagcggaaacaccttcacatcctacggcatcacgtgggtcagacaggcgcctgggcagggactcgaatggatgggctggatttctgcttataatgggaacaccaattacgcccaaaagctgcaggaccggcttacaatgaccacagataccagcacatccaccgcctatatggagctgcgctctctcagaagcgacgatacggctgtgtactattgtgccttttcccggcactacggaagcggcaactatgactactggggccaggggaccctggttacagtgtcttccgctagcaccaaagga

SEQ ID NO: 42471 - RNA, 375 nt, synthetic construct
  misc_feature 1..375: note = derived and/or modified sequence opt5 from anti-HIV_Chain
  source 1..375: mol_type = other RNA
cagttcagactggtgcaaagcggccccgaggtcaagaaccctgggtcctctgttaccgtgagctgcaaagcctccggaggcacattttctgggctcggaatcaattgggtgcggcaggctccgggccaggggctggaatggcttggagacattaagacgatgtacggcaccacaaactatgcccccaaattccagggccgcgtcaccatcacagcggatgagagcacctccacatcttacatggaactgagcgggctcagatccgaggacaccgctgtgttttattgtgttcgggaactgttcggacaccatcctgcctttggcgtgtgggggcaaggaacgagcgtcattgtgtcttccgccagcaccaagggc

SEQ ID NO: 42472 - RNA, 375 nt, synthetic construct
  misc_feature 1..375: note = derived and/or modified sequence opt5 from anti-HIV_Chain
  source 1..375: mol_type = other RNA
agagtgcagctggtccaaagcggcgccgaggttaagaaacccgggtcctctgtgaccgtgagctgcaaggcttccggaggctctttcagctcctacgccatctcttgggtccggcaggcgcctgggcagggactcgaatgggtgggcggggttaaagtgatgtttggaacagtccactatagccagaaggtgcaaggccgcgttacgattaccgctgacgattccacaggcaccagctacctggagctttctgggctgagatccgccgacacagccgtgtattactgtgctcggaacgccggagcttatttctacccgtttgatatctggggccaggggaccctcattatcgtcagctctgcctccacaaaagga

SEQ ID NO: 42473 - RNA, 375 nt, synthetic construct
  misc_feature 1..375: note = derived and/or modified sequence opt5 from anti-HIV_Chain
  source 1..375: mol_type = other RNA
caggtgcaactgcaggagagcggccccgggctcgtcaagccttccgaaaccctgtctcttacatgcacggttagcggaggctccatctctagcagatcctactattgggggtggattcggcagccgcccggaaaaggcctggagtgggtggggtctatctactataccggaagcacatactattcccctagcctcaagtctcgcgtgaccatttccgtcgacacaagccagaaccaattctctctgaaacttaattccgtgaccgccgctgatacagccgtttactattgtgcgagacagaagggcagcggcacctctctgctctactgggggcagggaacgctggtgaccgtctccagcgcttccacaaaaggc

SEQ ID NO: 42474 - RNA, 375 nt, synthetic construct
  misc_feature 1..375: note = derived and/or modified sequence opt5 from anti-HIV_Chain
  source 1..375: mol_type = other RNA
caggtgcaactggtccagagcggcaccgaggttaagaaacccgggtcctctgtgaaggtgagctgcaaagcctccggaggcacattctctgacagcgatatcgcttgggtcagacaggcccctgggcagggactcgaatggatgggcgggattacgccgatgtttgacatggcgaagtccgctcaaaaattccggggacgcctgatcattaccgccgataagtctacaggcaccgcctacatggagcttagctccctgagatatgaagacgctgccgtgtacttttgtgctcggagctctggcaacttcgagtttgccttcgaaatctgggggcagggaacaaagattatcgtttccctcgcgagcaccaaaggc

SEQ ID NO: 42475 - RNA, 375 nt, synthetic construct
  misc_feature 1..375: note = derived and/or modified sequence opt5 from anti-HIV_Chain
  source 1..375: mol_type = other RNA
gtggtccagctggttcaaagcggcaccgaggtgaagaaacccgggtcctctgtgaaggtcagctgcaaagcctccggaggcacattctctgggagcgacatctcctgggtgagacaggctcctggacagggcctcgaatggatgggagggattatcccgatgtttgatattgaggaccacgcccagaagttccggggccgcctgacgatcaccgcggataaatctacaggcgctgcctacatggaacttagctccctgagaagcgaggacgccgctgtttattactgtgcccggtcttccgggaactatgattttgctttcgacatttggggacaaggcacccgcctcatcgtgagctctgcctccacaaagggg

SEQ ID NO: 42476 - RNA, 375 nt, synthetic construct
  misc_feature 1..375: note = derived and/or modified sequence opt5 from anti-HIV_Chain
  source 1..375: mol_type = other RNA
gtggtccagctggttgagagcggcaccgaagtgaagaaacccgggtcctctgtgaaggtcagctgcaaagcctccggaggcacattctctgggagcgacatctcctgggtgagacaagctcctggacagggcctcgagtggatgggagggattatcccgatgtttgatattgaaaaccacgccgagaagttccggggccgcctgacgatcaccgcggttaaatctacaggcgctgcctacatggaacttagctccctgagaagcgaggacgccgctgtgtattactgtgcccggtcttccgggaattatgattttgcttacgacatttggggacagggcacccgcgtcatcgtgagctctgcctccacaaagggg

SEQ ID NO: 42477 - RNA, 378 nt, synthetic construct
  misc_feature 1..378: note = derived and/or modified sequence opt5 from anti-HIV_Chain
  source 1..378: mol_type = other RNA
caggtgcaactggtccagagcggctccgccatgaagaaacccggggcttctgttagagtgagctgctggacctccgaggacatcttcgatacaacggaactcattcactgggtgcggcaggcccctggacagggcctggagtggatcgggtgggtcaaggcggtgtctggagctgttaactacggcagccttgactttcgccatagagtgtccctgacccgggatcgcgacctctctacagcccacatggatattagagggctgacccaagacgatacagccacctatttctgtgctcggcagaaatttgcccgcggagaccagggctggttctttgatctttggggcagagggacactgatcgtcgtgagctccgct

SEQ ID NO: 42478 - RNA, 378 nt, synthetic construct
  misc_feature 1..378: note = derived and/or modified sequence opt5 from anti-HIV_Chain
  source 1..378: mol_type = other RNA
caggtgcaactgcaggagagcggccccgggctcgtcaagccttccgaaaccctgtctcttacatgcacggttagcggaggctccatctctaaccactactggagctggattagacagccgcccgggaaaggactggagtggatcggctatatttaccattccgggaatatcaactataagtctagcctcaaatcccgggccaccattagcatcgacacatctaataaccagttctccctgaaacttagctctgtgatcgctgccgataccgcggtgtactattgtgctcgcaattttggacctggctcccccaactacggcatggacgtctgggggcaaggaacaaccgtgacagttagctctgcctccaccaagggc

SEQ ID NO: 42479 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgggggagttgtgcagcccggcagatccctccggctgtcttgcgccgctagcgggttcaccttttcccaccatggaatccactgggtgcgccaggcccctggcgaggggcttgaatgggtcgcggtgatttctgaggacggaacaaacatccattacgaagatagcgttagaggccggttcacgatttcccgcgacaattctaagaacaccgtggatctgcaaatgaatagcctcagagctgaggacacagccgtctattactgtgcctccctgatcagcatgcgggatggcgacgcttttgatctttgggggcagggaacccgcgtgacagtttcttccgccagcaccaaaggc

SEQ ID NO: 42480 - RNA, 378 nt, synthetic construct
  misc_feature 1..378: note = derived and/or modified sequence opt5 from anti-HIV_Chain
  source 1..378: mol_type = other RNA
caggtgcaactggtcgagagcggcgggggactcggccagcccgggggatccctgagactttcttgcgccgctagcggcttcacctttcggaactacgccatgtcctgggttcgccaggcggctgggaagggactggaatgggtgtctggcgtgagcggcgggggagacacaacgtattacggcgattccgtcaaagggagattcaccatctctcgggacaatagcaagaacacactctatctgcagatgaataaccttcgcgccgaggataccgccgtgtactattgtgctaaagacaagggagtttggggctccagcgattttgactactgggggcaaggaacactggtgaccgtctcttccgccagcacaaaaggc

SEQ ID NO: 42481 - RNA, 378 nt, synthetic construct
  misc_feature 1..378: note = derived and/or modified sequence opt5 from anti-HIV_Chain
  source 1..378: mol_type = other RNA
gaggtgcagctggtcgaaagcggcgggggagttgtgcaacccggcagatccctccggctgtcttgcgccgctagcgggttcaccttttcccaccatggaatccactgggtgcgccaggcccctggcgaggggcttgaatgggtcgcggtgatttctgaggacggaacaaacatccattacgaagatagcgttagaggccggttcacgatttcccgcgacaattctaagaacaccgtggatctgcagatgaatagcctcagagctgaggacacagccgtctattactgtgcctccctgatcagcatgcgggatggcgacgcttttgatctttgggggcagggaacccgcgtgacagtttcttccgccagcaccaaaggc

SEQ ID NO: 42482 - RNA, 378 nt, synthetic construct
  misc_feature 1..378: note = derived and/or modified sequence opt5 from anti-HIV_Chain
  source 1..378: mol_type = other RNA
agaggccccgtgaccctggccgtcagcctcggggagcgggctacaatcacgtgcaagtcctctcagagcgttctggtgcactccaacaataaaaactacctttcttggtatcaacagaagcctggacagccgcccaaactgctcatttactgggccagcacccgcgaatccggcgtgcctgagagattctctgggagcggatccggcacagactttaccctgagcatctcttcccttcaggcggaagatgtcgctgtgtattactgtcatcaatatttcagcacaccccggacctttgggcagggaacaaaggttgagattaaaggcaccgtggccgccccttctgtcttcatctttcccccttccgacgaacagctg

SEQ ID NO: 42483 - RNA, 378 nt, synthetic construct
  misc_feature 1..378: note = derived and/or modified sequence opt5 from anti-HIV_Chain
  source 1..378: mol_type = other RNA
agcgagatcgtgatgacccagtcccccgccacactgtctatgagccctggcgaaagagctacgctctcctgccgggcctctctgagcgtcaacaccaatcttgcgtggtaccaacagaagccggggcaggctccccgcctgctcatttatggagcctccacaagagccaccggcatccctgctcggttctctgggagcggatccggcacagagtttaccctgacaattagctctcttcagtccgaagacttcgccctgtactattgtcaacagtacaaccactggccccagacctttgggcagggaacgaaagttgagatcaagcgcaccgtggctgcccctagcgtgttcatttttcccccttctgatgaacaaaaa

SEQ ID NO: 42484 - RNA, 378 nt, synthetic construct
  misc_feature 1..378: note = derived and/or modified sequence opt5 from anti-HIV_Chain
  source 1..378: mol_type = other RNA
agcgagatcgtgctgacccagtcccccgccacactctctctgagccctggcgaaagagctacgctttcctgccgggcctctcaaagcattaacaattacctggcgtggtatcagcagaagccggggcaggctccccgcctcctgatctacgacgcctccaacagagccaccggcattcctgctcggttctctggagggggaagcggcacagattttacccttacaatctccagcctggagcccgaagacttcgccgtctattactgtcaacagcgcgctaattggagactcctgacctttgggggaggcacaaaagttgagattaagcggaccgtggccgcgccttctgtgttcatctttcccccttccgatgaacag

SEQ ID NO: 42485 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcggggccgttaagaaacccggagcttccgtgaaggtgtcttgcgagacctacggctatacattcacggaccactttatgcattggtggagacaggcccctgggcagggactcgaatggatgggctggatcaacccgtacagctccgcggtctcttatagcccccggtaccaagggcgcgtgaccatgacaagagataccttcctggagacagtttatatggaacttcggggactgaaatttgacgataccgctatttactattgtgccacacctaagtccggccgcgactactggtctttcgatctctggggccaggggaccctggtgacggtcagctccgccagcaccaaagga

SEQ ID NO: 42486 - RNA, 378 nt, synthetic construct
  misc_feature 1..378: note = derived and/or modified sequence opt5 from anti-HIV_Chain
  source 1..378: mol_type = other RNA
agccaggtgcaactggtcgagtccggccccgggctcgttaagccttctgaaaccctgagccttacatgctccgtgtctaacggaagcatctcctctggcgggtactattggagctggctgagacagttcccgggaaaaggcctcgagtggattgggtccatccactacacgggacggaccatgtataatcccagcctgatgggccgccctgccctttctatggacacatccaacaatcagtttagcctgaagctctcttccgtgaccgctgccgatacagcgctgtacttctgtgctagagacctgcagtggatttttgtcgtggatccctggggccaagggaccctcgttacagtgagctctgcctccaccaaagga

SEQ ID NO: 42487 - RNA, 378 nt, synthetic construct
  misc_feature 1..378: note = derived and/or modified sequence opt5 from anti-HIV_Chain
  source 1..378: mol_type = other RNA
agcgtggtccagctggttgagtccggccccgggctcgtgaagccttctgaaaccctgagccttacatgctccgtgtctaacggaagcatctcctctggcgggtactattggagctggctgagacaattcccgggaaaaggcctcgagtggattgggtccatccactacacgggacggaccatgtataatcccagcctgatgggccgccctgccctttctatggacacatccaacaatcagtttagcctgaagctcagatctgtcaccgctgccgatacagcgctgtacttctgtgctcgggacctgcagtggatttttgtggttgatccctggggccaggggaccctcgtgacagtctccagcgcctctaccaaagga

SEQ ID NO: 42488 - RNA, 378 nt, synthetic construct
  misc_feature 1..378: note = derived and/or modified sequence opt5 from anti-HIV_Chain
  source 1..378: mol_type = other RNA
agcggcgggagactggtgcagcccggaggctccctccggctgtcttgcagcgcctccgggttcaccctttctaacagcgctatgtcctgggtccgccaagcccctggaaagggcctggagtgggtttctagcatcctctccagcggggtgggaacattttacgcggactctgtgaaaggcagattcacggtctcccgggataatagccgcaacaccctgtatcttcagatgaagtctctgagagctgaagacacagccctctactattgtgccaaagtgcagattcagcaactgaattttggcgttatcaccgatgctgggctggacgtgtggggaaagggcacaaccctcattgtctccagcgcctctacaaaaggg

SEQ ID NO: 42489 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgctgttaagaaacccggggcctccgtgaaggtgtcttgcgaggcgtacggatataaattcaccgaccactttatgcattggtggagacaggctcctggccaggggctcgaatggatgggatggatcaacccgtacacaagcgccgtcaattattcccccaagtaccaaggccgggtgacgatgacccgcgatacattcctggagaccgtttatatggaacttagagggctgcgggtggacgatacagccatttactattgtgctacccctaaatctggacgcgactactggagctttgatctctggggccagggcacactggtcaccgtgtcctctgccagcacgaagggg

SEQ ID NO: 42490 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgctgttaagaaacccggggcctccgtgaaggtgtcttgcgagacctacggatataaattcacagaccactttatgcattggtggagacaggcgcctggccaggggctcgaatggatgggatggatcaacccgtacagctccgctgtctcttatagcccccggtaccaaggccgcgtgacgatgaccagagatacattcctggagaccgtttatatggaacttcgggggctgcgctttgacgatacagccatttactattgtgccacccctaagtccggaagagactactggtctttcgatctctggggccagggcacactggtgaccgtcagctccgctagcacgaaaggg

SEQ ID NO: 42491 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgctgttaagaaacccggggcctccgtgaaggtgtcttgcgagacctacggatatacattcacggaccactttatgcattggtggagacaggcgcctggccaggggctcgaatggatgggatggatcaacccgtacagctccgctgtctcttatagcccccggtaccaaggccgcgtgaccatgacaagagataccttcctggagacagtttatatggaacttcgggggctgaaatttgacgataccgccatttactattgtgccacacctaagtccggacgcgactactggtctttcgatctctggggccagggcaccctggtgacggtcagctccgctagcaccaaaggg

SEQ ID NO: 42492 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgaggttaagaaacccgggtcctctgtgaaggtgagctgcaaaacctccggagtcagattctctagcaacgctatctcctgggtgcggcaggcccctggccaggggctcgaatggatgggacgcacaacgccgatgctgggcggggcgaatcacgctccctcttttaagggaagagttaccattagcgccgacgagtccacacggaccgtgtacatggaaatgagctctcttcgctatgaggatacagccgtctactattgtgcttccggcagacgggaaggcctgaacttcctcctggactactgggggcaaggaacccttgtgacagttagctctgcctccaccaaaggc

SEQ ID NO: 42493 - RNA, 378 nt, synthetic construct
  misc_feature 1..378: note = derived and/or modified sequence opt5 from anti-HIV_Chain
  source 1..378: mol_type = other RNA
caggtgcaactgcaggagagcggccccgggctcgtcaagccttccgaaaccctgtctcttacatgcacggttagcggaggctccatctctacctactattggagctggattagacagccgcccgggaaaggactggagtggatcggctacatttcctattctgggagcacaaactacaatccttccctcaagagccgggtgaccatctctgtggacacatccaaaaaccagttcagcctgaaactttcttccgtcaccgccgctgatacagccgtgtattactgtgcgcgccacaagagcgttctgctctggtttagagaactggactattggggacaaggcaccctggtgacggtctcttccgctagcaccaagggc

SEQ ID NO: 42494 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgaggttaagaaacccggggctgccgtgaagatctcctgcaaagcgtctagattcacctttagctcctactatattcactgggtgcggcaggctcctggacagggcctcgaatggatggggatcattaacccgtctggaggcagcacatccaatgcccaaaagttccaggaccgcgtcacgctgaccagagatatgtctacagggaccgtgtacatggagcttagccggctgacatccgaagacaccgccgtttattactgtgctacacccgagcctagctctatcgtggctcccctctattactggggacagggcaccctggtcacggtgtccagcgcctctaccaaaggc

SEQ ID NO: 42495 - RNA, 378 nt, synthetic construct
  misc_feature 1..378: note = derived and/or modified sequence opt5 from anti-HIV_Chain
  source 1..378: mol_type = other RNA
caggtgcaactggtccagagcggcgccgagatgaagaaacccggggcttccgttaaggtgtcttgcaaagccagcggacacaccttcacaaactactatatgcattgggtgagacaggcgcctggccaggggctcgaatggatgggaatgatcaatccgacgggcgactccacccggtacgctcaacgctttcaggggagagtcacaatgacccgggatacatctacccgcacagtgtatatggagctgagctcccttagatctgacgataccgccgtttactattgtgcccgggctcaccatgacttctggcgcgcccccgtggatgtctggggaaagggcacgaccgtgacagttagctccgctagcaccaaaggc

SEQ ID NO: 42496 - RNA, 378 nt, synthetic construct
  misc_feature 1..378: note = derived and/or modified sequence opt5 from anti-HIV_Chain
  source 1..378: mol_type = other RNA
caggtggtcctgatccaaagcggcgccgaggttaagagacccgggtcctctgtgaaagtgagctgcaaggcttccggaggctctttccctattacctgggtccggcaggccccggggcacggactcgaatggatgggcgggatcaacccctttttcggaacaacgaattacgcgcagaaatttcagggccgcgtgagcattaccgctgacgagtccacatctaccacatatctgcatcttagcgatctgagatccgaagacaccgccgtttacttctgtgcccgggagaaccgcgaaaagtggctcgtgctgagaagctggtttgctccttggggccaagggacacttgtcaccgtgtcttccgccagcacgaaagga

SEQ ID NO: 42497 - RNA, 378 nt, synthetic construct
  misc_feature 1..378: note = derived and/or modified sequence opt5 from anti-HIV_Chain
  source 1..378: mol_type = other RNA
agccagcaactggtgcagtccggcgcccaggtcaagaaacccggggcttctgttagagtgagctgccaggcctccggatacaccttcacaaaccactttctccattggtggcggcaagcgcctcgccagggcctggagtggatggggtggatcaatccggtgcacggaggcagaaactatgctcggcgcttccaggggagaattaattttggacgggacgtctaccaggaaacggcctatatggagctttctggcctgcgcaacgatgacaccgccacatacttctgtgctagaggcgggggagatggccggaattggcatctccacccctgggggcaaggaaccctggtgatcgttagcgccgcttccacaaagggc

SEQ ID NO: 42498 - RNA, 378 nt, synthetic construct
  misc_feature 1..378: note = derived and/or modified sequence opt5 from anti-HIV_Chain
  source 1..378: mol_type = other RNA
gaggtgcaggtcgttgaaagcggcgggggactggtgcaacccggcgggtccctcagactgtcttgcgtggccagcggattcaccttttccgagtactggatgtcttgggtccggcaggctcctggcaaggggcttgaatgggtggccacaatcaaacgcgacggaagcgaggaatcctatgttgattctgtgaagggcagattcacgattagccgggacaacgcgaaaaattccctgtacctccagatgaacagcctgcgcgctgaggataccgccgtctattactgtgccagagtgcgggacccgaattataaccttcactttgattcttggggccaggggacactggttaccgtgtccagcgcttctacaaaggga

SEQ ID NO: 42499 - RNA, 378 nt, synthetic construct
  misc_feature 1..378: note = derived and/or modified sequence opt5 from anti-HIV_Chain
  source 1..378: mol_type = other RNA
ctggtgcagctcgtcgagagcggcgggggagttgtgcaacccggcaagtccctgagactttcttgcgccaccagcgggttcacattttccacgtacggaatgcactgggtgcggcaggctcctggcaaagggctggaatgggtcgccgtgatctggtatgacggatcttacaagtattacgcggatagcgttaaaggccgcttcaccatttccagagacaactctaagaatacactctttctgcagatgaacagccttcgggctgaggataccgccatgtattactgtggccgcgaaatggccgtcgggggaacaaaagctctggaccattggggccaggggaccctcgtgacagtgtccagcgcctctaccaaggga

SEQ ID NO: 42500 - RNA, 378 nt, synthetic construct
  misc_feature 1..378: note = derived and/or modified sequence opt5 from anti-HIV_Chain
  source 1..378: mol_type = other RNA
gagttccagctggtgcaaagcggcgggggactcgtcaagcccggcgggtccctgagactttcttgcaccggaagcacattttccttctctagcgacgatatgaactgggttcggcaggcccctggcaaagggctggaatgggtgtcctctatgagcgactccggaagccacatctactatgctgattttgtgaagggccgcttcacgatttctagagacaatgccaaaaagtccctctacctgcagatgaacagccttcgggcggaggataccgctgtctattactgtgcccagtctcgcccgccccaaagactgtatggcatggacgtgtgggggcagggaacaaccgttacagtgtccagcgcctctaccaaaggc

SEQ ID NO: 42501 - RNA, 381 nt, synthetic construct
  misc_feature 1..381: note = derived and/or modified sequence opt5 from anti-HIV_Chain
  source 1..381: mol_type = other RNA
gaggtgcagctggtcgaaagcggcgggggagttgtgcaacccggcgggtccctcagactgtcttgcgccgctagcggattcatgtttaagaactacgccatgcactgggtgcggcagcctccgggcaaagggcttgagtgggtcgcggtgatctggtatggaggccgcgaccagaattacgctgattccgttaagggcagattcaccatttctcgggacgatagcgacaacacactgtatctccagatgaactccctgcgcgccggggatacggccgtgtacttttgtgctagaaattctcaagtcggacggcttatgcccgccgctggcgtgtgggggcagggaaccctggttacagtgagctccgccagcaccaaaggc

SEQ ID NO: 42502 - RNA, 381 nt, synthetic construct
  misc_feature 1..381: note = derived and/or modified sequence opt5 from anti-HIV_Chain
  source 1..381: mol_type = other RNA
cagggccacctggtgcaaagcgggggaggcgtcaagaaactcgggacctccgttacaatctcttgcctggccagcgagtacacgttcaacgaatttgtgattcattggatcagacaggctcccggacagggccctctttggctggggctcattaagcggtccggacgcctgatgacctcttatcagttccaagacagacttagcctgcggcgcgatagatccacaggcaccgtgtttatggagctccggggcctgcgcgtcgacgatacagccgtgtactattgtgcgagagacgggctgggagaagttgctccggcctacctctatggcatcgatgcctgggggcagggaaccacagtgattgtcacctctgctagcacg

SEQ ID NO: 42503 - RNA, 381 nt, synthetic construct
  misc_feature 1..381: note = derived and/or modified sequence opt5 from anti-HIV_Chain
  source 1..381: mol_type = other RNA
caggtgcaactgctcgagagcggcgggggactggtccagagaggcgggtcccttcggctgtcttgcaccgccagcggattcgtttttaacaattactggatgacatgggtgcgccaggctcccggcaacgggctcgaatgggtggccaatatcgaccaggatggatccgagaagcactatctggactctgtcaaaggcagattcacgattagccgggataacgcgaaaaattccctttacctgcaaatgaactctctccgcgctgaagacaccgccatctattactgtgccagagtgcggtttaaggttacagcttggcatcgcttcgatagctggggccagggggacctggtgaccgtctccagcacatctaccaaggga

SEQ ID NO: 42504 - RNA, 381 nt, synthetic construct
  misc_feature 1..381: note = derived and/or modified sequence opt5 from anti-HIV_Chain
  source 1..381: mol_type = other RNA
cagagcgccctgacccaacccccttccgcttctggcacaccggggcagagagtgacgatcagctgctccggatcttaccacaacattggcagcaatgccgtcaactggtatcagcagctccccgggaccgcgcctaagctgcttatctactccaatgaccaacggccctctggagttcctgatcgcttcagcggctccaaaagcgggacatctgcttccctggccattagcggactccagtctgaggacgaagccgattattactgtgctgcctgggacgattccctgcatgtgtttggcaccggcacaaaggtgaccgtccttgggcagcccaaagctaaccctacagtgaccctgttcccgcccagctctgaggaactc

SEQ ID NO: 42505 - RNA, 381 nt, synthetic construct
  misc_feature 1..381: note = derived and/or modified sequence opt5 from anti-HIV_Chain
  source 1..381: mol_type = other RNA
cagagcgtgctgacccaagtcctctccgtttctggcacacccgggcagagagtgatcattagctgctccggaacgtctagcaacgtgggcgggaatctggtctcctggtaccagcaccttcctggagccgctccgcggctgctcatccatcgcgacgatcagagaccctctggcgtgcctgaccggttcagcgggtccaagagcggaaactctgcctccctggttattagcggccttcgctctgatgacgaggcggattatttttgtgctgcctacgactccaccttcagcctgcccgtgtttggcgggggaacaagactcaccgtcctgtctcaacctaaagccgctccctccgtgacactgttccctccgagctccgaa

SEQ ID NO: 42506 - RNA, 381 nt, synthetic construct
  misc_feature 1..381: note = derived and/or modified sequence opt5 from anti-HIV_Chain
  source 1..381: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatccttgtcagtttcaggggagagtctcccttacgcggcatgcctcttgggatttcgacacctttagcttctacatggatctgaaggccctccgctccgacgatacagctgtgtatttttgcgccagacaacggtctgactactgggatttcgacgtttggggaagcggcacccaggtgacagtctccagcgcttctaccaaa

SEQ ID NO: 42507 - RNA, 381 nt, synthetic construct
  misc_feature 1..381: note = derived and/or modified sequence opt5 from anti-HIV_Chain
  source 1..381: mol_type = other RNA
caggtgcaactggtccagagcggcggggaggttagaaagcccggatcctctgtgaaagtgccttgcaagatcagcggcaacgccttctccaattacggggtcaactgggtgcggcaggctccgggacagggcctcgaatgggttgggcgcattatccccgtgattggagtcgcccaacacgcgcctaaatttcagggcagagtgaccatcacagctgacaagtctacgaccacagcctatctggagcttagctccctgcggtctgatgacaccgccgtttacttctgtgctaaagatcatggcgacccccgcacagggtattactttgattattggggacagggcgccctcgtgaccgtcagctccgctagcacaaagggg

SEQ ID NO: 42508 - RNA, 381 nt, synthetic construct
  misc_feature 1..381: note = derived and/or modified sequence opt5 from anti-HIV_Chain
  source 1..381: mol_type = other RNA
caggtgcaactgggccagagcgggaccgaggtcaagaaacccggattctccgttaaggtgtcttgcaaagccagcggcgggtcctctacagcttacggatatagctgggtgagacaggcccctggccaggggtttgaatggatgggacggatcattccgttctacggcatcattacgtatgcgcccaagtttcaaggccgcgtcaccatcacagctgacagatccacctctacagtgtacatggagctcaccagcctgacattcgccgataccgccctgtttttctgtgctcgggactttggggatcctcgcaacggatattacttcgactcctgggatcagggcctttggctcacggttagctctgcctccaccaaaggg

SEQ ID NO: 42509 - RNA, 381 nt, synthetic construct
  misc_feature 1..381: note = derived and/or modified sequence opt5 from anti-HIV_Chain
  source 1..381: mol_type = other RNA
caggtgcaactggtccagagcggcgccgaggttaagaaacccgggtcctctgtgaaggtgagctgcaaggcttccggaggcaccttctctaactacgccatcagctgggtcagacaggcgcctgggcagggactcgaatggatgggcgggattatcccgatttttgaggctgcctcctatgcccaaaaattccaggaccggctgacaatcacgaccgatgaatctacaaccacagcttacatggaccttagctccctgcgcagcgaggataccgccatttattactgtgctagagcccagggagacatcctcacagaaggctattttgattactggggccaggggaccctggtgacggtttcttccgcgagcaccaaagga

SEQ ID NO: 42510 - RNA, 381 nt, synthetic construct
  misc_feature 1..381: note = derived and/or modified sequence opt5 from anti-HIV_Chain
  source 1..381: mol_type = other RNA
caggtgcaactgcaggagagcggccccgggctcgtcaagccttccgaaaccctgtctcttacatgcacggttagcggaggctccatctctagcgccgggtactattggtcctggattagacagcacccggagaaaggactggagttcatcggctacatttattacctcgggaccacatattacaacccctctcttaagagccgggtgtccatcagcattgacacctctaataaccagttttccctggaactgagctctgtgtccgctgccgatacagcgatctattactgtgctcgcgactacaccgccagcggaagacatttctttgattattggggccaaggcacactcgtcaccgtgtcttccgccagcacgaaaggg

SEQ ID NO: 42511 - RNA, 381 nt, synthetic construct
  misc_feature 1..381: note = derived and/or modified sequence opt5 from anti-HIV_Chain
  source 1..381: mol_type = other RNA
caggtgcaactggtccagagcggcgccgaggttaagaaacccggggcttccgtgaaggtgtcttgcaaagcccctggatacaccttcatcggccactatatgcattggattagacaggcgccggggcagggactcgaatggatgggctggatcaaccccaatagcggggacacaaactacgctcaaacgtttcagggacgggtcaccatgacacgcgatacctccatttctacagcctatatggagctgaccagacttcggagcgacgatacagccgtgtactattgtgctcgcgacctgagacctatgcggggcaattgggccatgcacgtttggggcgaagggaccacggtgaccgtctcctctgctagcacaaaggga

SEQ ID NO: 42512 - RNA, 381 nt, synthetic construct
  misc_feature 1..381: note = derived and/or modified sequence opt5 from anti-HIV_Chain
  source 1..381: mol_type = other RNA
caggtgcaactgcaggagagcggccccgggctcgtcaagccttccgaaaccctgtctcttacatgcacggttttcggagccagcatcagatccttttactggcactggattcggcagtctccgggcaaagggctggagtggctcggaagcgtgttcgacaacggcctgaccacatataatccctcccttaagaaccgcctgtctatcagcgaagatccttccagaaatcagattagcctcaacctgcggtctatgaccgctgccgacacagcggtgtactattgtgctcgcgccgattacgacctgctcacctccagctatcattttgattcttgggggcaaggaacactggtcaccgtgtccagcgcctctacgaaaggc

SEQ ID NO: 42513 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagagtgagctgccaggcttccggatacacattcacggactatgtgctccactggtggcggcaagcccctggccaggggctggagtggatgggatggatcaagccggtctacggcgcgcgcaactatgctcatagatttcaggggcggattaatttcgatcgcgacgtgtacagagaaatcgcctatatggatctttctggactgcggagcgacgataccgccgtttacttttgtgctcgcgacggctccggcgatgccacatcttggcacctccatccctgggggcagggaaccctggtgattgtcagctccgctagcacaaaaggc

SEQ ID NO: 42514 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagagtgagctgccaggcttccggatacacattcacgaactatatcctccactggtggcggcaagcccctggccgcgggctggagtggatgggacttattaagccggtgtacggcgcggtcaattatgctagacagtttcaggggcggatccagctgacccgcgacatttacagagaaatcgccttcctcgatctgtctggacttcggcccgacgatacagccgtgtattactgtgctcgcgacgagagcggctatgatctgaactggcatctcgactcctggggccaagggacccaggttattgtgtctcctgccagcacaaaagga

SEQ ID NO: 42515 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcgcccaggtcaagaaacccggggcttctctcagagttagctgccaggcctccggatacaccttcatgaactatctgcttcactggtggcggcaagcgcctggccaggggctggagtggatgggatggatcaatccggtgtacggcgctgtgaactatgcccatcgctttcaggggagactcacattctctcgggacgtctaccgcgaaattgcctatatggatctgaatggacttagaagcgacgatacggctgtgtacttttgtgcccgggacggctccggcgatgaccgcaactggcacctggatccctgggggcagggaaccctcgttatcgtgtctagcgcttccacaaagggc

SEQ ID NO: 42516 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagaatcagctgccaggcttccggatacacattcacggactatgtgctccactggtggcggcaagcccctggccaggggctggagtggatgggatggattaagccggtgtacggcgcgcgcaactatgctagacggtttcaggggcgcatcaatttcgatagagacatttaccgggaaatcgcctttcttgatctgtctggactccgcagcgacgataccgccagatatttctgtgctcgggacggctccggcgatgacacatcttggcatctgcacccctgggggcagggaacccttgtcattgtgagcgccgcttccacaaaaggc

SEQ ID NO: 42517 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaaacaggggcctctgttagagtgagctgccaggcttccggatacgacttcacgaagtatctcatccactggtggcggcaagcccccggccaggggctggagtggatgggatggatgaaacctgtgtacggcgcgaccaactatgctcatcgctttcaggggagaatttctttcacacgggatatctaccgcgaaattgcctttatggaccttaatggactgagaagcgatgacaccgccgtctatttctgtgctcgggatggcggcggggacgatcgcacatggctcctggacgcctggggacagggcacccttgtgatcgtttcctctgctagcacaaagggg

SEQ ID NO: 42518 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagagtgagctgccaggcttccggatacacattcatgaactatatcattcactggtggcggcaagcccctggccagcgcctcgagtggatggggtggatcaatccggtgtttggagcgagaaactacgctcatcggttccagggccgcattaattttgacagagatatcaaccgggaaacgttccagatggacctgaccgggcttcgctctgatgacacagccgtctattactgtgccagagatggaagcggcgacgctcgggattggcatctgcacccctggggccaagggaccctcgtgattgtttcctctgccagcacaaaggga

SEQ ID NO: 42519 - RNA, 381 nt, synthetic construct
  misc_feature 1..381: note = derived and/or modified sequence opt5 from anti-HIV_Chain
  source 1..381: mol_type = other RNA
agccagcacctggtgcaatccggcacccaggtcaagaaacccggggcctctgttagagtgagctgccaggcttccggatacacattcacgaactatatcctccattggtggcggcaggcccctggccaagggctggagtggatgggacttattaagccggtgtttggcgcggtcaattacgctcgccagttccaggggagaatccagctgacccgggacattaaccgcgaaatcgcctttctcgatctgtctggacttagaagcgacgatacagccgtgtattactgtgctcgggacgagtccggcgatgacctgaaatggcacctccatccctggggccaagggacccaggttattgtgtctcctgccagcacaaaggga

SEQ ID NO: 42520 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagagtgagctgccaggcttccggatacacattcatgaactatatcattcactggtggcggcaagcccctggccagcgcctcgagtggatggggtggatcaatccggtgtttggagcgagaaactacgctcatcggttccagggccgcattaattttgacagagatatcaaccgggaaacgttccagatggagctgaccgggcttcgctctgacgatacagccgtctattactgtgccagagacggaagcggcgatgctcgggactggcacctggatccctggggccaagggaccctcgtgattgtttcctctgccagcacaaaggga

SEQ ID NO: 42521 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagaatcagctgccaggcttccggatacacattcacggactatgtgctccactggtggcggcaagcccctggccaggggctggagtggatgggatggattaagccggtgtacggcgcgcgcaactatgctagacggtttcaggggcgcatcaatttcgatagagacatttaccgggaaatcgcctatatggatctttctggactgcgcagcgacgataccgccagatacttttgtgctcgggacggctccggcgatgacacatcttggcatctccacccctgggggcagggaaccctggtcattgtgagcgccgcttccacaaaaggc

SEQ ID NO: 42522 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagaatcagctgccaggcttccggatactctttcacagactatgtgctccactggtaccggcaagcccctggccaggggctggagtggatgggatggattaagccggtgtatggcgcgcgcaactacgctagacggtttcaggggcgcatcaatttcgatagagacatttatcgggaaatcgcctttatggatcttagcggactgcgctccgacgatacggccctctacttctgtgctagagacggctctggcgatgacaccagctggtatctggatccctgggggcagggaacacttgtcattgtgtccgccgctagcaccaaaggc

SEQ ID NO: 42523 - RNA, 381 nt, synthetic construct
  misc_feature 1..381: note = derived and/or modified sequence opt5 from anti-HIV_Chain
  source 1..381: mol_type = other RNA
agccagcaactggtgcagtccggcacccaggtcaagaaacccggggcctctgttagaatcagctgccaggcttccggatactctttcacagactatgtgctccactggtggcggcaagcccctggccaggggctggagtggatgggatggattaagccggtgtacggcgcgcgcaactatgctagacggtttcaggggcgcatcaatttcgatagagacatttaccgggaaatcgcctttatggatcttagcggactgcgctccgacgatacggccctctatttctgtgctagagacggctctggcgatgacaccagctggcatctggatccctgggggcagggaacacttgtcattgtgtccgccgctagcaccaaaggc

SEQ ID NO: 42524 - RNA, 381 nt, synthetic construct
  misc_feature 1..381: note = derived and/or modified sequence opt5 from anti-HIV_Chain
  source 1..381: mol_type = other RNA
agccagcacctggtgcaatccggcacccaggtcaagaaacccggggcctctgttagagtgagctgccaggcttccggatacacattcacgaactatatcctccattggtggcggcaggcccctggccaagggctggagtggatgggacttattaagccggtgtttggcgcggtcaattacgctcgccagttccaggggagaatccagctgacccgggacatttatcgcgaaatcgcctttctcgatctgtctggacttagaagcgacgatacagccgtgtactattgtgctcgggacgagtccggcgatgacctgaaatggcacctccatccctggggccaagggacccaggttattgtgtctcctgccagcacaaaggga

SEQ ID NO: 42525 - RNA, 381 nt, synthetic construct
  misc_feature 1..381: note = derived and/or modified sequence opt5 from anti-HIV_Chain
  source 1..381: mol_type = other RNA
caggtgcaactggtcgagagcggcgggggagttgtgcagcccggcaagtccctcagactgtcttgcgccatcagcgggttcctttttaacaattacggaggccagtgggtgcggcaggctcctgggaaaggactggaatgggtcgccgcgatttcctatgacggcaacaatcgctactatgctgattctgccaagggcagattcctcatcagccgggacaccccgaaaaacattctgtaccttcaaatctattccctgcgcctcgatgacacagccgtgtactattgtgctagagattctgttagcaagtcctacagcgctccccctgagttttgggggcagggaacggtggtcaccgtgtcttccgccagcacaaaaggc

SEQ ID NO: 42526 - RNA, 381 nt, synthetic construct
  misc_feature 1..381: note = derived and/or modified sequence opt5 from anti-HIV_Chain
  source 1..381: mol_type = other RNA
caggtgcacctggaggaaagcggccccgggctcgtcaagacctcccaaacactgtctcttacgtgcagcgtttcctcttacagcatctccagatctggatatttctggacctggattcggcagcgccctggcaaagggctggagtggatcggatacatttattttaacggcagaacaacctacaatccgagcctcaagtcccggatcacaattagccgcgacacctctcattcccagttcagcctgacacttaactctctgtccgccgctgataccgccgtgtattactgtgggagatgccaggacggactcgcgagccggcccatcgatttttggggccaaggcacgctggtgaccgtctcttccgctagcacaaaaggg

SEQ ID NO: 42527 - RNA, 381 nt, synthetic construct
  misc_feature 1..381: note = derived and/or modified sequence opt5 from anti-HIV_Chain
  source 1..381: mol_type = other RNA
caggtgcaactggtcgagagcggcgggggagttgtgcagcccggcagatccctccggctgtcttgcgccaccagcgggttcacatccaagaactacggagtgcactgggtccgccaggctcctggcaaagggcttgaatgggtggccgttatctggtatgacggatctaataagttttacgcggatagcgtgaaaggcagattcacgatttcccgggaccgctctaagaacatggtctatctgcagatgaatagcctcagagtggaggataccgctatctactattgtgcccgggactccgttgcctttgtgctggaaggcccgattgattactgggggcaaggaacacttgtcaccgtgagctctgcttccacaaaaggc

SEQ ID NO: 42528 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgggggagttaagaaacccggcacctccgcctctttcagctgcagaacatccgacgatatctacgacaacgagtttttcgattctgcttttatgcactgggtgcggctcattcctgggcagcgcccggaatggatgggatggatgaatcccagaagcggcgccgtgaactatgcgcggcagctgcaacctcgcgtctccatgtacagagaccgggatctttctacggcttatatggagttcaagagcctgacctccgccgacacagggacctacttttgtgcccgcaaaaagagaggagatggcttcaatctctattttgacctgtggggccgggggagccaggtgatcgtttcttccgct

SEQ ID NO: 42529 - RNA, 384 nt, synthetic construct
  misc_feature 1..384: note = derived and/or modified sequence opt5 from anti-HIV_Chain
  source 1..384: mol_type = other RNA
cagggccacctggtgcaaagcgggggaggcgtcaagaaactcgggacctccgttacaatctcttgcctggccagcgaggacacgttcaacgaatttgtgattcattggatcagacaggctcccggacagggccctctttggctggggctcattaagcggtccggacgcctgatgacctcttaccagttccaagatagacttagcctgcggcgcgacagatccacaggcaccgtgtttatggagctccggggcctgcgcgtcgatgacacagccgtgtattactgtgcgagagatgggctgggagaagttgctccggcctatctctacggcatcgacgcctgggggcagggaaccacagtgattgtcacctctgctagcacgtcc

SEQ ID NO: 42530 - RNA, 384 nt, synthetic construct
  misc_feature 1..384: note = derived and/or modified sequence opt5 from anti-HIV_Chain
  source 1..384: mol_type = other RNA
cagagcgccctgacccaacccccttccgtgtctggcgctccggggcagagagtcacaatcagctgctccggaggcccctctaacgttgggggaaattacgtgtattggtaccggcagttccctggcacggcccccaagctcctgattcttcgcgacgatcagagacctagcggggtgcccgaccggttttccgcgtctaaaagcggaaactccgctagcctggccatctctggcctccgccctgatgacgaggccttctatttttgtgctacctacgattcccaaggcagcttcagagtctttgggggaggcacagccctgaccgtgctttctcagccgaaggctgccccctccgttacactgtatcctcccagctctgaagag

SEQ ID NO: 42531 - RNA, 384 nt, synthetic construct
  misc_feature 1..384: note = derived and/or modified sequence opt5 from anti-HIV_Chain
  source 1..384: mol_type = other RNA
aacttcatgctgacccagccccctagcgcctccggcacaccggggcaaagagtgacgatctcttgcagcggaggcgggtccaatattggaggcaacctcgtctcttggtaccagcactttcccggggctgcccctaagctgcttatctatcggaatgaccagcgccccagcggagttcctgatagattctccggctctaaaagcggcacctccgcgagcctggctatttctgggctccggtccgacgataaggccacatacttttgtgccgcttatgacagcaccctgtctcttcgcctgttcggaggcgggacaaccctcacagtgctgtcccagcccaaagccgctcctagcgtgaccctgtttccgccctcttccgaggaa

SEQ ID NO: 42532 - RNA, 384 nt, synthetic construct
  misc_feature 1..384: note = derived and/or modified sequence opt5 from anti-HIV_Chain
  source 1..384: mol_type = other RNA
aacttcatgctgacccagccccctagcgtgtccgccacaccgggccaaacggtcaccatctcttgcagcgggtccggatctaatgttggcgggaaccacgtgtactggtatagacagctccccggagctgcccctacactggtgattagcaagaccgaccatcggccctcccgcgtccctgatagattctctggcagcaaatccgggaatagcgcgtctcttgctatctccggactgcggcccgacgatgaggccgtgtacttctgtgccacatatgacaccggcctcagcctgcgcctttttggcgggggaacaagactgaccgttctctctcagcctaaggctgccccgtccgtgacgcagtttccccctagctctgaagag

SEQ ID NO: 42533 - RNA, 384 nt, synthetic construct
  misc_feature 1..384: note = derived and/or modified sequence opt5 from anti-HIV_Chain
  source 1..384: mol_type = other RNA
cagagcgccctgacccaacccccttccgcttctggcgccccggggcagagagtgacaatcagctgctccggaggcccctctaacgtcgggggaaattacgtttattggtaccggcagttccctggcacggcgcccaagctcctgattcttcgcgacgatcagagacctagcggggtgcccgaccggttttccgcttctaaaagcggaaactccgccagcctggccatctctggcctccgccctgatgacgaggctctgtatttctgtgccacctacgattccgacggcagcattagactttttgggggaggcacagctctgaccgtgctctctcaaccgaaggccgcgccctccgtcacactgttccctcccgggtgggaagag

SEQ ID NO: 42534 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagactttttcaggggcgggtctccctgacgcgccatgcctcttgggatttcgacacctttagcttctacatggatctcaaggccgtgagatccgacgatacagctgtttatttttgtgcccggcagcgctctgactactgggatttcgacgtgtggggaagcggcacccaagtcacagtgtccagcgcttctaccaaaggc

SEQ ID NO: 42535 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgtcgttaccaagcccggggcttccgtgagagtgtcttgcgaggccagcggatacaaaatccgggactatttcattcactggtggcgccaggcgcctggccaggggctgcaatgggtcggatggatcaacccgcagacaggccagcccaatattcctagaccctttcaggggcgggtgacgcttacccgccatgcttcctgggatttcgacacattttctttctacatggatctgaaggccctcagaagcgacgataccgccatctatttttgtgctcggcgcagatccgactactgcgatttcgacgtttggggatctggcacacacgtgaccgtcagctccgccagcacaaaaggc

SEQ ID NO: 42536 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccaagcctcttgggatttcgacaccattagcttttacatggatctgaaggccctcagactggacgatacagctgtgtatttctgtgcccggcagcgctccgactactgggattttgacgtttggggatctggcacccaggtgacagtcagctccgctagcaccaaaggc

SEQ ID NO: 42537 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaaggccctcagatccgacgatacagctgtgtatttttgtgcccggcaacgctctgactactgggatttcgacgtttggggaagcggcacccaggtgacagtctattccgctagcaccaaaggc

SEQ ID NO: 42538 - RNA, 384 nt, synthetic construct
  misc_feature 1..384: note = derived and/or modified sequence opt5 from anti-HIV_Chain
  source 1..384: mol_type = other RNA
caggtgcaactgctccccttcggcggggccgtcaccaagcctggagctagcgttagagtgtcctgcgaggcctctggctacaacatccgggactattttattcactggtggcgccaggcgccggggcagggactgcagtgggtgggctggatcaatcccaaaacagggcaacctaacaatccctgtcagttccagggaagagtcagccttacgcggcctgcttcctgggattttgacaccatttctttctacatggatctgaaggccctccgcctggacgatacagccgtgtatttttgcgctagacagcggagcgactactgggatttcgacgtttggggctccggcacccaagtgacagtctctagcgcctccaccaaaggg

SEQ ID NO: 42539 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagagtcagcctgacgcggcaggcctcctgggatttcgacacctattctttttacatggatcttaaagccctgcgcagcgacgatacagctatttatttctgtgccagacaacggtccgacttttgggatttcgacgtgtggggaagcggcacccaggttacagtgtcttccgctagcaccaagggc

SEQ ID NO: 42540 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagagtcagcctgacgcggcaggcctcctgggatttcgacacctattctttttacatggatcttaaagccgtgcgcagcgacgatacagctatttatttctgtgccagacaacggtccgacttttgggatttcgacgtttggggaagcggcacccaggtgacagtctcttccgctagcaccaagggc

SEQ ID NO: 42541 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaaaatctccgaccacttcattcattggtggcggcaggctcctggccaggggctgcaatgggtgggatggatcaacccgaagacaggccagcccaataaccctcgccagtttcaggggagaatttctcttacgcggcaagccagctgggatttcgacaccttttccttctatatggatctgaaagccctccgctctgacgatacagctgtctacttttgtgccagacagcggagcgactattgggatttcgacgtgtggggatccggcacccaggttacagtgagctctgcttccaccaagggc

SEQ ID NO: 42542 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaagggactcagatccgacgatacagccatttatttttgtgctcggcaacgctctgactactgggatttcgacgtgtggggcagcggcacccaggttacagtgtccagcgcctctaccaaaggg

SEQ ID NO: 42543 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaaggccctcagatccgacgatacagctgtgtatttttgtgcccggcaacgctctgactactgggatttcgacgtttggggaagcggcacccaggtgacagtctccagcgcttctaccaaaggc

SEQ ID NO: 42544 - RNA, 384 nt, synthetic construct
  misc_feature 1..384: note = derived and/or modified sequence opt5 from anti-HIV_Chain
  source 1..384: mol_type = other RNA
cacgtgcagctgctccaaagcggcgccgctgtcaccaagcccggggcctccgttagagtgtcttgcgaggcgagcggatacaacatccgggactatttcattcattggtggcgccaggctcctggccaggggctgcagtgggtgggatggatcaatccgaaaacaggccaacccaacaatcctagacagtttcaggggcgggtctcccttacgcgccaggcctcttgggatttcgacacctttagcttctacatggatctgaaggccctcagactggacgatacagctatttatttttgtgcccggcaacgctccgactactgggatttcgacgtgtggggatctggcacccaggttacagtgagctccgctagcaccaaaggc

SEQ ID NO: 42545 - RNA, 384 nt, synthetic construct
  misc_feature 1..384: note = derived and/or modified sequence opt5 from anti-HIV_Chain
  source 1..384: mol_type = other RNA
caggtgcacctgagccattccggcgccgctgtcaccaagcccggggcctctgttagagtgagctgcgaggcgtccggatacaaaatctctgaccacttcattcattggtggcggcaagctcctggccaggggctccagtgggtgggatggatcaacccgaagacaggccagcccaataaccctcgccaatttcaggggagaattagcctgacgcggcaggcctcctgggatttcgacaccttttctttctatatggatcttaaagccctgcgcagcgacgatacagctgtctacttttgtgccagacagcggtccgactattgggatttcgacgtgtggggaagcggcacccaagttacagtgtcttccgctagcaccaagggc

SEQ ID NO: 42546 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggctccagtgggtcggatggatcaacccgaagacaggccaacccaataaccctcgccagtttcaggggagaattagcctgacgcggcaggcttcctgggatttcgacaccttttctttctatatggatcttaaagccctgcgcagcgacgatacagccgtgtacttttgtgctagacaacggtccgactattgggatttcgacgtttggggaagcggcacccaggtgacagtctcttccgccagcaccaagggc

SEQ ID NO: 42547 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggctccagtgggtcggatggatcaacccgaagacaggccaacccaataaccctcgccagtttcaggggagaattagcctgacgcggcaggcttcctgggatatcgacaccttctctttttatatggatcttaaagccctgcgcagcgacgatacagccgtgtacttctgtgctagacatcggtccgactattgggattttgacgtttggggaagcggcacccaagtgacagtctcttccgccagcaccaagggc

SEQ ID NO: 42548 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggctccagtgggtcggatggatcaacccgaagacaggccaacccaatattcctcgccagtttcaggggagaatcagcctgacgcggcaggcttccggagatttcgacaccttttctttctatatggatcttaaagccctgcgcagcgacgatacagccgtgtacttttgtgctagacaacggtccgactattgggatttcggcgtttggggcagcgggacccaggtgacagtctcttccgccagcaccaaggga

SEQ ID NO: 42549 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctggccatttcattcactggtggcggcaggcgcctgggcagggactccagtgggtcggctggatcaacccgaagacagggcaacccaataaccctcgccagtttcagggaagaattagcctgacgcggcaggcttcctgggacttcgataccttttctttctatatggaccttaaagccctgcgcagcgatgacacagccgtgtacttttgtgctagacatcggtccgattattgggacttcgatgtttggggcagcggcacccaagtgacagtctcttccgccagcaccaagggg

SEQ ID NO: 42550 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagaattagcctgacgcggcaggcctcctgggatttcgacaccttttctttctatatggatcttaaagccctgcgcagcgacgatacagctgtctacttttgtgccagacatcggtccgactattgggatttcgacgtgtggggaagcggcacccaagttacagtgtcttccgctagcaccaagggc

SEQ ID NO: 42551 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagagtcagcctgacgcggcaggcctcctgggatttcgacacctattctttttacatgggacttaaagccgtgcgcagcgatgacacagctatttatttctgtgccagacaacggtccgatttttgggacttcgatgtttggggcagcggcacccaggtgacagtctcttccgctagcaccaagggg

SEQ ID NO: 42552 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggctccagtgggtcggatggatcaacccgaagacaggccaacccaataaccctcgccagtttcaggggagaattagcctgacgcggcaggcttcctgggatttcgacaccttttctttctatatggatcttaaagccctgcgcagcgacgatacagccgtgtacttttgtgctagacatcggtccgactattgggatttcgacgtttggggaagcggcacccaagtgacagtctcttccgccagcaccaagggc

SEQ ID NO: 42553 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggctccagtgggtcggatggatcaacccgaagacaggccaacccaataaccctcgccagtttcaggggagaattagcctgacgcggcaggcttcctgggatttcgacaccttttctttctatatggatcttgaagccctgcgcagcgacgatacagccgtgtacttttgtgctagacaacggtccgactattgggatttcgacgtttggggaagcggcacccaggtgacagtctcttccgccagcaccaaaggc

SEQ ID NO: 42554 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatccgggactattctattcattggtggcgccaggctcctggccaggggctccagtgggtgggatggatcaacccgcaaacaggccagcccaatattcctagacccttccaggggcggatcagcctgacgcgccaggcctcctgggattttgacaccttctctttttacatggatcttgaagccctgagaagcgacgatacagctgtctatttctgtgcccggcaacgctccgactactgggattttgacgtgtggggaagcggcacccaggttacagtgtcttccgctagcaccaagggc

SEQ ID NO: 42555 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagaattagcctgacgcggcaggcctcctgggatttcgacaccttttctttctatatggatcttaaagccctgcgcagcgacgatacagctgtctacttttgtgccagacaacggtccgactatcgcgatttcgacgtgtggggaagcggcacccaggttacagtgtcttccgctagcaccaagggc

SEQ ID NO: 42556 - RNA, 384 nt, synthetic construct
  misc_feature 1..384: note = derived and/or modified sequence opt5 from anti-HIV_Chain
  source 1..384: mol_type = other RNA
caggtgcacctgagccaatccggcgccgtcgttaccaagcccggggcttctgtgagagtgagctgcgaggcctccggatacaaaatctctgaccatttcattcactggtggcggcaggcgcctggccaggggccgcagtgggtcggatggatcaaccccaagacaggccaacctaataacccccgccagtttcaggggagaattagcctcacgcggcaggcttcctgggatttcgacaccttttctttctatatggatctgaaagcccttcgcagcgacgatacagccgtgtacttttgtgctagacatcggtccgactattgggatttcgacgtttggggaagcggcacccaagtgacagtctcttccgccagcaccaagggc

SEQ ID NO: 42557 - RNA, 384 nt, synthetic construct
  misc_feature 1..384: note = derived and/or modified sequence opt5 from anti-HIV_Chain
  source 1..384: mol_type = other RNA
caggtgagactgctccaaagcggcgccgctgtcaccaagcccggggcctccgttcgggtgtcttgcgaggcgagcggatacgaaatccgcgactatttcattcactggtggagacaggctcctggccaggggctgcagtgggtgggatggatcaacccgaaaacaggccaacccaataaccctcggcagtttcaggggcgcgtctcccttacgagacaggcctcttgggatttcgacagctactccttttatatggatctgaaggccctccggtctgacgataccgctgtgtacttctgtgcccgccaaagaagcgactattgggattttgacgtttggggatccggcacacaggtgaccgtcagctctgcttccacaaaaggc

SEQ ID NO: 42558 - RNA, 384 nt, synthetic construct
  misc_feature 1..384: note = derived and/or modified sequence opt5 from anti-HIV_Chain
  source 1..384: mol_type = other RNA
caggtgagactgctccaaagcggcgccgctgtcaccaagcccggggcctccgttcgggtgtcttgcgaggcgagcggatacgaaatccgcgactatttcattcactggtggagacaggctcctggccaggggctgcagtgggtgggatggatcaacccgaaaacaggccaacccaataaccctcggcagtttcaggggcgcgtctcccttacgagacaggcctcttgggatttcgacagctactccttttatatggatctgaaggccctccggtctgacgataccggagtgtacttctgtgctcgccaaagaagcgactattgggattttgacgtttggggctccggcacacaggtgaccgtcagctctgcctccacaaaaggg

SEQ ID NO: 42559 - RNA, 384 nt, synthetic construct
  misc_feature 1..384: note = derived and/or modified sequence opt5 from anti-HIV_Chain
  source 1..384: mol_type = other RNA
caggtgagactgctccaaagcggcgccgctgtcaccaagcccggggcctccgttcgggtgtcttgcgaggcgagcggatacgaaatccgcgactatttcattcactggtggagacaggctcctggccaggggctgcagtgggtgggatggatcaacccgaaaacaggccaacccaataaccctcggcagtttcaggggcgcgtctcccttacgagacaggcctcttgggatttcgacagctactccttttatatggatctgaaggccctccggtctgacgataccgctgtgtacttctgtgcccgccaaagaagcgactattgggattttgacgtttggggatccggcagccaggtgacagtctcttccgctagcaccaaaggc

SEQ ID NO: 42560 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatccttgtcagtttcaggggagagtctcccttacgcggcaagcctcttgggatttcgacaccattagcttttacatggatctgaaggccctccgcctggacgatacagctgtgtatttctgcgccagacagcggtccgactactgggattttgacgtttggggatctggcacccaggtgacagtcagctccgctagcaccaaaggc

SEQ ID NO: 42561 - RNA, 384 nt, synthetic construct
  misc_feature 1..384: note = derived and/or modified sequence opt5 from anti-HIV_Chain
  source 1..384: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaaggccctcagatccgacgatacagctgtgtatttttgtgcccggcaacgctctgactactgggatttcgacgtttggggaagcggcacccaggtgattgtctccagcgcttctacaaaaggc

SEQ ID NO: 42562 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgacgttaagaaacccggggctaccgtgacagtgtcctgcaagacggatgaggacgaagatgacttcagagcccacctcatgcagtggatgcggcaggcgcctggacaacgcctggagtgggtcggctggatcaaaccgcagaccgggcagccctcttacggacagaagtttcaaggcagagtgacacttacccgggaagttagcacatccaccgtgttcctgcagctccgcaacctgagatctgatgacacagctgtctattactgtgcccggcctcgcgggggaagagataattggagctttcatgtgtggggccggggcacccttgttacggtgtcctctgccagcaccaaaggg

SEQ ID NO: 42563 - RNA, 384 nt, synthetic construct
  misc_feature 1..384: note = derived and/or modified sequence opt5 from anti-HIV_Chain
  source 1..384: mol_type = other RNA
gaggtgcagctggtcgaaagcggcgccgaggttaagaaacccggggcttccgtgaaggtgtcttgcaaagtcagcggaaactccctcaccgagttctctatccactgggtgagacaagcccctggcaaggggctggaatggatgggaggctttgacccggaagagggggagacagttcccgcgcagaaattcaagggacggcttacgatgaccgaagatacaagcaccaatacagcttacatggagctgtcctctctccgcagcgaagacaccgccgtgtattactgttccacagagcctagagagatgggcaccctgacggccggctttgaatattgggggcagggaacccttgtcacagtgagctctgcttccaccaagggc

SEQ ID NO: 42564 - RNA, 384 nt, synthetic construct
  misc_feature 1..384: note = derived and/or modified sequence opt5 from anti-HIV_Chain
  source 1..384: mol_type = other RNA
agagtgcagctgggccaaagcggggccgaggtcaagaaacccggagcttccgttaaggtgtcttgcaaagtgagcggcaactccctcaccgagttctctatccactgggtccggcaggcccctgggaagggactggaatggatgggcgggtttgacccggaagagggagaaacagtgcccgcgcagaaattcaagggccgcgttacgatgaccgaggatacaagcaccaatacagcttacatggagctttcctctctgagaagcgaagacaccgccgtgtattactgttccacagagcctcgggaaatgggcaccctcacggccgggtttgagtattggggacagggcaccctggtcattgtgagctctgcttccacaaagggg

SEQ ID NO: 42565 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgacgttaagaaacccggggcttccgtgaccgtgtcttgcaagacagatgaggacgaagatgacttcagagcccacctcgtccagtggatgcggcaggcgcctggacaacgcctggagtgggtgggctggatcaaaccgcagacggggcagcccagctacgctcagaagtttcaaggaagagttacccttacacgggaagtgtccacctctacagtcttcctgcagctccgcaacctgagaagcgatgacaccgccgtgtattactgtgcccggcctcgcggcgggagagataattggtcctttcatgtttggggacggggcacacttgtgaccgtctctagcgcttccacgaaaggc

SEQ ID NO: 42566 - RNA, 384 nt, synthetic construct
  misc_feature 1..384: note = derived and/or modified sequence opt5 from anti-HIV_Chain
  source 1..384: mol_type = other RNA
caggtgcaactgcaggagagcggccccgggctcgtcaagccttccgaaaccctgtctcttacatgcagcgtttccggagcctctatcagcaacttctactggacgtggattagacagccggctggcaaagggctggagtgggtgggacggctctattcctctgaccgcaccaattacaaccccagcctgaatggcagagtgacaatgtcccttgataccagcaagaaccagttttctctgcggctcacatccatgaccgacgccgatacagcgatctatttctgtgctcgcgaaaaagggcaatggctgaccgtccctccctactattttgacagctggggacagggcattctggtgacggtttcttccgccagcaccaagggc

SEQ ID NO: 42567 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttagaaagcccggggcttccgtgaaagtgtcttgcaagaccagcggatacacattcacgaactcctatatccactgggtccggcaggcccctggccaggggctcgaatggatgggaattatcaatccgcccggcgggaacacctactatgcgcaaaaatttcatggacgcgtgacactgaccagagacacatctaccagcacagtttacatggagcttaattccctgcggtctgaagataccgctgtgtatttctgtgcccgccctcacagccccacgaacattccttccagacccctcgactactggggccagggcaccctggtcacagtgagctctgcctccaccaagggg

SEQ ID NO: 42568 - RNA, 384 nt, synthetic construct
  misc_feature 1..384: note = derived and/or modified sequence opt5 from anti-HIV_Chain
  source 1..384: mol_type = other RNA
caggtgcaactgcaggagagcggccccgggctcgtcaagccttccggaaccctgtctcttacatgcaacgtttacggcgggagcatgatctcctattactggtcttggattagacagccgcccggaaaaggcctggaatggatcgggcacgtgtataatagcggaaacacgaagtactccccttctctcaaaaatcgggtgaccattagcatggacacatcccgcaacctgttcagccttaaggtcacctctgtgacacccgccgataccgctgtttattactgtgccagagcggactatgataatatctgggactcccggggcggctttgatctgtgggggcagggaacactcgtgaccgtcagctctgcttccacgaaaggc

SEQ ID NO: 42569 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagaaacccgggtcctctgtgaaggtgagctgcaaggcttccggaggcaccctctctagctacacaatctcctgggtcagacaggcccctgggcagggactggaatggatgggccggcttattccgctggtggacatcacgacctatgcgcaaaaattccaggggcgcgttacaattaccgctgatacatctaccaacacagcctacatggagctcagcaatctgagatccgaagacaccgccatctatcactgtgctacgagcaccatgattgccgctgtgatcaacgatgcctttgacctttggggacagggcacaaccgtcacagtgtcttccgcgagcaccaaaggc

SEQ ID NO: 42570 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagaaacccggggcttccgtgaagatctcttgcaaagccagcggatactccttcagaaactatgcggtgcactgggtccggcaggctcctggccaggggctcgaatggatgggagagattaatggcgggaacggaaataccgaatactctcaaaagagccagggccgcctgacaatcacgagagacatttccgccaccacagcctatatggagctttctagcctgcggtccgatgacaccgctgtgtactattgtgcccgcgttgcttacgtgcatgtcgtgacaaccagaagcctcgataactggggccaggggacactggttaccgtgtcttccgccagcacgaaagga

SEQ ID NO: 42571 - RNA, 384 nt, synthetic construct
  misc_feature 1..384: note = derived and/or modified sequence opt5 from anti-HIV_Chain
  source 1..384: mol_type = other RNA
caggtgagactgagccaatccggcgccgctgtcatgaagaccggggcctctgttacaatcagctgcgagacggaaggattcaactttgtgaattacattatccactgggtgcggagaccccctggccgcgggttcgagtggctcggaatgattgacccgcggaacggccatccctggtttgcgcagaccgtccgcgggagactgtcccttcggcgcgatacattcaatgaaatcgtgtatatgaccctgtctggactcacaaccgacgatacaggcctgtacttttgtgctagaaacgagcctcagtatcacagccttcccggcatgttcgactactgggggcagggaacccctgttacggtgtcctctgccagcaccaaaggc

SEQ ID NO: 42572 - RNA, 384 nt, synthetic construct
  misc_feature 1..384: note = derived and/or modified sequence opt5 from anti-HIV_Chain
  source 1..384: mol_type = other RNA
caggtgagactgagccaatccggcgccgctgtcgttaagaccggggcctctgtgacaatcagctgcgagacggaaggatacaacttcgtgaattatattatccactgggtccggagaccccctggccgcgggtttgagtggctcggaatgattgacccgcggaacggccatccctggttcgcgcagaccgtgcgcgggagactgtcccttcggcgcgatacatttaaagaaaccgtttacatgacactgtctggactcaccagcgacgatacaggcgtgtatttctgtgctagaaatgagcctcagtaccactccctgcccggcatgtttgactattgggggcatggaacccctgtcacggtgtctagcgcctccaccaagggc

SEQ ID NO: 42573 - RNA, 384 nt, synthetic construct
  misc_feature 1..384: note = derived and/or modified sequence opt5 from anti-HIV_Chain
  source 1..384: mol_type = other RNA
cagggccaactggtgcagagcgggggaggcgtcaagaaactcgggacctccgttacaatctcttgcctggccagcgagtacacgttcaacgaatttgtgattcactggatcagacaggctcccggacagggccctctttggctggggctcattaagcggtccggacgcctgatgacctcttatcaattccaggacagacttagcctgcggcgcgatagatccacaggcaccgtgtttatggagctccggggcctgcgcgtcgacgatacagccgtgtactattgtgcgagagacgggctgggagaagttgctccggcctacctctatggcatcgatgcctgggggcagggaaccacagtgattgtcacctctgctagcacgtcc

SEQ ID NO: 42574 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagaaacccggggcttccgtgaaggtgtcttgcaaagccagcggatacaccttcacatcctatgacatcaactgggtcagacaggcgacgggccaggggctcgaatggatgggatggatgaatcctaactctggcaataccgggtacgctcaaacatttcagggacgggtgaccatgacacgcaacaccagcatttccacagcctatatggagctgtctagccttagatccgaagataccgccgtttactattgtgctcgggaccgctggctgccgcagtactattactacggcatggatgtgtggggccaggggacgaccgtcacagtgagctctgcctccaccaaggga

SEQ ID NO: 42575 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagaaacccgggtcctctatgaaggtgagctgcaaatcctctggaggcaccttcagcaaccacgctatctcctgggtgagacaggcccctgggaagggactcgaatggatgggcgggattatcccgatgtctggaacaacgaattacctgcagaaatttcaaggccgggtcaccattacagcggacgagttcgctaccacagcctatatggaacttagctccctgaccagcgaggatacagccgtgtactattgtgctcgcgccagagctgactctcatacccccatcgatgcctttgacatttggggccctgggacgcgggttatcgtgtccagcgcgtctaccaaggga

SEQ ID NO: 42576 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagaaacccggggcttccgtgaaggtgtcttgcaaagtcagcggatacaccctcacagaactgtccatccactgggtgagacaggcccctggcaagcggcttgagtggatgggagggttcgacccggaagatggcgagcgcatttatgcgcagaaatttcaagggagagttacgatgaccgaagacacatctaccgatacagcttacatggagctgaacagcctccggtccgacgataccgccgtgtattactgtgccacaggaggcctgtattgctctagcatctcctgtattatggacgtctggggccaggggaccacggtgaccgttagctctgcttccacaaaggga

SEQ ID NO: 42577 - RNA, 384 nt, synthetic construct
  misc_feature 1..384: note = derived and/or modified sequence opt5 from anti-HIV_Chain
  source 1..384: mol_type = other RNA
caggtgcaactggtccagagcggcgccgaggttaagatgcccggggcttccgtgaaagtgtcttgcaaggtcagcggatactccctcaccgaactgtctatccactgggtgagacaggcccctggcaaacggcttgagtggatgggagggttcgacccggaagatgacgagcgcatttatgcgcagaagtttcaagatagagttacaatgacggaagacaccagcacagataccgcttacatggacctgaactccctccggtctgaggatacagccgtgtattactgtaccacaggcgggctgtattgcagctccatcagctgtattatggacgtctggggacagggcaccacggtgatcgtttcttccgccagcaccaaaggc

SEQ ID NO: 42578 - RNA, 387 nt, synthetic construct
  misc_feature 1..387: note = derived and/or modified sequence opt5 from anti-HIV_Chain
  source 1..387: mol_type = other RNA
gaggtgcagctgagcgaatccggcgggggattcgtcaagcccggcgggtctctcagactgagctgcgaggcctccggatttaccttcaacaattacgctatgtcttgggttcggcaagcccctggcaaagggcttgaatgggtgagcgtgacatccgcgcacggaggctctgcttattacggcgagtttgtcaaggggcgcttcacgatgagcagagaccattttatcgataccgtgtatctggaaatgaacggactcacagttgaggacaccgccgtgtactattgtgtccgggtgacattctaccacgagggctccgggtattactaccgcgccggaaattattttgatagctggggcaaagggaccagagttgtggtctctgct

SEQ ID NO: 42579 - RNA, 387 nt, synthetic construct
  misc_feature 1..387: note = derived and/or modified sequence opt5 from anti-HIV_Chain
  source 1..387: mol_type = other RNA
gaggtgcagctgagcgaatccggcgggggattcgtcaagcccggcgggtctctcagactgagctgcgaggcctccggatttaccttcaacaattacgctatgtcttgggttcggcaagcccctggcaaagggcttgaatgggtgagcgtgacatccgcgcacggaggctctgcttattacggcgagtttgtcaaggggcgcttcacgatgagcagagaccattttatcgataccgtgtatctggaaatgaaccggctcacagttgaggacaccgccgtgtactattgtgtccgcgtgacattctaccacgagggatccggctattactacagagccgggaattattttgatagctggggaaaaggcacccgggttgtggtctctgct

SEQ ID NO: 42580 - RNA, 387 nt, synthetic construct
  misc_feature 1..387: note = derived and/or modified sequence opt5 from anti-HIV_Chain
  source 1..387: mol_type = other RNA
gaggtgcagctgagcgaatccggcgggggagtcgttaagcccggcgggtctctcagactgagctgcgaggcctccggattcaccttttctaactacgctatgagctgggtgcggcaagcccctggcaaagggcttgaatgggtgtccgtcacaggaggccacggcacgtatgggtactatggagagttcgtgaagggccgctttaccatctctagagaccatagcatggatacagtttacctgcagatgaatcggctccgcgtggaagacaccgcggtctattactgtgtgagaacaccgtattaccacgagtccagcgggtactattaccgggctggaaactatttcgatttttggggcaaagggaccctggttattgtgtctgcc

SEQ ID NO: 42581 - RNA, 387 nt, synthetic construct
  misc_feature 1..387: note = derived and/or modified sequence opt5 from anti-HIV_Chain
  source 1..387: mol_type = other RNA
gaggtgcagctgagcgaatccggcgggggattcgtcaagcccggcgggtctctcagactgagctgcgaggcctccggatttaccttcaacaattacgctatgggctgggttcggcaagcccctgggaaaggacttgaatgggtgtctgtgacaagcgcgcacggcggctccgcttattttggggagttcgtcaagggacgctttacgatgtctagagaccatttcatcgataccgtgtacctggaaatgaaccggctcacagttgaggacaccgccgtgtattactgtgtccgcgtgacattttatcacgagggcagcgggtactattacagagccggaaattacttcgattcctggggccaggggaccctggttattgtgagcgct

SEQ ID NO: 42582 - RNA, 387 nt, synthetic construct
  misc_feature 1..387: note = derived and/or modified sequence opt5 from anti-HIV_Chain
  source 1..387: mol_type = other RNA
caggtgcaactggtcgagagcggcgggggactcgttcagcccggcgggtccctgagactttcttgcgccgctagcggattcaccttttccacacactggatgcattgggtgcggcaggcccctggcaaggggctggtgtgggtctctcgcatccacagcgacggaagatccacgtcttacgcggatagcgtgaaaggccggttcaccatttcccgcgacaacgctaagaatacactctatctgcagatgaacagccttagagccgaagataccgccgtttactattgtgctcggggcgccgctgtgtttggggtcgtgatcattggaggcatggacctgtgggggcaaggaacaaccgttacagtgtcttccgccagcaccaaaggc

SEQ ID NO: 42583 - RNA, 387 nt, synthetic construct
  misc_feature 1..387: note = derived and/or modified sequence opt5 from anti-HIV_Chain
  source 1..387: mol_type = other RNA
caggtgcaactggtcgaaagcggcggggccctcgttcagcccggaggctccctgagactttcttgcgctgccagcgggttctccttttctagctacgcgatgtcctgggtgcggcaggctcctggaaagggcctggaatgggtgtctgccatcagccgctccgggggaagcacctattacgccgactctgtcaaaggcagattcacaatttccatcgataatagcaataacacgctctatctgcagatgaactctcttcgggtggaggacaccgctgtttactattgtgccaagcgcgaggctttttactatggcgccgggggatacggcatggatgtgtgggggcaaggaacaaccgtcacagtgtccagcgcgtctaccaaaggc

SEQ ID NO: 42584 - RNA, 387 nt, synthetic construct
  misc_feature 1..387: note = derived and/or modified sequence opt5 from anti-HIV_Chain
  source 1..387: mol_type = other RNA
ttccagggccacctggtgcaaagcgggggaggcgtcaagaaacccgggacctccgttacactctcttgcctggccagcgagtacacgtttaccgagttcacaatccattggattagacaggctcctggacagggcccgctttggctggggctcatcaagcggtccggacgcctgatgacctcttatagatttcaggaccggcttagcctgcgcagagatcggtccacaggcaccgtgttcatggaactccgctctctgagaacagacgataccgccgtgtactattgtgcgcgggacggcctgggggaactcgctcccgcctaccactatggaattgatgcctggggccaagggacgaccgtcatcgtgacaagcgcttccaccagc

SEQ ID NO: 42585 - RNA, 387 nt, synthetic construct
  misc_feature 1..387: note = derived and/or modified sequence opt5 from anti-HIV_Chain
  source 1..387: mol_type = other RNA
cagggcctgctcgtgcaaagcgggggaggcgtcaagaaactggggacctccgttacaatctcttgccttgccagcgagtacacgttcaacgaatttgtgattcactggatcagacaggctcccggacagggccctctgtggctcgggctgattaagcggtccggacgccttatgacctcttatcagttccaagacagactgagcctccggcgcgatagatccacaggcaccgtgtttatggagctgcggggcctgcgcgtcgacgatacagccgtgtactattgtgcgagagacgggctcggagaagttgctccggcctacctgtatggcatcgatgcctgggggcagggaaccacagtgattgtcacctctgctagcacgaaaggc

SEQ ID NO: 42586 - RNA, 387 nt, synthetic construct
  misc_feature 1..387: note = derived and/or modified sequence opt5 from anti-HIV_Chain
  source 1..387: mol_type = other RNA
aacttcatgctgacccagcccgccagcgtgtccggctctcctgggcaaagcatcacaatttcctgctctggaacgggcagcgacatcggggtctacaattatgtttcctggtaccagcagcacccgggaaaggctcccagactcatgatttatgatgtgaccaaccggccttctggcgtgagcaatcgcttctccgggagcaaatctggattcacagcctccctgaccatcagcggccttcagggcgacgatgaggcggactactattgttcttcctacagctctacaaacacctatgtctttgggacaggaacccatgtgacggttctgggccaacccaaggctaatcctaccgtgacactctttcccccttccagcgaggaactg

SEQ ID NO: 42587 - RNA, 387 nt, synthetic construct
  misc_feature 1..387: note = derived and/or modified sequence opt5 from anti-HIV_Chain
  source 1..387: mol_type = other RNA
cagagcgccctgacccaacccagatccgtgtctggcagccctgggcagtccgtcacaatctcttgcacgggaaccagctccgacgttggcgcttacaactatgtgtcttggtaccggcagcacccggggaaggcccccaaactcatgattaatgatgtgagcaagcgcccttccggagtccccgacagattcagcggctctaaatccgggaacacagcgagcctgaccatctctggacttcaggctgaggatgaagccgactattactgttgctcctatgccggcacatacagctatgtgtttggcaccgggacaaaggttaccgtgctgggacaacctaaagctaatcccacggtcaccctcttccctccgtcttccgaggaactg

SEQ ID NO: 42588 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcctcaagaaacccgggacctccgtcacaatctcttgcctggccagcgagtacacgttcaacgaatttgttattcactggatcagacaggctcctggacagggcccgctttggctggggctcattaagcggtccggacgcctgatgaccgcctataatttccaagacagactttctctgcggcgcgatagaagcacaggcaccgtgtttatggagctccggggcctgcgccccgacgatacagcggtgtactattgtgctagagacgggctgggagaagtcgcccctgattaccggtatggcatcgacgtgtgggggcagggatccaccgttattgtgacagccgcttctaccaaaggc

SEQ ID NO: 42589 - RNA, 387 nt, synthetic construct
  misc_feature 1..387: note = derived and/or modified sequence opt5 from anti-HIV_Chain
  source 1..387: mol_type = other RNA
aacttcatgctgacccagccccctagcgcctccggcgctccggggcaaagagtgacaatctcttgcagcggaggcccctccaatgtcgggggaaactacgtttattggtaccggcagtttcctggcacggcccccaatctcctgattcttcgcgacgatcagagaccttctggggtgcccgaccggttcagcgcgtccaagtctggaaacagcgcttccctggccatcagcggcctccgccctgatgacgaggccttttatttctgtgctacctacgattctgacggctccattagactgtttgggggaggcacaacccttacagtgctgagccagccgaaagccgctccctctgtcaccctcttccctccctccagcgaggaactg

SEQ ID NO: 42590 - RNA, 387 nt, synthetic construct
  misc_feature 1..387: note = derived and/or modified sequence opt5 from anti-HIV_Chain
  source 1..387: mol_type = other RNA
cagctggtgctcacccaaccccctagcgtctccggcgccccggggcagagagttacaatctcttgcagcggaggcccctccaacgtcgggggaaatctggtgtactggtataagcagttccctggcacggctcccaaacttctgattcggcgcgacgatcagagaccttctggggtgcccgaccggtttagcggatccaagtctggcaacagcgcctccctcaccatcagcggcctgcgccctgatgacgaggcgttctacttttgtgctacatatgattctcaagggtccaccagacttttcggaggcgggacagtgctgaccgttctcagccagccgaaagccgccccctctgtgacactgtttcctccctccagcgaggaactg

SEQ ID NO: 42591 - RNA, 387 nt, synthetic construct
  misc_feature 1..387: note = derived and/or modified sequence opt5 from anti-HIV_Chain
  source 1..387: mol_type = other RNA
aacttcatgctgacccagccccctagcgtgtccggcgccccggggcaaagagtcacaatctcttgcagcggaggcccctccaatgttgggggaaacctcgtgtactggtataagcagtttcctggcacggctcccaaactgcttattcggcgcgacgatcagagaccttctggggtgcccgaccggttcagcggatccaagtctggcaatagcgcctccctggcgatcagcggcctccgccctgatgacgaggctttttacttctgtgccacctatgattctcacgggtccattagactgtttggaggcgggacacttctgaccgtcctcagccagccgaaagccgctccctctgtgacactgttccctccctccagcgaggaactg

SEQ ID NO: 42592 - RNA, 387 nt, synthetic construct
  misc_feature 1..387: note = derived and/or modified sequence opt5 from anti-HIV_Chain
  source 1..387: mol_type = other RNA
cagagcgccctgaccagaacaccctccgtgtctggcgctcctgggcaacgggtcacgatcagctgctccggaggcccgtctaacgttgggggaaattacgtgtattggtaccagcagttccccggcgccgcgcctaagctcctgattcgcagagacgatcagcggcccagcggggtgcctgaccgcttttccggatctaaaagcggcaactccgctagccttgccatctctggcctgagactcgatgacgaggcctattacttctgtgctacctatgattccgggtggagcattcggctgtttggaggcgggacacgccttaccgtcctgtctcaacccaaggccgctccttccgtgacactcttcccgcccagctctgaggaactg

SEQ ID NO: 42593 - RNA, 387 nt, synthetic construct
  misc_feature 1..387: note = derived and/or modified sequence opt5 from anti-HIV_Chain
  source 1..387: mol_type = other RNA
cagagcgccctgacccaacccccttccgtgtctgctacaccgggccagacggtcaccatcagctgctccgggtctggaagcaacgttggcgggaatcacgtgtactggtatagacagctccccggagccgcgcctacactgcttatttccaagaccgaccatcggccctctcgcgtgcctgatagattcagcgcttccaaaagcggcaactctgcctccctggccatcagcgggctccggcccgacgatgaggctatttacttttgtgccacatatgacaccggactgtctcttcgcctgttcggcggcgggacaagactcaccgtcctgtcccagcctaaggctgccccgagcgtgacgctgtttcccccttcttccgaggaactc

SEQ ID NO: 42594 - RNA, 387 nt, synthetic construct
  misc_feature 1..387: note = derived and/or modified sequence opt5 from anti-HIV_Chain
  source 1..387: mol_type = other RNA
caggtgcaactgctcgagagcggccccgggctggtcaccccttccggaacactttctctggcctgcgctgttagcggcgcctccatctctagctcccactggtggacgtgggtgagacagtctccggggaagggactcgaatggattggcgagatcgaccggcgcgggaccacaaactacaatcccagcctgagatcccgggtgaccattcttctggataacagcaaaaatcagttctctctctccctgcgcagcgtcacagcggctgacaccgccgtgtattactgtacaaaggtttatgccggactgtttaacgaaagaacctacggcatggatgtgtggggccatgggacgaccgtcctcgtgtcttccgctagcacaaaagga

SEQ ID NO: 42595 - RNA, 387 nt, synthetic construct
  misc_feature 1..387: note = derived and/or modified sequence opt5 from anti-HIV_Chain
  source 1..387: mol_type = other RNA
caggccgtggtcacccaaccccctagcgtttccgctacaccgggccagacggtgaccatctcttgcagcgggtccggatctaacgtgggcgggaatcacgtctactggtatagacagctgcccggagccgcgcctacactcctgattagcaagaccaaccggcgcccctcccaggtgcctgacagattctctggcagcaaatccgggaatagcgcttctcttgccatctccggactgcggcccgatgacgaggccgattacttttgtgctacatatgacaccgatctcagcctgcgccttttcggcggcgggacaagactgaccgttctctctcaacctaaggccgctccgtccgtgacgctgtttccccctagctctgaggaactg

SEQ ID NO: 42596 - RNA, 387 nt, synthetic construct
  misc_feature 1..387: note = derived and/or modified sequence opt5 from anti-HIV_Chain
  source 1..387: mol_type = other RNA
cagagcgccctgacccaacccccttccgtgtctggcacaccggggcagaacgtcacgatcagctgctccggaggcgggtctgacgttggaggcaatctcgtgagctggtaccagcacttccccggggctgcccctaagctgcttattcatagagataaccagcggccctccggagtgcctgaccgcttttctgcgctgaaaagcggcaattccgctagcctcgccatctctggcctgagatccgatgacgaggccttctatttttgtgctgtctacgatagctctctttccctgggactcttcgggggcgggaccaagctgacagtgctgagccaacccaaagccgctccttctgttaccctctttccgccctccagcgaggaactg

SEQ ID NO: 42597 - RNA, 387 nt, synthetic construct
  misc_feature 1..387: note = derived and/or modified sequence opt5 from anti-HIV_Chain
  source 1..387: mol_type = other RNA
cagagcgccctgacccaacccccttccgcttctggcacaccggggcagagagtgacgatcagctgctccggaggcgggtctaacattggaggcaatctcgtcagctggtaccagcacttccccgggaccgcccctaagctgcttatctatcggaacgaccagcgcccctccggagttcctgatagattttctggcagcaaatccggcacaagcgcgtctctgaccatttccgggctccggagcgacgatgaggctacatacttctgtgccgcctatgactcttccctgagccttcgcctgtttggaggcgggaccacactcaatgtgctgtctcaacccaaggctgccccttccgtgaccctgttcccgcccagctccgaggaactc

SEQ ID NO: 42598 - RNA, 387 nt, synthetic construct
  misc_feature 1..387: note = derived and/or modified sequence opt5 from anti-HIV_Chain
  source 1..387: mol_type = other RNA
cagagcgccctgacccaacccccttccgtgtctgctacaccgggccagacggtcaccatcagctgctccgggtctggaagcaacgttggcgggaatcacgtgtactggtatagacagctccccggagccgcgcctacactgcttatttccaagaccaaccatcggccctctcaggtgcctgaccgcttcagcgcttccaaaagcggcaattctgcctccctggccatcagcgggctcagacccgatgacgaggctgattacttttgtggaacatatgacacctctctgtcccttcggctgttcggcggcgggacacgcctcaccgtcctgagccaacctaaggccgctccgtctgtgacgctgtttcccccttccagcgaggaactc

SEQ ID NO: 42599 - RNA, 387 nt, synthetic construct
  misc_feature 1..387: note = derived and/or modified sequence opt5 from anti-HIV_Chain
  source 1..387: mol_type = other RNA
cagagcgtgctgacccaagtcctctccgtttctggcacacccgggcagagagtgatcattagctgctccggaacgtctagcaacgtgggcgggaatctggtctcctggtaccagcaccttcctggagccgctccgcggctgctcatccatcgcgacgatcagagaccctctggcgtgcctgaccggttcagcgggtccaagagcggaaactctgcctccctggttattagcggccttcgctctgatgacgaggcggattatttttgtggcgcttacgactccaccttcagcctgcccgtgtttgggggaggcacaagactcaccgtcctgtctcaacctaaagccgccccctccgtgacactgttccctccgagctccgaggaactc

SEQ ID NO: 42600 - RNA, 387 nt, synthetic construct
  misc_feature 1..387: note = derived and/or modified sequence opt5 from anti-HIV_Chain
  source 1..387: mol_type = other RNA
cagagcgccctgacccaaccccctgctacatccggcacgccggggcagagagtgaccatctcttgcagcggaggcgggtccaacgtcggaggcaatctcgtttcttggtaccagcagttccccggggccgcgcctaagctgattcttcaccgggacggacaacgccccagcggcgtgcctgatagattttccgcttctaaaagcggcacatccgccagcctgaccatctctgggctccggtccgacgatgaggccacatatttctgtgctgcctttgacagcgctctgtctcttcccctgttcggaggcgggaccaagctcacagtgctgtcccagcctaaagccgcgccgagcgtcaccctgtttcccccttcttccgaggaactc

SEQ ID NO: 42601 - RNA, 387 nt, synthetic construct
  misc_feature 1..387: note = derived and/or modified sequence opt5 from anti-HIV_Chain
  source 1..387: mol_type = other RNA
cagctggtgctcacccaaccccctagcgtctccgccacaccgggccagacggttaccatctcttgcagcgggtccggatctaacgtgggcgggaatcacgtgtactggtatagacagctgcccggagctgcccctacacttgtcattagcaagaccgaccatcggccctcccgcgtgcctgatagattctctggcagcaaatccgggaacagcgcgtctctggctatctccggactccggcccgacgatgaggccgcctacttttgtgctacatatgacaccggcctgagccttcgcctgttcggcgggggaacaagactcgccgttctgtctcagcctaaggctgccccgtccgtgaccctgtttccccctagctctgaggaactc

SEQ ID NO: 42602 - RNA, 387 nt, synthetic construct
  misc_feature 1..387: note = derived and/or modified sequence opt5 from anti-HIV_Chain
  source 1..387: mol_type = other RNA
cagagcgccctgacccaacccccttccgtgtctggcacaccggggcagaacgtcacgatcagctgctccggaggcgggtctaatgttggaggcaacctcgtgagctggtaccagcacttccccggggctgcccctaagctgcttattcatagagacaatcagcggccctccggagtgcctgatcgcttttctgtcctgaaaagcggcaactccgcgagcctcgctatctctggccccagatccgacgatgaggccttctatttttgtgccgtgtacgacagctctctgtcccttgggctgttcggaggcgggaccaagctcacagttctgagccaacctaaagctgccccgtctgtgaccctgtttcccccttccagcgaggaactc

SEQ ID NO: 42603 - RNA, 387 nt, synthetic construct
  misc_feature 1..387: note = derived and/or modified sequence opt5 from anti-HIV_Chain
  source 1..387: mol_type = other RNA
cagaccgtggtcacacaaccccctagcgcctccggcacgccggggcagagagttaccatctcttgcagcggaggcgggtccaacattggaggcaatctggtgtcttggtaccagcacttccccggggctgcccctaagctcctgatctatcggaacgaccagcgccccagcggagtgcctgatagattttccggctctaaaagcggcacatccgcgagccttaccatttctgggctgcggtccgacgatgaggctacatacttctgtgccgcctatgactgcaccctcagcctgcgcctttttggaggcgggacaaccctgaatgtcctctctcaacccaaggctgccccttccgtgacgctgttcccgcccagctctgaggaactg

SEQ ID NO: 42604 - RNA, 387 nt, synthetic construct
  misc_feature 1..387: note = derived and/or modified sequence opt5 from anti-HIV_Chain
  source 1..387: mol_type = other RNA
cagagcgccctgacccaaacaccctccgtgtctggcgctcctgggcagagagtcacgatcagctgctccggaggcccgtctaacgttgggggaaattacgtgtattggtaccagcagttccccggcgccgcgcctaagctcctgattcggcgcgacgatcaaagacccagcggggtgcctgaccggttttccggatctaaaagcggcaactccgctagccttgccatctctggcctgcgcctcgatgacgaggcctattacttctgtgctacctatgattccgggtggagcattagactgtttggaggcgggacacggcttaccgtcctgtctcagcccaaggccgctccttccgtgacactcttcccgcccagctctgaggaactg

SEQ ID NO: 42605 - RNA, 387 nt, synthetic construct
  misc_feature 1..387: note = derived and/or modified sequence opt5 from anti-HIV_Chain
  source 1..387: mol_type = other RNA
cagagcgtgctgacccaacccccttccgcctctggcgctccggggcagagagtcacaatcagctgctccggaggcccctctaacgttgggggaaattacgtgtattggtaccggcagttccctggcacggcccccaacctcctgattcttcgcgacgatcagagacctagcggggtgcccgaccggttttccgcgtctaagagcggaaattccgctagcctggccatctctggcctccgccctgatgacgaggccttctatttttgtgctacctacgattccgacggcagcgtcagactgttcgggggaggcacaacccttacagtgctgtctcaaccgaaagccgctccctccgttaccctctttcctcccagcaacgggggacgg

SEQ ID NO: 42606 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaacccgggacctccgttacaatctcttgcctcgccagcgagtacacgttcaacgaatttgtgattcactggatcagacaggctcctggacagggcccgctgtggcttgggctgattaagcggtccggacgcctcatgacctcttataaattccaagacagactgaatcttcggcgcgatagaagcacaggcaccgtgtttatggagctgcggggcctccgccccgacgatacagccgtctactattgtgcgagagacgggctgggagaagtggctcctgattaccggtatggcatcgacgtttgggggcagggatccaccgtgattgtcacagccgcctctaccaagggc

SEQ ID NO: 42607 - RNA, 387 nt, synthetic construct
  misc_feature 1..387: note = derived and/or modified sequence opt5 from anti-HIV_Chain
  source 1..387: mol_type = other RNA
gaggtgcagctggtcgaaagcggcgccgaggttaagaaacccggggcttccgtgaaggtggcctgcaaagtctctggaaagaaactcagcgacctgtccatccactgggtgagacaagcgcctggcaaggggcttgaatggatgggaggcttcgatgaggaagacgggaagatttcttacgagcggaaatttcagggacgcgttaccatgacagaggatacggctagagacaccgccttcatggaaatgagctccctgcggtctgatgacacagccgtgtatttttgtgctgccgctccgcgcctcgatctgggcgagcttagctccggcttccatttttgggggctgggaaccctcgtcagcgtgtcttccgccagcacaaagggc

SEQ ID NO: 42608 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgggaagaaactcggaacctccgtcacaatctcttgcctggccagcgagtacacgttcaacgaatttgttattcactggatcagacaggctcccggccaggggcctctttggctgggactcattaagcggtccggccgcctgatgacctcttatcaattccaggacagacttagcctgcggcgcgatagatccacaggcaccgtgtttatggagctccgggggctgcgcgtggacgatacagccgtctactattgtgcgagagacggactgggcgaagtggctccggcctacctctatgggatcgatgcctggggacagggcaccacagttattgtgtctagcgcttccaccaaaggg

SEQ ID NO: 42609 - RNA, 387 nt, synthetic construct
  misc_feature 1..387: note = derived and/or modified sequence opt5 from anti-HIV_Chain
  source 1..387: mol_type = other RNA
gaggtgcagctggtcgaaagcggcgccgaggttaagaaacccggggcttccgtgaaggtgtcttgcaaagtcagcggatacaccctctccgacctgtctatgcactgggtgagacaagcccctggcaaggggcttgaatggatgggaggcttcgatgaggaagacggggagatcacatatgcgcagaaatttcagggacgggttagcatgacggaggatacctcccgcgacacagcttacatggaactgtctagcctcagatccgaggataccgccgtgtattactgtgccacagctccgcggctggaacttggcgagctgagctctggcttccattattgggggctcggaaccctggtcacagtgtccagcgcctctaccaagggc

SEQ ID NO: 42610 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaaaccgggacatccgttacgatctcttgcctcgccagcgagtacaccttcacagaatttaccattcactggatcagacaggctcccggacagggccctctgtggcttgggctgattaagcggtccggacgcctcatgacagccaacagattccaagaccggctgtctcttcgcagagatcggagcaccggcacagtgtttatggagctgcgctccctcagaatcgacgataccgcggtgtattactgtgctcgggacggcctgggggaactggccccggcctatcattacggaattgatgtctggggccaggggacgaccatcatcgtgacatctgctagcaccaaagga

SEQ ID NO: 42611 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaactcgggacctccgttacaatctcttgcctggccagcgagtacacgttcaacgaatttgtgattcactggatcagacaggctcccggacagggccctctttggctggggctcattaagcggtccggacgcctgatgacctcttatcaattccaggacagacttagcctgcggcgcgatagatccacaggcaccgtgtttatggagctccggggcctgcgcgtcgacgatacagccgtgtactattgtgcgagagacgggctgggagaagttgctccggcctacctctatggcatcgatgcctgggggcagggaaccacagtgattgtcacctctgctagcacgaaaggc

SEQ ID NO: 42612 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaactcgggacctccgttacaatcccctgcctggcctctgagtacacgttcaacgaatttgtgattcactggatcagacaggctcctggacagggcccgctttggctggggctcattaagcggagcggacgcctgatgacctcctatcaattccaggacagactttctctgcggcgcgatagaagcacaggcaccgtgtttatggagctccggggcctgcgcgtcgacgatacagccgtgtactattgtgcgagagacgggctgggagaagttgctcccgcctacctctatggcatcgatgcctgggggcagggaaccacagtgattgtcacctccgcttctacgaaaggc

SEQ ID NO: 42613 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaacccgggacctccgttacaatctcttgcctcgccagcgagtacacgttcaacgaatttgtgattcactggatcagacaggctcctggacagggcccggtgtggctggggcttattaagcggtccggacgcctgatgacctcttataaattccaagacagactcagcctgcggcgcgatagatccacaggcaccgtctttatggagcttcggggcctgcgcctcgacgatacagccgtgtactattgtgcgagagacgggctgggagaagttgctcccgcctacctgtatggcatcgatgcctgggggcagggatctaaggtgattgtcacccctgctagcacaaaaggc

SEQ ID NO: 42614 - RNA, 387 nt, synthetic construct
  misc_feature 1..387: note = derived and/or modified sequence opt5 from anti-HIV_Chain
  source 1..387: mol_type = other RNA
caggccagactggaccaatggggcaccgggctcctgaagcccagcgagacactttccctgaaatgcgctgtgttcggagtcctctttacggattacaactggacctgggttcggcagtctcctggcaaggaactggagtggatcgggcaccttgaccatcgcggaggcgggaattataacccgagcctggaatccagagtgacaatttctctcgattacagcaaagcccagttctccctgcacctgaagtctgtgaccgtcgcggacacagctcggtattactgtgccggagccgtgaaaggcttttggttcgatgacccctatacctggtttggcccttggagccaggggacactcgttaccgtggcttccgccagcacgaaggga

SEQ ID NO: 42615 - RNA, 387 nt, synthetic construct
  misc_feature 1..387: note = derived and/or modified sequence opt5 from anti-HIV_Chain
  source 1..387: mol_type = other RNA
caggccagactggaccaatggggcaccgggctcctgaagcccagcgagacactttccctgaaatgcgctgtgttcggagtcctctttacggattacaactggacctgggttcggcagtctcctggcaaggggctggaatggatcggacaccttgaccatcgcggcgggggaagctataatccgtccctggagtctagagtgagcatttccctcgattactctaaagcccagttcagcctgcacctgaagtccgtgacagtcgcggacaccgctctctattactgtgccggcgccgtgaaaggcttttggttcgatgaacccagcacatggtttgggccttggtctcagggaaccatggttacagtggcttccgccagcaccaagggc

SEQ ID NO: 42616 - RNA, 387 nt, synthetic construct
  misc_feature 1..387: note = derived and/or modified sequence opt5 from anti-HIV_Chain
  source 1..387: mol_type = other RNA
cagggccacctggtgcaaagcgggggaggcgtcaagaaactcgggacctccgttacaatctcttgcctggccagcgaggacacgttcaacgaatttgtgattcattggatcagacaggctcccggacagggccctctttggctggggctcattaagcggtccggacgcctgatgacctcttaccagttccaagatagacttagcctgcggcgcgacagatccacaggcaccgtgtttatggagctccggggcctgcgcgtcgatgacacagccgtgtattactgtgcgagagatgggctgggagaagttgctccggcctatctctacggcatcgacgcctgggggcagggaaccacagtgattgtcacctctgctagcacgaaaggc

SEQ ID NO: 42617 - RNA, 387 nt, synthetic construct
  misc_feature 1..387: note = derived and/or modified sequence opt5 from anti-HIV_Chain
  source 1..387: mol_type = other RNA
caggtgcaactggtccagagcgaggccgaagttaagaaacccggctcctctgtgaaggtgagctgcaaggcttccgggggaaccttcagaggctacacaatctcttgggtccggcaggcccctgggcagggactcgagtggatgggccgcattatcccgattctggggaaagcgatctatgctcccagctttcaaggaagagtgacgcttaccgccgacaaatccacaggcaccgcctacatggaactgtctcggctccgcagcgatgacacagctgtttattactgtgccaaggtgaagatgagaggctccagcgggtattactatctgttcgatgactggggacagggcacccttgtcacagtgtcttccgctagcaccaaaggg

SEQ ID NO: 42618 - RNA, 387 nt, synthetic construct
  misc_feature 1..387: note = derived and/or modified sequence opt5 from anti-HIV_Chain
  source 1..387: mol_type = other RNA
caggccagactggaccaatggggcaccgggctcctgaagcccagcgagacactttccctgaaatgcgctgtgttcggagtcctctttacggattacaactggacctgggttcggcagtctcctggcaaggggctggaatggatcggacaccttgaccatcgcggcgggggaaattataacccgagcctggagtccagagtgacaatttctctcgattacagcaaagcccagttctccctgcacctgaagtctgtgaccgtcgcggacacagctctctattactgtgccggcgccgtgaaaggcttttggttcgatgaagtttataattggtttgggccctggagccagggaaccctggtgacagtcgcttccgccagcaccaagggc

SEQ ID NO: 42619 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaacccgggacctccgttacaatctcttgcctcgccagcgagtacacgttcaccgaatttacaattcactggatcagacaggctcctggacagggcccgctgtggcttgggctgattaagcggtccggacgcctcatgaccgcctatagattccaagaccggctgtctcttcgcagagatcggagcacaggcaccgtgtttatggagctgcgcaacctcagaatggacgatacagcggtgtactattgtgctcgggacggcctgggggaactggcccccgcctaccagtatggaatcgatgtctggggccaggggaccacggtgattgtttcctctgctagcaccaaagga

SEQ ID NO: 42620 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagcggcctggggcctccatccgcctctcttgcgagagctccggatacagattccaggactatattgtggcttggatccggcagacccgcggccaagggtttgagttcgtgggaatggtcaacccgagaggcgggcggccctggccttctagccgctttagagatcgggtgacactgacgcgcgacattgaatccgaaaccttctaccttggactgaatgatctcacatctgacgataccgccacatatttttgtgcgagactggaggctgacggcagcgattactcccccaaaatgttcgacttttggggccaggggaccaagatcgttgtgagccctgcctctacaaaagga

SEQ ID NO: 42621 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagacccctggggcctccatgcgggtgtcttgcgaggctagcggataccgcttcctcgactatatcattgtgtggatcagacagacacacggccagcattttgaatacgtcgggatgattaacccgcggggaggcacgccctggccttcctctaaattccgcgatagactgagccttacccgggacatccacacagataccttttatctggggctcaataacctgggatccgacgatacagccatttacttctgtgcgcgccttgaggctgacggcgatgactattctcccaagatgtttgatcattggggccaagggaccagaatcatcgtgagcgccgcctccacaaaagga

SEQ ID NO: 42622 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagacccctggggcctccatccggctctcttgcgaggctagcggataccgcttcctggactattttattgtgtgggtgagacagacaccgggccaggggttcgaatacgtcggaatgatcaacccccggggcgggcgcccttggtcctcttggaaatttagagatcggcttagcctgacgcgcgagattgacaccgatacattctatctcggactgtccaatcttagatctgacgataccgccatctacttttgtgcgcggctggaagctgacggcgatgactatagccccaagatggtggattactggggccaagggacaaaaattatcgtttccgccgccagcaccaaggga

SEQ ID NO: 42623 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagcggcctggggcctccatccgcctctcttgcgagaccagcggatacagattccaggactatattgtggcttggatccggcagacacgcggccaaagatttgagttcgtggggatggtcaacccgcggggaggccgcccctggccttcctctaaatttagagatcgggtgacgctgacccgcgacattgaaagcgaaacattccaccttgggctgaatgatctcacctccgacgatacagccacctacttttgtgcgagactggaggctgacggagccgattattctcccaagatgttcgacttttggggccagggcacaaaaatcgttgtgagccctgcctccaccaagggg

SEQ ID NO: 42624 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagacccctggggcctccatgcggatctcttgcgaggctagcggataccgcttccaggactatattatcgtgtggattagacagacacacggccaagggtttgaatacgtgggaatgatcaacccgcggggcgggacgccctggtcctctagcaaattccgcgatagactctccctgacccgggacatttatacagataccttttaccttggactgaataacctcggctctgacgatacagccatctatttctgtgcgcgcctggaggctgacggcggggattacagccctaagatgtttgactattggggacagggcaccagaatcattgtctccgccgccagcacaaaaggg

SEQ ID NO: 42625 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaacccggggcctccgttaccatctcttgcctcgctagcgagtacacattcaacgaatttgtgattcactggatcagacaggcccctggacagggcccgctgtggcttgggctgattaagcggtccggacgcctcatgacggcgtataaattccaagacagactgtctcttcggcgcgatagaagcaccggcacagtgtttatggagctgcggggcctccgccccgaagacaccgctgtctactattgtgccagagatgggctgggagaggtggcccctgactaccggtatggcatcgatgtttgggggcagggatccacagtgattgtctctgctgccagcaccaagggc

SEQ ID NO: 42626 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccagatgaagacccctggggcctccctccggctgtcttgcgaggttagcggataccgcttccttgactattttatcgtgtgggtgagacagacaggcgggcagggattcgaatacgtcggcatgattaacccgcgcgggggacggccctggtcctcttggaaatttagagatcggctgagcctcacgcgcgacatcgagaccgatacattctatctgggccttaataacctgagatccgacgataccgctatttacttttgtgcccggctcgaagcggacggcgataattattctcctaagatggtggactactgggggcaaggaacaaaaatcattgttagccccgcttccaccaagggc

SEQ ID NO: 42627 - RNA, 387 nt, synthetic construct
  misc_feature 1..387: note = derived and/or modified sequence opt5 from anti-HIV_Chain
  source 1..387: mol_type = other RNA
caggtgagcctggtccaatccggcccccaggttaagacccctggggcctctatgagagtgagctgcgagacatccggataccggttcctcgactatatcattgtgtggatccgccagacgcacggccagcattttgaatacgtcgggatgattaacccgagaggaggcaccccctggccttctagcaaattccgggatcgcctgacaatgaccagagacatccacacagataccttttatcttgggctgaataacctccggtccgacgatacagctatttacttctgtgcccgcctggaggcggacggagatgactattctcccaagatgtttgattactggggccaaggcaccagaatcatcgtgagcgctgcctccacgaaaggg

SEQ ID NO: 42628 - RNA, 387 nt, synthetic construct
  misc_feature 1..387: note = derived and/or modified sequence opt5 from anti-HIV_Chain
  source 1..387: mol_type = other RNA
caggtgagactggtccaaagcggcccccaggttaagaccgccggggcttccatgcgggtgtcttgcgaggccagcggataccgcttcctcgactatatcattgtgtggatcagacagacacacggccagcattttgaatacgtcgggatgattaaccctcggggaggcacgccgtggccctcctctaaattccgcgatagactgacccttacacgggacatctataccgatacattttacctggggctcaataacctgggaagcggcgacaccgcgatttatttctgtgctcgccttgaggccgatggcgacgattactcccctaagatgtttgactattgggggcaaggaacaagaatcatcgtgtctgccgctagcaccaaaggc

SEQ ID NO: 42629 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaacccgggacctccgttacaatctcttgcctcgccagcgagtacacgttcaacgaatttgtgattcactggatcagacaggctcctggacagggcccggtgtggctggggcttattaagcggtccggacgcctgatgacctcttataaattccaagacagactcagcctgcggcgcgatagatccacaggcaccgtctttatggagcttcggggcctgcgcctcgacgatacagccgtgtactattgtgcgagagacgggctgggagaagttgctcccgcctacctgtatggcatcgatgcctgggggcagggatctaccgtgattgtcacaagcgcttccaccaagggc

SEQ ID NO: 42630 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcctcaagaaacccgggacctccgtcacaatctcttgcctggccagcgagtacacgttcaacgaatttgttattcactggatcagacaggctcctggacagggcccgctttggctggggctcattaagcggtccggacgcctgatgaccgcctataatttccaagacagacttcggctgcgcagagatcggtctacaggcaccgtgtttatggagctccgcggcctgagacccgacgatacagcggtgtactattgtgctcgggacgggctgggagaagtcgcccctgattaccgctatggcatcgacgtgtgggggcagggaagcaccgttattgtgacagccgcttccaccaaaggc

SEQ ID NO: 42631 - RNA, 387 nt, synthetic construct
  misc_feature 1..387: note = derived and/or modified sequence opt5 from anti-HIV_Chain
  source 1..387: mol_type = other RNA
cagggccacctggtgcaaagcgggggaggcgtcaagaaactcgggacctccgttacaatctcttgcctggtgagcgagtacacgttcaacgaatttgtgattcattggatcagacaggcccccggacagggccctctttggctggggctcattaagcggtccggacgcctgatgacctcttatcagttccaagacagacttagcctgcggcgcgatagatccacaggcaccgtctttatggagctccggggcctgcgcgtggacgatacagctgtttactattgtgccagagacgggctgggagaagtggcgccggcttacctctatggcatcgatgcctgggggcagggaaccacagtcattgtgacctctgccagcacgaaaggc

SEQ ID NO: 42632 - RNA, 387 nt, synthetic construct
  misc_feature 1..387: note = derived and/or modified sequence opt5 from anti-HIV_Chain
  source 1..387: mol_type = other RNA
cagggccaactggtgcagagcgggggaggcgtcaagaaactcgggacctccgttacaatctcttgcctggccagcgagtacacgttcaacgaatttgtgattcactggatcagacaggctcccggacagggccctctttggctggggctcattaagcggtccggacgcctgatgacctcttatcaattccaggacagacttagcctgcggcgcgatagatccacaggcaccgtgtttatggagctccggggcctgcgcgtcgacgatacagccgtgtactattgtgcgagagacgggctgggagaagttgctccggcctacctctatggcatcgatgcctgggggcagggaaccacagtgattgtctctagcgcttccaccaaaggc

SEQ ID NO: 42633 - RNA, 387 nt, synthetic construct
  misc_feature 1..387: note = derived and/or modified sequence opt5 from anti-HIV_Chain
  source 1..387: mol_type = other RNA
cagggccacctggtgcaaagcgggggaggcgtcaagaaactcgggacctccgttacaatctcttgcctggccagcgagtacacgttcaacgaatttgtgattcattggatcagacaggctcccggacagggccctctttggctggggctcattaagcggtccggacgcctgatgacctcttatcagttccaagacagacttagcctgcggcgcgatagatccacaggcaccgtgtttatggagctccggggcctgcgcgtcgacgatacagccgtgtactattgtgcgagagacgggctgggagaagttgctccggcctacctctatggcatcgatgcctgggggcagggaaccacagtgattgtcacctctgctagcacgaaaggc

SEQ ID NO: 42634 - RNA, 387 nt, synthetic construct
  misc_feature 1..387: note = derived and/or modified sequence opt5 from anti-HIV_Chain
  source 1..387: mol_type = other RNA
caggtgcaactggtccagagcggctccgagctcaagaaacccggggcctctgttaaggtgagctgcaaggcttccggatacaccttcacatcttatgccatcaactgggtgagacaggcgcctggccaggggctggaatggatgggatggattaatacgaacaccggcaatccgacatacgctcaagggtttaccggacggttcgtctttagccttgagacatccgtgtctaccgcctatctgcagatcaacagcctcaaagccgaagacacagctgtttactattgtgcccgcgatctgcttgagtccagaacctactataatgacattcgggattgctggggccagggcacgctggtgaccgtcagctctgcttccacaaaaggg

SEQ ID NO: 42635 - RNA, 387 nt, synthetic construct
  misc_feature 1..387: note = derived and/or modified sequence opt5 from anti-HIV_Chain
  source 1..387: mol_type = other RNA
caggtgcaactggtccagagcggcgccgaggttaagaaacccggggcttccgtgaaggtgtcttgcaaagccagcggatacaccttcacagactattacatccactgggtcagacaggcgcctggccaggggctcgaatggatgggatggattaacccgtccacgggcgggaccaattttgtgcaaaagttcctgggacgggttacaatgacctctgatacaagcatcaacaccgcttatatggagcttcgcagactgaaaaatgacgatgccgccatttactattgtgctacatactccacccggcagtttttccattattactacgtgacggacgtctggggccagggcaccacagtgaccgtttctagcgcctccacaaagggg

SEQ ID NO: 42636 - RNA, 387 nt, synthetic construct
  misc_feature 1..387: note = derived and/or modified sequence opt5 from anti-HIV_Chain
  source 1..387: mol_type = other RNA
ttccagggccaactggtgcagagcgggggaggcgtcaagaaacccgggtcctctgttaccatcagctgcctcgcctccgagtacacatttacggagttcaccattcactggatcagacaggctcctggacagggcccgctgtggcttgggctgattaagcggtctggacgcctcatgacaagctatggctttcaagacagactgtccgtgcggcgcgatagatctaccggcacagtgttcatggaacttcggagcctgcgcaccgacgatacagccgtctactattgtgcgagagacgggctcggagaactggctcccgcctaccattatggcatcgatgtgtgggggcagggaaccacggttattgtgacctccgccagcacatct

SEQ ID NO: 42637 - RNA, 387 nt, synthetic construct
  misc_feature 1..387: note = derived and/or modified sequence opt5 from anti-HIV_Chain
  source 1..387: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacaaatactatgccgattctgttaagggaagattcacaattagccgggacgattccaaaagcacggtgtacctgcagatcaattctctccgcgccgctgacaccgccgtctatttttgtgctagagagggcggcctgcggttccttgaatggctgttttgggggcaaggaacactcgtgaccgtttccagcggcgagtcttccgccagcacaaagggg

SEQ ID NO: 42638 - RNA, 390 nt, synthetic construct
  misc_feature 1..390: note = derived and/or modified sequence opt5 from anti-HIV_Chain
  source 1..390: mol_type = other RNA
caggtgcaactggtccagagcggcgccgttgtgaagtcccccgggtctagcgctaaactctcctgcagactgcttggagacgagttcggcacctactttatctcttggattcggcaggcccctgggcgcggactggaatgggtgggcgggatcgtcccgcacagccagctccaatcctctgcgcagaagttccatggaagatttttcattacaggcggcgtgacgccccctatcatttttctgcagcttaccaacgttacattcgaggataccgggacatatttttgtgctcgggaacgcggaagacaccgggaccccaaaaccggcaagagcctgcgcgggagatacttcgatttttggggacggggcacaggggtgaccgtctcccct

SEQ ID NO: 42639 - RNA, 390 nt, synthetic construct
  misc_feature 1..390: note = derived and/or modified sequence opt5 from anti-HIV_Chain
  source 1..390: mol_type = other RNA
cagatcgagctgagacaaagcggcgccgctatgaagtcccccgggtctagcgtgaaactctcctgcaccgtcctgggagaaaacttcggcacatactttatttcttggatccggcaggcccctgggcagggacttgagtgggttggcgggattgtgccgcacagccagctgcaatcctctgcgcagaagttccatggacgcatcaaaattagcggcggcgggacgccccctgtggtctccctcgaactgaccaatgtgacatttgacgataccggaacatatttctgtgctagagagcggggccgccacgttgaacccaagaccggggacagacttgccggacggtactttgatatctggggccgcgggacaggactgagagtgagccct

SEQ ID NO: 42640 - RNA, 390 nt, synthetic construct
  misc_feature 1..390: note = derived and/or modified sequence opt5 from anti-HIV_Chain
  source 1..390: mol_type = other RNA
gaggtgcagctggtcgaaagcggcgggggactcgttaagcccggcgggtccctgagactttcttgcgaggccagcggattcacctttacaaacgcttggatgaattgggtgcggcaagcccctggcaaagggctggaatgggtgggacgcatcaagtcccagacgcacggcggcaccacaagatacgcggctccggtcaaagggcggttcaccatttctcgcgacgatagcaagcatacactctatctgcagatggacagacttaccacagaggataccgccgtgtactattgtacgggaaccatcacaggctccaccttttactattacgggatggacgtttggggacagggcacaaccgtgacggtctctcccgccagcacaaaaggg

SEQ ID NO: 42641 - RNA, 390 nt, synthetic construct
  misc_feature 1..390: note = derived and/or modified sequence opt5 from anti-HIV_Chain
  source 1..390: mol_type = other RNA
gtggtccagctggttcaaagcggccccgggctcgtgaagccttcccagaccctgtctcttacatgcacggtgagcggaggctccatctctagcggggacttctactggtcctggattagacagccgcccggaaaaggcctggagtggatcgggtatatttactattctggaagcacctactataacccttccctcaagagccggctgacaatctctgtcgatacctccaaaaatcagtttagccttcgcctgtcttccgtgacagccgctgacaccgccgtttactattgtgcgagagatctcaacagccggattgtgggcgctctggacgccttcgatatctggggccaagggacaatggtcaccgtgtcttccgccagcacgaaggga

SEQ ID NO: 42642 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggcgggggactcgttcagcccggcagatccctgcggctttcttgcgccgctagcgggttcacctttgacgattacgccatgcactgggtgcgccaggcgcctggaaagggcctggaatgggtgtccgggatctcttggaacagcggaacaattggctatgctgactccgtcagaggccggttcacgatctctcgcgatgacgccaaaagctccctctacctgcagatgaatagccttagaaccgaggatacagccctgtattactgtgctaaggacgggtgggtgggatctggctccagcaccctccgggggtctgattattggggacaaggcacactggttaccgtgtccagcgcctctacaaaaggg

SEQ ID NO: 42643 - RNA, 390 nt, synthetic construct
  misc_feature 1..390: note = derived and/or modified sequence opt5 from anti-HIV_Chain
  source 1..390: mol_type = other RNA
cagagcgtgctgacccaacccccttccgcctctggcagcccggggcagtccatcacaatttcttgcacgggaaccagctccgacgtcggcgggtacaactatgtttcttggtaccagcagccccctggaaaggctcccaaagtgatcatttatgaggtgagcaagagaccttccggcgtccccgatcggttcagcgggtctaaatccggaaatacagccagcctcaccgtgtctggcctgcaagcggaagacgaggctgattactattgttccagctacgccggctctaacaattttgttttcgggacaggaaccgaagtgacagtcgtgggccagcctaaggccaacccgaccgttacgctttttcccccttccagcgaggaactgctc

SEQ ID NO: 42644 - RNA, 390 nt, synthetic construct
  misc_feature 1..390: note = derived and/or modified sequence opt5 from anti-HIV_Chain
  source 1..390: mol_type = other RNA
caggccgtggtcacccaagagcccagcctgacagtttcccctggcgggacggtgaccctcacatgcgcttctagcaccggagccgtgacatccggcttctacccgcactggtttcagcagaagcccgggcaggcgcctagagctctgatctattctaccagcaaccggtactcctggacacccgcccgcttctctggaagccttctgggcgggaaagccgctctcaccctgtccggagtccaacctgaagacgaggccgaatattactgtcttctgctcccctattacggcggcccttggatttttgggggaggcacgaagctgaccgtgctggggcagccgaaagctgcccccagcgttacactcttccctccctcttccgaggaactg

SEQ ID NO: 42645 - RNA, 390 nt, synthetic construct
  misc_feature 1..390: note = derived and/or modified sequence opt5 from anti-HIV_Chain
  source 1..390: mol_type = other RNA
cagagcgccctgacccaacccccttccgcttctggcgccccggggcagagagtgacaatcagctgctccggaggcccctctaacgtcgggggaaattacgtttattggtaccggcagttccctggcacggcgcccaccctcctgattcttcgcgacgatcagagacctagcggggtgcccgaccggttttccgcttctaagagcggaaactccgccagcctggccatctctggcctccgccctgatgacgagggcttctatttttgtgctacatacgattccgacgggagcattagactgttcggaggcgggaccgcccttacagtgctgtctcaaccgaaagctgccccctccgtcaccctctttcctcccagctctgaggaactgaag

SEQ ID NO: 42646 - RNA, 390 nt, synthetic construct
  misc_feature 1..390: note = derived and/or modified sequence opt5 from anti-HIV_Chain
  source 1..390: mol_type = other RNA
caggtgcaactggtcgagagcggctccgacgttagaaagcccggggccaccgtgacagtgtcttgcaaagctgatgaagacgaggatgacttcacggcctacaactattttatgcactgggtccggcaggcgcctggacatggcctcgaatggatcgggtggattaatccgcgcaccggacagcccaaccacgctaagcagttccaaggcagagtgacactgacccgggagcgcagcacatccaccgtttttatgaaacttacaaatctgagactcgatgacaccgccgtgtacttctgtgcccggcctctgcgcgggggagatacgtggcattatcactcttggggcagaggcaccagccttacagtctcctctgctagcaccaagggg

SEQ ID NO: 42647 - RNA, 390 nt, synthetic construct
  misc_feature 1..390: note = derived and/or modified sequence opt5 from anti-HIV_Chain
  source 1..390: mol_type = other RNA
gaggtgcagctggtcgaaagcggctccgacgttagaaagcccggggccaccgtgacagtgtcttgcaaagctgatgaggacgaagatgacttcacggcctacaactattttatgcactgggtccggcaagcgcctggacatggcctcgagtggatcgggtggattaatccgcgcaccggacagcccaaccacgctaagcagttccagggcagagtgacactgacccgggaacgcagcacatccaccgtttttatgaaacttacaaatctgagactcgatgacaccgccgtgtacttctgtgcccggcctctgcgcgggggagatacgtggcattatcactcttggggcagaggcaccagccttacagtctcctctgctagcaccaagggg

SEQ ID NO: 42648 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggctccgacgttagaaagcccggggccaccgtgacagtgtcttgcaaagctgatgaagacgaggatgacttcacggcctacgattattttatgcactgggtccggcaggcgcctggacatggcctcgaatggatcgggtggattaacccgcgcaccggacagcccaatcacgctaagcagttccaaggcagagtgacactgacccgggagcgcagcacatccaccgtttttatgaaacttacaaacctgagactcgacgataccgccgtgtacttctgtgcccggcctctgcgcgggggagacacgtggcattatcactcttggggcagaggcaccagccttacagtctcctctgctagcaccaagggg

SEQ ID NO: 42649 - RNA, 390 nt, synthetic construct
  misc_feature 1..390: note = derived and/or modified sequence opt5 from anti-HIV_Chain
  source 1..390: mol_type = other RNA
caggtgcaactggtccagagcggctccgacgttagaaagcccggggccaccgtgacagtgtcttgcaaagctgatgaggacgaagatgacttcacggcctacaactattttatgcactgggtccggcaggcgcctggacatggcctcgagtggatcgggtggattaatccgcgcaccggacagcccaaccacgctaagcaattccagggcagagtgacactgacccgggaacgcagcacatccaccgtttttatgaaacttacaaatctgagactcgatgacaccgccgtgtacttctgtgcccggcctctgcgcgggggagatacgtggcattatcactcttggggcagaggcaccagccttacagtctcctctgctagcaccaagggg

SEQ ID NO: 42650 - RNA, 390 nt, synthetic construct
  misc_feature 1..390: note = derived and/or modified sequence opt5 from anti-HIV_Chain
  source 1..390: mol_type = other RNA
caggtgcaactggtccagagcggctccgacgttagaaagcccggggccaccgtgacagtgtcttgcaaagctgatgaggacgaagatgacttcacggcctacaactattttatgcactgggtccggcaggcgcctggacatggcctcgagtggatcgggtggattaatccgcgcaccggacagcccaaccacgctaagcaattccagggcagagtgacactgacccgggaacgcagcacatccaccgtttttatgaaacttacaaatctgagactcgatgacaccgccgtgtacttctgtgcccggcctctgcgcgggggagatacgtggcattatcactctagaggccggggcaccagccttacagtctcctctgctagcaccaagggg

SEQ ID NO: 42651 - RNA, 390 nt, synthetic construct
  misc_feature 1..390: note = derived and/or modified sequence opt5 from anti-HIV_Chain
  source 1..390: mol_type = other RNA
gaggtgcagctggtcgaaagcggctccgacgttagaaagcccggggccaccgtgacagtgtcttgcaaagctgatgaggacgaagatgacttcacggcctacaactattttatgcactgggtccggcaagcgcctggacagggcctcgagtggatcgggtggattaatccgcgcaccggacagcccaaccatgctaagcagttccaaggcagagtgacactgacccgggaacgcagcacatccaccgtttttatgaaacttacaaatctgagactcgatgacaccgccgtgtacttctgtgcccggcctctgcgcgggggagatacgtggcactatcattcttggggcagaggcaccagccttacagtctcctctgctagcaccaagggg

SEQ ID NO: 42652 - RNA, 390 nt, synthetic construct
  misc_feature 1..390: note = derived and/or modified sequence opt5 from anti-HIV_Chain
  source 1..390: mol_type = other RNA
gtggtccagctggttcaaagcggctccgacgtgagaaagcccggggccaccgtgacagtctcttgcaaagctgatgaggacgaagatgacttcacggcctacaactattttatgcactgggtgcggcaggcgcctggacatggcctcgagtggatcgggtggattaatccgcgcaccggacagcccaaccacgctaagcagttccaaggcagagttacactgacccgggaacgcagcacatccaccgtgtttatgaaacttacaaatctgagactcgatgacaccgccgtctacttctgtgcccggcctctgcgcgggggagatacgtggcattatcactcttggggcagaggcaccagccttacagtgtcctctgctagcaccaagggg

SEQ ID NO: 42653 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggctccgacgttagaaagcccggggccaccgtgacagtgtcttgcaaagctgatgaagacgaggatgacttcacggcctacaactattttatgcactgggtccggcaggcgcctggacatggcctcgaatggatcgggtggattaatccgcgcaccggacagcccaaccacgctaagcagttccaaggcagagtgacactgacccgggagcgcagcacatccaccgtttttatgaaacttacaaatctgagactcgatgacaccgccgtgtacttctgtgcccggcctctgcgcgggggagatacgtggcattatcactcttggggcagaggcaccagccttacagtctcctctgctagcaccaagggg

SEQ ID NO: 42654 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggctccgacgttaagaaacccgggaccacagtgacgatctcttgcaaggccgatgaagacgaggatgacttcaccgcttacaactattttatgcactgggtgagacaggcccctggacagggcctcgaatggattgggtggatcaatccgcggacaggacagcccaaccatgcgaaacaactgcagggccgcgtcacccttacaagagagcggagcacctccacagtgttcatgaagctgaccaatctccgcctggatgacacggctgtttacttttgtgccagacctcttcgcgggggagatacctggcactatcattcttggggccggggcacaagcctgattgtgtcctctgccagcaccaaaggg

SEQ ID NO: 42655 - RNA, 390 nt, synthetic construct
  misc_feature 1..390: note = derived and/or modified sequence opt5 from anti-HIV_Chain
  source 1..390: mol_type = other RNA
caggtgcaactggtcgagagcggcgggggactcgttaagcccggcgggtccctgagactttcttgcgccgctagcggattctcctttaacgaatactatatgtcttggatccggcaggcccctggccaggggctggagtgggtggcgaatattggaagctccgacgcttacaccatctatgccgattctgtgaaaggccgcttcacaattagcagagacaacgccgaaaatacggtctacctccagatgaactccctgcggggcgaggataccgctgtgtattactgtgcccgcatcgaagggtattgcagcaattctagatgttccaactactttgacccgtggggacaaggcgctcttgttacagtgagctctgcctccaccaagggg

SEQ ID NO: 42656 - RNA, 390 nt, synthetic construct
  misc_feature 1..390: note = derived and/or modified sequence opt5 from anti-HIV_Chain
  source 1..390: mol_type = other RNA
caggtgcaactggtccagagcggcgccgaggttaagaaacccggggcttccgtgaaggtgtcttgcaaagtcagcggataccctctcgccgaactgtccgtgcactgggttagacaggtgccgggcaaggggcttgagtgggtcggaggcttcgaccccgaagaggggaaaaccgtgtatgcgcagaagtttcaaggacgggttacaatgacggaagatcgctctaccgacacagtgtacatggagctgatcagcctcagatatgaggataccgctgtctactattgtgccacagacaaccctgtgctgcagcttggcgaactgtcctctagcctcgattactggggccaggggaccctggtgacagtctccagcgcctctaccaaggga

SEQ ID NO: 42657 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggcgccgaagttaagaaacccggggagtccctcagaatctcttgcaagaccagcggatacaacttcaatgacgattggattgcttgggtgcggcagcgccctgacaaaggcccggaatggatggggatcttttatcccggagattcccaggccacatactctcctagcttccagggccacgtgacgttttccgcggacacctctattagcacagcttatctgcaatggacctcccttaaggccagcgatacagccatctactattgtgctagaacccggtgcttcggggccaactgttttaatttcatggacgtctggggaaaaggcacagctctgaccgtgacggtttcttccgccagcaccaagggc

SEQ ID NO: 42658 - RNA, 390 nt, synthetic construct
  misc_feature 1..390: note = derived and/or modified sequence opt5 from anti-HIV_Chain
  source 1..390: mol_type = other RNA
caggtgcaactggtccagctcctgcagagcggcgccgaggttaagaaacccgggtcctctgtgaaggtgagctgccagatctccggatacggcttctctaactatgctattagctgggtcagacaagcccctgggcagggacttgaatggctgggccggatcgtgccggcggttgggatgaccgagtacgctcagaaatttcagggacgcgtgacattcacggccgacagatccaccattacagcctatatggatctccggggcctgcgctctgacgataccgctgtctactattgtgtgagagacccccaagttgaagtgcggggcaatgcctttgatatctgggggcagggaacaatggtcaccgtgagctccgctagcacaaagggc

SEQ ID NO: 42659 - RNA, 390 nt, synthetic construct
  misc_feature 1..390: note = derived and/or modified sequence opt5 from anti-HIV_Chain
  source 1..390: mol_type = other RNA
caggtgcatctgcaacagtggggcgccgggctcctgaagcccagcgagaccctttccctgacatgcgctgtctctggaggcagcttctccgggtttttctggacgtggatcagacagtctcctggaaaaggcctcgaatggattggggaggttaaccacagcggatttacccactccaatccgtctctggaaagccgggccacaatctccgtggcggctagcaacacccagttctctcttcgcctggcctccgtgacagccgctgacaccgccatttacttttgtgctctcagatatttcgattggagcccctttcggcgcgacacatacggcaccgatgtctggggccaagggacgaccgtgatcgtttcttccgccagcacaaaggga

SEQ ID NO: 42660 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcggggccctccggaagcccggagcttccgtcaccctgtcttgccaggccagcggctacaacttcgttaaatatatcattcactgggtgcgccagagacctgggcttggatttgaatgggtgggcatgatcgacccgtaccgggggcgcccctggtatgcgcattccttcgctggaagactgtctctcagccgggatacatccacggagaccctgtacatgacactttctagcctgaagtccgacgataccgccacatatttttgtgcccgcgctgaagccgctagcgactctcactccagacctattatggattggacctggcggatcctctgcctgctggccgtcgtgcccgcgagcacaaaaggc

SEQ ID NO: 42661 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctgtccggaagcccggggcctccgttaccctctcttgccaggcgagcggatacaacttcgtgaattatatcattcactgggtgcgccagagacctggcctggactttgaatgggtcgggatgatcgatccgtaccggggacgcccctggtccgctcataaattccagggcagactttctctgagccgggacgtgtccacagagattctctatatgacgctgaactctcttcgcagcgatgacaccgccacatacttttgtgccagagctgaagccgagtcccaaagccactctcggcctatcatgttcgattcctgggggcagggaagccgcgttaccgtgtcttccgctagcacaaagggc

SEQ ID NO: 42662 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctgtcaagaaacccggggcctccgttaccatctcttgccaggcgagcggatacaacttcgtgaagtttttcattcactgggtgcggcagcgccctggccaggggtttgaatgggtcggaatgatcgagccgtatagaggccggccctggtccgctgggaatttccaaggacgcctctctctgagcagagacgtgtccacagaaacgctttacatgaccctgaacaatctccggtctgatgacacagccgtttatttttgtgcccgcctggaggctgaaagcgattcccatagcagacctattatgttcgaccactggggccatggctctcttgtgaccgtctccagcgcctctacaaaaggg

SEQ ID NO: 42663 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctgtccggaagcccggggcctccgttaccctctcttgccaggcgagcggatacaacttcgtgaattatatcattcactgggtgcgccagagacctggcctggactttgaatgggtcgggatgatcgatccgtaccggggacgcccctggtccgctcataaattcgagggcagactttctctgagccgggacgtgtccacagaagttctctatatgacgctgtctagccttcgctccgatgacaccgccacatacttttgtgccagagctgaggccgaaagccagtctcactcccggcctattatgttcgattattgggggcaaggaagccgcgtgaccgtctcttccgctagcacaaagggc

SEQ ID NO: 42664 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcaccgccgtccggaagcccggggcttccgttacaatctcttgccaggccagcggatacaacttcgtgaaatttttcattcacggcgtgcgccagagacctgggcagggatttgaatgggtcggcatgatcgagccgttccgggggcgcccctggtccgcgggaaattttcaaggcagactctctctgagccgggacgtgtccacggaaaccctttatatgacactgaacaatctccgctctgatgacaccgctgtttacttctgtgccagactggaggccgaaagcgattcccatagccggcctattatgtttgaccactggggccatgggtctcttgtgacagtctccagcgcttctaccaaggga

SEQ ID NO: 42665 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcaccgccatgcggaagcccggggcttccgtcacactctcttgccaggccagcggatacaacttcgttaaatatatcgtgcactgggtgcgccagaagcctggcctggggtttgaatgggtcggaatgattgacccgtacagaggccggccctggtccgcgcataaattccaggggcgcctttctctgagcagagatacgtccatggagatcctctatatgaccctgacatctcttaagagcgacgataccgctacatacttttgtgcccgggccgaagctgcctccgacagccactctcgccctattatgttcgatcattggggacaaggctccagagtgaccgttagctctgcttccacaaaaggc

SEQ ID NO: 42666 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctatgcggaagcccggggcctccgtcaccctctcttgccaggcgagcggatacaacttcgttaaatatatcgtgcactgggtgcgccagaagcctggcctggggtttgaatgggtcggaatgattgacccgtacagaggccggccctggtccgctcataaattccaggggcgcctttctctgagcagagatacatccatggagatcctctatatgacgctgacctctcttaagagcgacgatacagccacctacttttgtgcccgggctgaagccgcttccgacagccactctcgccctattatgttcgatcattggggacaaggctccagagtgacagttagctctgcctccaccaaaggc

SEQ ID NO: 42667 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctatgcggaagcccggggcctccgtcaccctctcttgccaggcgagcggatacaacttcgttaaatatatcattcactgggtgcgccagaagcctggcctggggtttgaatgggtgggaatgatcgacccgtacagaggccggccctggtccgctcataaattccaggggcgcctttctctgagcagagatacatccatggagattctctatatgacgctgacctctcttaagagcgacgatacagccacctacttttgtgcccgggctgaagccgcttccgacagccactctcgccctatcatgttcgatcattggggacaaggctccagagtcacagtgagctctgcctccaccaaaggc

SEQ ID NO: 42668 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcaacgccgtccggaagcccggggcttccgttaccatctcttgccaggccagcggatacaatttcgtgaaatttttcattcactgggtgcgccagagacctggccaggggtttgaatgggtcggaatgatcgagccgttccggggccgcccctggtccgcggggaactttcaaggaagactctctctgagccgggacgtgtccacagaaacgctttatatgaccctgaataacctccgctctgatgacacagctgtttacttctgtgccagactggaggccgaaagcgattcccatagccggcctattatgtttgaccactggggccatggctctcttgtgaccgtctccagcgcttctacaaagggg

SEQ ID NO: 42669 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctgtccggaagcccggggcctccgttaccctctcttgccaggcgagcggatacaacttcgtgcgctatatcattcactgggtgagacagcggcctggcctggactttgaatgggtcgggatgatcgatccgtaccgcggaagaccctggtccgctcataaattcggcgggcggctttctctgacacgcgacgtgagcacggagattctctatatgaccctgacatcccttagatctgatgacaccgccacatacttttgtgcccgggctgaagccgagagccagtcccacagccgccctatcatgttcgattcttggggacaaggctccagagttaccgtgagctctgcttccacaaagggc

SEQ ID NO: 42670 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctgtccggaagcccggggcctccgttaccctctcttgccaggcgagcggatacaacttcgtgaattatatcattcactgggtgcgccagagacctggcctggactttgaatgggtcgggatgatcgatccgtaccggggacgcccctggtccgctcataaattccagggcagactttctctgagccgggacgtgtccacagagattctctatatgacgctgtctagccttcgctccgatgacaccgccacatacttttgtgccagagctgaagccgagagccaatctcactcccggcctatcatgttcgatttttgggggcagggaagccgcgttaccgtgtcttccgctagcacaaagggc

SEQ ID NO: 42671 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcaccgccgtccggaagcccggggcttccgttacaatctcttgccaggccagcggatacaacttcgtgaaatttttcattcactgggtgcgccagagacctggccaggggtttgaatgggtcggaatgatcgagccgttccggggccgcccctggtccgcggggaattttcaaggaagactctctctgagccgggacgtgtccacggaaaccctttatatgacactgaacaatctccgctctgatgacaccgctgtttacttctgtgccagactggaggccgaaagcgattcccatagccggcctattatgtttgaccactggggccatggctctcttgtgacagtctccagcgcttctaccaagggg

SEQ ID NO: 42672 - RNA, 390 nt, synthetic construct
  misc_feature 1..390: note = derived and/or modified sequence opt5 from anti-HIV_Chain
  source 1..390: mol_type = other RNA
caggtgagactggagcaaagcggcgccgctatgcggaagcccggggcctccgtcaccctctcttgccaggcgagcggatacaacttcgttaaatatatcgtgcactgggtgcgccagaagcctggcctggggtttgaatgggtcggaatgattgacccgtacagaggccggccctggtccgctcataaattccaggggcgcctttctctgagcagagatacatccatggagatcctctatatgacgctgacctctcttacaagcgacgataccgccacatacttttgtgcccgggctgaagccgcttccgacagccactctcgccctattatgttcgatcattggggacaaggctccagagtgaccgttagctctgcctccacaaagggc

SEQ ID NO: 42673 - RNA, 390 nt, synthetic construct
  misc_feature 1..390: note = derived and/or modified sequence opt5 from anti-HIV_Chain
  source 1..390: mol_type = other RNA
gaggtgcagctggtccaaagcggcgggggactcgttcagcccggcgggtccctgagactttcttgcgccgctagcggactgaccttccggaattttgccatgtcctgggtgcgccaggcgcctggcaaggggctcgaatgggtgtctagcatctccggatctggcggcagcacatactatgctgactccgtcaaagggagattcacgattagccgggataattctaagaacaccctgtaccttcagatgaactccctgcgcggagaggacacagccgtgtatttttgtgccaaaggcgttgggtacgatatcctcaccggactgggcgacgctttcgatatttgggggcaaggaacagtggtcgccgtgagctctgcttccaccaagggc

SEQ ID NO: 42674 - RNA, 393 nt, synthetic construct
  misc_feature 1..393: note = derived and/or modified sequence opt5 from anti-HIV_Chain
  source 1..393: mol_type = other RNA
caggtgcaactggtccagagcggcgccgctgttagaaagcccggggcctccgtgaccgtgtcttgcaaattcgcggaggacgatgactacagccctcactgggtcaacccggctcccgaacattatatccactttctccggcaggcccctggacagcaactggagtggcttgcctggatgaatcccacaaacggcgctgtgaattacgcctggcagctgcatgggcgcctcacggctaccagagatggatccatgacaaccgccttcctggaagttcggtctcttcgcagcgacgatacagcggtgtattactgtgccagagctcagaagcggggccgctccgagtgggcctatgctcactgggggcagggaacccctgtcctggtgtctagc

SEQ ID NO: 42675 - RNA, 393 nt, synthetic construct
  misc_feature 1..393: note = derived and/or modified sequence opt5 from anti-HIV_Chain
  source 1..393: mol_type = other RNA
caggtgcaactgcagcagtggggcgccgggctcctgaagcccagcgagaccctttccctgacatgcgctgtctacgccggatctttcagcggctattactggacgtggatcagacagcctccggggaaaggactcgaatggattggcgaggttaaccacgggggatccaccaattataacccctctcttaagagccgggtgacactgtccgtggacacctctaaaaatcaatttagcctgaagctcacatccgtcaccgcggctgatacagccgtgtactattgtgcccgcgttagcagatacgacttctggtctggcaactatggctcctacgggctggatgtgtggggacagggcaccacggtcaccgtgagctctgcttccacaaaaggg

SEQ ID NO: 42676 - RNA, 393 nt, synthetic construct
  misc_feature 1..393: note = derived and/or modified sequence opt5 from anti-HIV_Chain
  source 1..393: mol_type = other RNA
gaggtgcagctggtccaaagcggcgggggagttgtgcagcccggcagatccctccggctgtcttgcgtggtcagcgggttcaccttttcctctttcacatttcactgggtgcgccaggcccctggaaagggccttgaatgggttgctgggatgagcttccatgccacgtacatctattacgcggactccgtgaaaggaagatttaccatttctcgggatgacagccaggatacactgtatctcgagatggactccctgcgcagcgaagataccgctatctactattgtgccagagacccgggcattcacgattacggcgactatgcccccggggctttcgattactggggacaaggctctcctgtcacagtgtccagcgcctctaccaagggg

SEQ ID NO: 42677 - RNA, 393 nt, synthetic construct
  misc_feature 1..393: note = derived and/or modified sequence opt5 from anti-HIV_Chain
  source 1..393: mol_type = other RNA
caggtgcaactggtccagagcggcaccgaggttcagaagcccggggcctccgtgaaagtgtcttgcaagacaagcggatacacgttctccaaatattacatccactgggtcagacaggctcctggccaagggctcgaatgggtgggacggattaacaccgactctggcgggacagattatgccgagaagtttcagggacgcgttaccatgacaagagacaccagcatcacaaccgtgtacctggaaatgcggggccttacgtccgatgacaccgcggctttctattgtgcccgcggcccgccccatgccgggggatggacaatttactattacggcctggatgtctgggggcagggaacctctgtgatcgttagctccgctagcacaaaaggc

SEQ ID NO: 42678 - RNA, 393 nt, synthetic construct
  misc_feature 1..393: note = derived and/or modified sequence opt5 from anti-HIV_Chain
  source 1..393: mol_type = other RNA
agaaccgtggtcacacagccccctagcgtttccggcgccccggggcaacgggtgacgatctcttgcaccggaagctcctctaacattggcgctgggtacgacgtgcactggtatcagcagctgcccggaacagcccctaagctcctgatctacggcaatagcaaccgcccctccggggtccctgatagattctctggaagcaaatccggcaccagcgcgtctcttgctattacaggcctgcaggccgaggacgaagccgattattactgtcaatcctatgacagctctctctccgggagcggagtgtttggcaccgggacaaaggttaccgtgctgggacagcccaaagctaatcctacggtcacccttttcccgccctcttccgaggaactg

SEQ ID NO: 42679 - RNA, 393 nt, synthetic construct
  misc_feature 1..393: note = derived and/or modified sequence opt5 from anti-HIV_Chain
  source 1..393: mol_type = other RNA
caggtgcaactgcagcagtggggcagcgggctcctgaagccctccgagaccctttctctgacatgcgccgtctacggaggcagcttcagatcctattactggaactggatccggcagtctcctgggaaaggactcgaatggattggcgaggttagccactccgggtctacgaattataacccggctcttaagagccgcgtgaccatctccgtggacacaagcaaaaatcaattttctctgaaggtcaaatccgtgaccgccgcggatacagctctgtactattgtagcagaggacggggcaagcgctgctctggcgcctactgtttcgccgggtattttgactcctggggacagggcgggctcgttgtggtcagctctgcttccaccaaggga

SEQ ID NO: 42680 - RNA, 393 nt, synthetic construct
  misc_feature 1..393: note = derived and/or modified sequence opt5 from anti-HIV_Chain
  source 1..393: mol_type = other RNA
caggtgcacctggtccaaagcggcgccgaggttaagaaacccgggtcctctgtgagagtgagctgcgaggcttccggatggaccttcggctctgtcaacagcgccatcacatgggtgcggcaggcgcctgggcagggactcgaatggatgggccgcacgattccgtttctggggatctccaattacgctcagaagttccaaggaagagttaccattacagccgacaaatctaccaacatcgcctatgtggatgtcacaagccttacctcccaggacacagctgtgtactattgtgcccggctgattaccggcatgacggctccctggttttactatatggatgtttggggcaaggggaccacagtgaccgtcagctctgcctccacaaaagga

SEQ ID NO: 42681 - RNA, 393 nt, synthetic construct
  misc_feature 1..393: note = derived and/or modified sequence opt5 from anti-HIV_Chain
  source 1..393: mol_type = other RNA
caggtgcatctgcaagagagcggccccagactcgtccggtcctctgaaaccctgagccttacatgctccgttcctgggggatctatcgtgaacccgattacgaattactattggagctggatccgccagtcccccagaaagggcctgcagtggattggggacatctactataccggaacatctagccggaacccttccctcgatagccgcgtgtctatttccatggacgtcagcagaaaacagatctctctgaccctttactccgtgacagccgctgataccgccgttcactattgtgcgagccaatctctgtcctggtaccggcccagcggctatttcgagtcctgggggcagggaatcctcgtgacagtctctagcgcttccaccaagggc

SEQ ID NO: 42682 - RNA, 393 nt, synthetic construct
  misc_feature 1..393: note = derived and/or modified sequence opt5 from anti-HIV_LightChain
  source 1..393: mol_type = other RNA
atgaagctgcccgtgagactcctggtccttatgttctggatccctgccagctcctctgacattgttatgacccagagcccgctgtccctccccgtgacacctggcgagcccgcttctatcagctgccggtcctctcaacgcctgcttagctcctacgggcacacgtatctgcattggtacctccagaaacctggacagagcccccagctgctgatttatgaagtgtctaacagattttccggcgtccctgatcggttcagcgggtctggatccggcaccgactttacactcaagatcagccgcgtggaggccgaagatgttggggtgtactattgttctcaatccacccacgtcccgctgacattcggacagggcaccaaagtggagattaag

SEQ ID NO: 42683 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagccttccgaaaccctgtctgttacatgcagcgtgtccggagactctatgaacaattactattggacgtggatcagacagagcccgggcaaagggcttgagtggattggatacatctccgatcgggcctctgctacctataaccccagcctcaattcccgcgtggtcattagcagagacacatctaagaaccagctgtccctgaaacttaatagcgtgacccctgccgatacagcggtttactattgtgctaccgcccggcgcggccaaagaatctacggggtggtctctttcggagaatttttctattactactccatggacgtgtggggcaagggcacaaccgttacggtgagctct

SEQ ID NO: 42684 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagcctccggaaaccctgtcccttacatgctctgttagcggagcctccgtgaacgacgcttactggtcttggatcagacagagccccggcaaacggcctgagtgggtggggtatgtccaccattccggagatacgaattacaacccctctctgaagcgcagagtgaccttcagcctcgacacagccaaaaatgaagtttccctgaaacttgtggcgctgaccgctgccgatagcgccgtctatttttgtgctcgggccctccacggcaagcgcatttacgggatcgtggctctgggagagctgttcacatatttttacatggacgtttggggcaagggcaccacagtgaccgtctcttcc

SEQ ID NO: 42685 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagccttccgaaaccctgtctcttacatgcagcgtttccggagcctctatcagcgactcctactggtcttggattagacggagcccgggcaaagggctggagtggatcggatatgtgcacaagtccggcgatacgaactacagcccctctctcaaatcccgcgtgaatctgagccttgacacctctaagaaccaggtctccctgagcctcgtggctgccacagcggctgattctgggaaatattactgtgccagaaccctgcatggacggcgcatttatggcatcgttgccttcaatgaatggtttacatacttctatatggacgtgtggggcaacgggacccaggtcacagtgtccagc

SEQ ID NO: 42686 - RNA, 396 nt, synthetic construct
  misc_feature 1..396: note = derived and/or modified sequence opt5 from anti-HIV_Chain
  source 1..396: mol_type = other RNA
caggtgcatctgcaagagagcggccccgggctcgtcaagccttccgaaaccctgtctcttacatgcaacgttagcggaacgctggtgagagacaattactggtcctggatgcggcagccgctcggcaaacagcccgagtggatcgggtatgtgcacgattctggagacaccaactacaatcctagcctgaagtcccgcgtccacctttctctggataaaagcaacaatctcgtgtccctgagactgacagccgttaccgctgccgacagcgcgacatattactgtgctaccacaaagcatggccggcgcatttatgggatcgtggccttcaacgaatggtttacctacttctatatggatgtctggggaaaaggcacgaccgtgacagtttcttcc

SEQ ID NO: 42687 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagccttccgaaaccctgtctgttacatgcagcgtgtccggagactctatgaacaattactattggacgtggatcagacagagcccgggcaaagggcttgagtggattggatacatctccgatcgggaatctgccacctataaccccagccttaattcccgcgtggtcattagcagagacacatctaccaaccagctctccctgaagctgaatagcgtgacccctgctgatacagccgtttactattgtgcgacagctcggcgcggccaaagaatctacggggtggtctctttcggagagtttttctattactactccatggacgtgtggggccggggcaccacggttaccgtgagctct

SEQ ID NO: 42688 - RNA, 396 nt, synthetic construct
  misc_feature 1..396: note = derived and/or modified sequence opt5 from anti-HIV_Chain
  source 1..396: mol_type = other RNA
caggtgcaactggtcgagagcggccccgggctcgttaccccttccgaaacactgtctcttacgtgcaccgtgagcaacggatccgtgtctggcagattctggagctggatccggcagtccccggggcgcggactggagtggattggctacttttctgacacagatagaagcgaatattcccccagcctccggtctcgcctgaccctttccctggacgccagcagaaatcagctctctctgaagctgaaatccgtcacagctgccgatagcgcgacctactattgtgctcgggcccagcaagggaagcgcatctacggaattgtgtctttcggcgagtttttctattactattacatggacgcctggggcaaagggacagctgttaccgtgtccagc

SEQ ID NO: 42689 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagcctccggaaaccctgtcccttacatgctctgttagcggagcctccatcaacgacgcttactggtcttggattagacagagccccggcaaacggcctgagtgggtggggtatgtgcaccattccggagatacgaattacaacccctctctgaagcgcagagtcaccttcagcctcgacacagccaaaaatgaagtgtccctgaaacttgttgatctgaccgcggctgacagcgccgtgtatttttgtgcccgggctctccacggcaagcgcatctacgggattgtcgccctgggagagctgttcacatatttttacatggatgtgtggggcaagggcaccacagttaccgtgtcttcc

SEQ ID NO: 42690 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagcctccggaaaccctgtcccttacatgctctgttagcggagcctccatcaacgacgcttactggtcttggattagacagagccccggcaaacggcctgagtgggtggggtatgtgcaccattccggagatacgaattacaacccctctctgaagcgcagagtcagcttctccctcgacaccgccaaaaatgaagtgagcctgaaacttgttgatctgacagcggctgactctgccatctatttttgtgcccgggctctccacggcaagcgcatttacgggatcgtggccctgggagagctgttcacctatttttacatggatgtctggggcaagggcacaaccgtgacagtttccagc

SEQ ID NO: 42691 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagccttccgaaaccctgtctgttacatgcagcgtgtccggagactctatgaacaatagctactggacgtggatcagacagtccccgggcaaagggcttgagtggattggatatatctctaagagcgaatccgccaactacaatcccagcctgaactctcgggtggtcatttcccgcgataccagcaaaaatcagctctctctgaaacttaactccgtgacccctgctgacacagccgtttattactgtgcgacagctagacacggccaacggatctatggggtggtcagcttcggagagtttttcacctactattctatggatgtgtggggcaagggcacaaccgttacggtgtccagc

SEQ ID NO: 42692 - RNA, 396 nt, synthetic construct
  misc_feature 1..396: note = derived and/or modified sequence opt5 from anti-HIV_Chain
  source 1..396: mol_type = other RNA
caggtgcaactgcaggagagcggccccgggctcgtcaagccttccgaaaccctgtctcttacatgcagcgtttccaacggatctgtgagcggcagattctggtcctggatccggcagtctccggggcgcggactggagtggattggctactttagcgacacggaaaaatccaattataaccccagcctcagatctcggctgaccctttccgtggatgccagcaagaatcagctgtctctcaaactgaactccgtcacagctgccgacagcgcgacctactattgtgctcgcacacaacaggggaagagaatctacggagtggtttctttcggcgagtttttccactattactatatggatgcctggggcaaagggaccgccgtgacagtctccagc

SEQ ID NO: 42693 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcaccgccctcaagtcccccgggtctagcgctaaactgtcctgcacagttcttggagacgagttcggcacgtactttatctcttggattagacaggcccctgggcagggactggaatgggtgggcgggatcgtgccgcacagccaactccagtcctctgcgcagaagttccatggacggattatcattagcgctggcgccggcgtcacaccccctgtggtttccctgcagcttaccaacctgacctttgaggatacagggacctatttctgtgcccgcgaaagaggacggcaccgcgaccccaaaacaggcgatgctctcagagggcggtactttgacttctggggacgcggcaccggggtgagcgtctctgcc

SEQ ID NO: 42694 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcaccgccctcaagtcccccgggtctagcgctaaactgtcctgcacagttcttggagacgagttcggcacgtactttatctcttggattagacaggcccctgggcagggactggaatgggtgggcgggatcgtgccgcacagccaactccagtcctctgcgcagaagttccatggacggattatcattagcgctggcgccggcgtcacaccccctgtggtttccctgcagcttaccaacctgacctttgaggatacagggacctatttctgtgcccgcgaaagaggacggcaccgcgaccccaaaacaggcaaggctcctagagggcggtactttgatttctggggacgcggcaccggggtgacggtcagcgcc

SEQ ID NO: 42695 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcaccgccctcaagtcccccgggtctagcgctaaactgtcctgcacagttcttggagacgagttcggcacgtactttatctcttggattagacaggcccctgggcagggactggaatgggtgggcgggatcgtgccgcacagccaactccagtcctctgcgcagaagttccatggacggattaccatcagcgctggcgccggcgtcacaccccctgtggtttccctgcagcttaccaacctgacatttgaggataccgggacatatttctgtgcccgcgaaagaggacggcaccgcgaccccaaaaccggcgatgctctcagagggcggtactttgacttctggggacgcggcacgggggtgagagtcagcacc

SEQ ID NO: 42696 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgctgttaagtcccccgggtctagcgccaaactctcctgcaccgtgctgggagacgagttcggcacatactttatctcttggattagacaggcgcctgggcagggacttgaatgggtgggcgggatcgtcccgcacagccaactgcagtcctctgctcagcggttccatggacgcattacgatcagcgccggcgccggcgtgacaccccctgttgtgtccctccagctgaccaaccttacctttgatgacgctgggacatatttctgtgccagagagcggggacgccacagagatcccaagaccggcgacgctctgcgggggcgctactttgatttctggggaagaggcacagggattagcgtctctcct

SEQ ID NO: 42697 - RNA, 396 nt, synthetic construct
  misc_feature 1..396: note = derived and/or modified sequence opt5 from anti-HIV_Chain
  source 1..396: mol_type = other RNA
gaggtgcagctggtccaaagcggcgccgaagttaagaaacccggggcttccgtgaaggtgtcttgcaaagtcagcggatacaccctcacagagctgtccatccactgggtgagacaggcccctggcaaggggcttgaatggatgggaggcttcgacccggaggatgacgaagcgatttatgagcccaaatttcaggggcggctgacgatgaccgaggatacatctaccgacacagcttacatggaactcagctccctgcgctctgaggataccgccgtttattactgtgccacagctgaccctttcaaggtggcccaggatgaaggactttatgtcatctttgactactggggccaaggcaccctggtgacggttagctccgctagcaccaagggg

SEQ ID NO: 42698 - RNA, 396 nt, synthetic construct
  misc_feature 1..396: note = derived and/or modified sequence opt5 from anti-HIV_Chain
  source 1..396: mol_type = other RNA
gaggtgcagctggtcgaaagcggcgggggactcctgcaacccggcgggtcccttagactgtcttgcgccgctagcggattctcctttaacgacttcgagatgaattgggttcggcaggcccctggcaaggggctcgaatgggtgtcttacatcagcaacgatggaaccatgattcactatgcggactccgtgaaaggccgctttacaatctctagagataatgctaagaaaagcctgttccttcagatgaactccctgcgggccgaggacacggccgtctactattgtgctcgcctcgccgaagtgccgcccgctattagaggcagctactattacgggatggatgtttggggacagggcaccacagtgaccgtcgcctctgcgtccacaaagggg

SEQ ID NO: 42699 - RNA, 396 nt, synthetic construct
  misc_feature 1..396: note = derived and/or modified sequence opt5 from anti-HIV_Chain
  source 1..396: mol_type = other RNA
caggtgcaactgatgcagagcggcgccgaggtcaagagacccggggcttccgttaaagtgtcttgcaaggccttccggcacagcctcaacaatctgggaatctcctggattcgcagagcgcctggccgggggcttgaatggctgggatggatcaacgtgtacgagggcaataccaaatatgggcgcagatttcagggacgggtcacaatgacgaccgaccgctctacaaacaccgtgagcatggaactcagatccctgacatctgatgacaccgctgtttactattgtgcccgggataatcatttctggagcggctccagccgctactattactttggcatggacgtgtgggggcagggaacaaccgtcattgtgtcttccgccagcacgaagggc

SEQ ID NO: 42700 - RNA, 396 nt, synthetic construct
  misc_feature 1..396: note = derived and/or modified sequence opt5 from anti-HIV_Chain
  source 1..396: mol_type = other RNA
caggtgcaactggtccagtggggcgccgggctcctgaagccccttgagaccctgagcctcacatgcgctgtttacggaggctccttcaacgggtatttttggtcttggatcagacagacgcctggaaaaggcctggaatggattggggagatcaatcacggaggcagcgccaacttcaatccgtcccttaagtctcgggtgaccatgagcgtggacacatccaaaaaccagttttctctgaagctcgcgagcgtcaccgctgccgatacagccatttactattgtgctcgcggcagaatcaccatggtgcgcggggacccccaacggggaggcgttagaatggatgtgtgggggcagggaacatccgtcaccgtgagctctgcctccacgaaaggc

SEQ ID NO: 42701 - RNA, 396 nt, synthetic construct
  misc_feature 1..396: note = derived and/or modified sequence opt5 from anti-HIV_Chain
  source 1..396: mol_type = other RNA
ctggtgcagctcgtccaaagcggcgccgaggttaagaaacccggggcttccgtgaaggtgtcttgcaaagtcagcggacacaccctgtccgaactttctatcaactgggtgagacatgttcctggcaaggggctggagtggatgggaggcctcgacccggaagatggggaggccattcacgaacccaaattccagggacggctgacaatgacggaggacaccagcacagataccgcgtactccacactttctgtgtgggctcctgtcgccgccgctatgtattactgtgccaccgctgacccctttaaggtggcccaggatgagggcctgtatgttatcttcgactactggggccaggggacactcgtgaccgtcagctccgcgagcacgaaggga

SEQ ID NO: 42702 - RNA, 396 nt, synthetic construct
  misc_feature 1..396: note = derived and/or modified sequence opt5 from anti-HIV_Chain
  source 1..396: mol_type = other RNA
caggtgcaactgctccagagcggcggggaggtcaagaaacccggagcctccgttaaggtgtcttgcaaagtgagcggctacaccctgacagaactttccatccactgggtcagacaggctcctgggaagggactggagtggatgggcgggttcgacccggaagatgacgaggccatttatgaacccaaatttcagggacggctcacgatgaccgaggatacatctaccgacacagcgtacatggagctgagctcccttcgctctgaagataccgctgtgtattactgtgccacagccgaccctttcaaggttgctcaagatgagggcctgtatgtgatctttgactactggggccaggggaccctcgtcacggtgagctccgccagcaccaaggga

SEQ ID NO: 42703 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgaggttaagaaacccggggcttccgtgaaggtgtcttgcaaagtcagcggatacaccctcacagaactgtccatccactgggtgagacaggcccctggcaaggggcttgagtggatgggaggcttcgactctgaagatggggaggcgttttataaacagaacttccaaggacgggttacgatgaccgaagacacaagcaccgatacagcttacatggagctgcgcagactccggtccgaggacaccgccgtgtattactgtgccacagctgatcgctttaaggtcgcccaggacgaaggcctgttcgtgatttttgattattggggccaggggacccttgttacggtgtctagcgcttccaccaaggga

SEQ ID NO: 42704 - RNA, 396 nt, synthetic construct
  misc_feature 1..396: note = derived and/or modified sequence opt5 from anti-HIV_Chain
  source 1..396: mol_type = other RNA
caggtgcacctggtccaaagcggcgccgaggttaagaaacccggggcttccgtgagagtgtcttgcaaggccagcggatacaccttcacaacgtatggcatctcctgggtccggcaggcgcctgggcagggactcgaatggatgggctggatttctgctcatagcggggacaccaactacgcccagaaactgcaagcccgcgtgacaatgaccacagatacctccacaaataccgcttatatggagcttagatctctgacgagcgacgataccgccgtttactattgtgctcgggaccgcccgagacactactatgatcggggaggctactactccccctttgactattggggccaggggacactcgtgaccgtcagctctgcctccacaaaggga

SEQ ID NO: 42705 - RNA, 396 nt, synthetic construct
  misc_feature 1..396: note = derived and/or modified sequence opt5 from anti-HIV_Chain
  source 1..396: mol_type = other RNA
ctggtgcagctcctgcaaagcggcgccgaggtcaagaaacccggggcttccgttaaggtgtcttgcaaagtgagcggatacacccttacagaactgtccatccactgggtcagacaggcccctggcaaggggctcgagtggatgggaggcttcgacccggaagatgacgaggcgatttatgaacccaaatttcaggggcggctgacgatgaccgaggatacatctaccgacacagcttacatggagcttagctccctgcgctctgaagataccgccgtgtattactgtgccacagctgaccctttcaaggttgcccaggatgagggactctatgtgatctttgactactggggccaaggcaccctggtcacggtgagctccgctagcaccaagggg

SEQ ID NO: 42706 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgaggttaagaaacccggggcttccgtgaaggtgtcttgcaaagtcagcggacacaccctctccgaactgtctatcaactgggtgagacatgttcctggcaaggggcttgagtggatgggaggcctggacccggaagatggggaggccattcacgaacccaaattccagggacggctcacaatgacggaggacaccagcacagataccgcgtacgtggagctgtcctctcttcgcagcgaagacacagctatgtattactgtgccaccgccgatccttttaaggtcgctcaggacgagggcctgtatgtgatcttcgattactggggccaagggacactcgttaccgtgtccagcgcctctacgaaggga

SEQ ID NO: 42707 - RNA, 396 nt, synthetic construct
  misc_feature 1..396: note = derived and/or modified sequence opt5 from anti-HIV_Chain
  source 1..396: mol_type = other RNA
caggtgcaactgctccagagcggcgccgaggtcaagaaacccggggcttccgttaaggtgtcttgcaaagtgagcggatacaccctgacagaactttccatcaactgggtcagacaggcccctggcaaggggctggagtggatgggaggcttcgacccggaagatgacgaggcgatttatgaacccaaatttcaggggcggctcacgatgaccgaggatacatctaccgacacagcttacatggagctgagctcccttcgctctgaagataccgccgtgtattactgtgccacagctgaccctttcaaggttgcccaagatgagggactgtatgtgatctttgactactggggccagggcaccctcgtcacggtgagctccgctagcaccaagggg

SEQ ID NO: 42708 - RNA, 396 nt, synthetic construct
  misc_feature 1..396: note = derived and/or modified sequence opt5 from anti-HIV_Chain
  source 1..396: mol_type = other RNA
cagccccaactggtgcagagcggctccggggccgaggtcaagaaacctggagcttctgttagaatcagctgcgaagcctccgagtacaacgtgttcgaccactttatgcagtgggtgcggcaggcgccgggccaagggctcgaatggatgggatggattaatccccgcggcgggtatccttcttacagccccaccttccagggaagactgacatttacgcggcagccttcctgggatgactctaccatcacattccatatggagcttcgcggcctgggccacgatgacaccgctgtctattactgtgccagaccccatagccctgatgacgcctggtccctcgatgtgtgggggcggggaacactggttaccgtgagctctgcttccacaaagggc

SEQ ID NO: 42709 - RNA, 396 nt, synthetic construct
  misc_feature 1..396: note = derived and/or modified sequence opt5 from anti-HIV_Chain
  source 1..396: mol_type = other RNA
cagccccaactggtgcagagcggctccggggccgaggtcaagaaacctggagcttctgttagaatcagctgcgaagcctccgagtacaacgtgttcgaccactttatgcagtgggtgcggcaggcgccgggccaagggctcgaatggatgggatggattaatccccgcggcgggtatccttcttacagccccagattccagggacggctgacctttacacgccagccttcctgggatgactctagcgtcacgttccatatggagcttagaggcctgcggcacgatgacaccgctgtgtattactgtgcccgcccccattcccctgatgacgcctggagcctcgatgtttggggcagagggacactggtgaccgtctcttccgctagcacaaaggga

SEQ ID NO: 42710 - RNA, 396 nt, synthetic construct
  misc_feature 1..396: note = derived and/or modified sequence opt5 from anti-HIV_Chain
  source 1..396: mol_type = other RNA
gaggtgcagctggtcgaaagcggcgggggagttgtggagcccggcgaatccctcagactgtcttgcgccgctagcgggttcacctttcggtcctacgacatgttctgggtgcgccaagccacaggaaagtctcttgagtgggtcagcgcgatcggcattgctggggatacgtattactccggatctgtgaaaggcagatttaccatcagccgggaaaacgcccgcacatccctgtatctccagctgagcggccttagagttgaggactctgccgtgtacttctgtgtccgggggtcccctccgcgcattgctgccaccgagtataattactattacggactggatgtgtggggccaggggacaaccgttagcgtgttttctgcttccacaaaggga

SEQ ID NO: 42711 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgaggttaagaaacccgggtcctctgtgaaggtgagctgcaaggcttccggaggcaccttcacaacgtacgacatctcttgggtcagacaggcccctgggcagggactcgaatggatgggcgggattctgccggattttggagcgcccagctatgctcaaaaattccaggaccgggtgaccatcacaaccgatgagtcctctagcacagcctacatggaacttaactccctgcgcagcgaggacaccgccatttattactgtgctagaggccggggcgatgacttttggtctggggaatcccctagctggtatttcgattactggggacagggcacactcgttaccgtgtcttccgccagcacgaaaggg

SEQ ID NO: 42712 - RNA, 396 nt, synthetic construct
  misc_feature 1..396: note = derived and/or modified sequence opt5 from anti-HIV_Chain
  source 1..396: mol_type = other RNA
cagccccaactggtgcagagcggctccggggccgaggtcaagaaacctggagcttctgttagaatcagctgcgaagcctccgagtacaacgtgttcgaccactttatgcagtgggtgcggcaggcgccgatggaaggcctcgagtggatggggtggattaatccccgcggaggctatccttcttacagccccaccttccaagggagactgacatttacgcggcagccttcctgggatgactctaccatcacattccatatggaacttcgcggactgagacacgatgacaccgctgtctattactgtgcccggccccatagccctgatgacgcctggtccctcgatgtgtggggccgcggcacactggttaccgtgagctctgcttccacaaagggg

SEQ ID NO: 42713 - RNA, 396 nt, synthetic construct
  misc_feature 1..396: note = derived and/or modified sequence opt5 from anti-HIV_Chain
  source 1..396: mol_type = other RNA
gaggtgagactgctcgaaagcggcgggggactggtccagcccggcgggtcccttcggctgtcttgcagcgcctccggattcaccttttctaacagcgctctctcctgggttcgccaagcccctggcaaggggctggagtgggtgtctagcgtggtctccagcggaggcgacacattctacgcggattctgtgaaaggcagatttacgatctcccgggacaatagccgcaacaccctttatctgcagatgaagtctctcagagctgaagatacagccctgtactattgtgccaaagttcagattcagcaactgaatttcggggtgatcaccgacgctggaatggatgtctggggcaaggggacaaccgtgattgtttccagcgcctctacaaaagga

SEQ ID NO: 42714 - RNA, 396 nt, synthetic construct
  misc_feature 1..396: note = derived and/or modified sequence opt5 from anti-HIV_Chain
  source 1..396: mol_type = other RNA
caggtgcaactggtcgagagcggcgggggagttgtgcagcccggcagatccctccggctgtcttgcgtggggagcggattcaccttttcctctagcggcatgcactgggtccgccaggcccctgggaagggacttgaatgggtggctgttatctcctctgacggcagcgatgagtactatggcgactccgtggaagggagattcacaattagccgggataactctaaaaatacgctgtttctccagctggactcccttgaggccgaagatagcgcggtctactattgtgctaagaccccgccccattacgacgccctgacaggatatccttcttccgtgctcgagttctggggcctggggaccctggttacagtgagctctgcctccaccaaagga

SEQ ID NO: 42715 - RNA, 396 nt, synthetic construct
  misc_feature 1..396: note = derived and/or modified sequence opt5 from anti-HIV_Chain
  source 1..396: mol_type = other RNA
gaggtgcagctggtccaaagcggcgccgaagttaagaaacccgggtcctctgtgaaggtgagctgcaaggcttccggaggcaccttcacaacgtacgacatctcttgggtcagacaggcccctgggcagggactcgagtggattggcgggatcctgccggattttggagcgcccagctatgctcagaaattccaagaccgggtgaccattacaaccgatgaatcctctcgcacagcctacatggagcttaacagcctgagatccgaagacaccgccatctattactgtgctcggggccgcggcgatgacttttggagcggggagtctccttcctggtatttcgattactggggacagggcacacaggttaccgtgagctctgcctccacgaaaggg

SEQ ID NO: 42716 - RNA, 396 nt, synthetic construct
  misc_feature 1..396: note = derived and/or modified sequence opt5 from anti-HIV_Chain
  source 1..396: mol_type = other RNA
caggtgcaactgctccagagcggcaccgaggtcaagaaacccgggtcctctgttaaggtgagctgcagagcctccggatggacactgggcaactctcctaatagcgctatcgggtgggtgcggcaggccccgggacagggccttgaatggattgggcgcatcattcccatcctggacgtcacgaactacgcgcaaaaattccagggaagagtgaccatttccgctgataagtctacaaatatcgcctatatggagatcagctccctcggcagcgaagacaccgccttttactattgtgctcgggttattacaggcatgacctctccttggtacttctatatggatgtgtggggagaggggacaaccgtcatcgtgtccagcgcctctacgaaaggc

SEQ ID NO: 42717 - RNA, 396 nt, synthetic construct
  misc_feature 1..396: note = derived and/or modified sequence opt5 from anti-HIV_Chain
  source 1..396: mol_type = other RNA
caggtgcacctggtccaaagcggcgccgaggttaagaaacccgggtcctctgtgagagtgagctgcaaggcttccggatggaccttcggcgactctgtcaacagcgccatcacatgggtgcggcaggcgcctgggcagggactcgaatggatgggccgctttattccgatcctggggctttccaattacgctcagaaattccaagatagagttacgattaacgtggaccggtctaccaatacagcctatatggagctgagcggactccgctccgaagataccgccgtctactattgtgctagactgatcacaggcatgaacgccccctggttttactatatggacgtgtggggcaaggggaccacaattaccgttagctctgcttccacgaaagga

SEQ ID NO: 42718 - RNA, 396 nt, synthetic construct
  misc_feature 1..396: note = derived and/or modified sequence opt5 from anti-HIV_Chain
  source 1..396: mol_type = other RNA
caggtgcacctggtccaaagcggcgccgaggctaagagacccgggtcctctgttcgggtgagctgccgcgcctccggaggcgacttctctagctacaccctctcctgggtgagacaggcgcctgggcagggactggaacggatgggcggggtcgtgccgatgcttgatacagttcattatgctcagaaatttcaaggacgcctgacgctctctgtggacgagggcaccagcacagcctacatggaactgtccagccttagatctgaggataccgccatgtattactgtacacggggccgccagaccttcagagctatctggtccgggccccctgtcgtgtttgacatttggggacagggcacactggttagcgtgtcttccgccagcaccaagggg

SEQ ID NO: 42719 - RNA, 396 nt, synthetic construct
  misc_feature 1..396: note = derived and/or modified sequence opt5 from anti-HIV_Chain
  source 1..396: mol_type = other RNA
caggtgcacctggtccaaagcggcgccgaggctaagagacccgggtcctctgttcgggtgagctgccgcgcctccggaggcgacttctctagctacaccctctcctgggtgagacaggcgcctgggcagggaatcgaatggatgggcggggtcgtgccgatgctggatacagttcattatgctcagaaatttcaaggacggcttacgctgtctgtggacgagggcaccagcacagcctacatggaactctccagcctgcgctctgaggataccgccatgtattactgtacaagaggccggcagaccttccgcgctatttggtccgggccccctgccgtctttgacatctggggacagggcacacttgtgattgttagctctgcttccaccaagggg

SEQ ID NO: 42720 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgagctcaagaaacccgggtcctctgttaaggtgagctgcaaggcttccggaggcaccttcaacaatcacacatttaactgggtgagacaggcccctgggcagggactggaatggatgggccggacgatcccgattcttgggtctcgcgactacgcgaaaaccttccaagatagagtcacaatcattgctgacaaaagcacctccacagtgtatctggagctccggcgcctgaagtctgaagataccggagtttactattgtgccacaagcatgtactattttgactccggcggctactatagaaataccgatcttgacaagtgggggcagggaagcctggtgacggtctcttccgccagcaccaaaggc

SEQ ID NO: 42721 - RNA, 396 nt, synthetic construct
  misc_feature 1..396: note = derived and/or modified sequence opt5 from anti-HIV_Chain
  source 1..396: mol_type = other RNA
caggtgtacctggtccaaagcggccccgagctcaagaaacctggggcctccgttaagatctcttgcaaagctagcggatataacttcccgaagtacgccattcactgggtgagacaggcgcccggccaggggctgcagtggatgggatggatcaatggcgacaacggggatgctcggtattcccaaaaacttcagggacgcgtgaccccttctacagacacgagcgcctccgtcgtgtacatggaactgaagagactccggtctgaggataccgccgtttattactgtgctcgcgccctgtatccctgggaaattggcggcgtgcctagcacaatgggggacgattactggggacagggcacccttatcacagtctccagcgcttctaccaagggg

SEQ ID NO: 42722 - RNA, 396 nt, synthetic construct
  misc_feature 1..396: note = derived and/or modified sequence opt5 from anti-HIV_Chain
  source 1..396: mol_type = other RNA
caggtgcaactggtccagagcggccccgagctcatgaagcctgggtcctctgttaaagtgagctgcagagcctccggagacaacttcctgacctctacatttaattggcttcggcaggctccgggccagcgcctggaatggatggggagattcatccccagcctcggactgattacgtccgcccctaagttttctgatcggcttaccatcacagcggaccaagctaccctgacagcctacatggagctcaccggcctgacaagcgaagataccgccctgtattactgtgctcgcgggctctgcagaggaggcaactgtcggctgggcccctccgggtggcttgacccttggggacgcggcacccaggtgacggtcagctctgcctccacaaaaggg

SEQ ID NO: 42723 - RNA, 396 nt, synthetic construct
  misc_feature 1..396: note = derived and/or modified sequence opt5 from anti-HIV_Chain
  source 1..396: mol_type = other RNA
ggcgtgcacttccaggggcatctggtccaaagcggaggcggggttaagaaacccggatcctctgtgaccatcagctgcctcgcctccgagtacacatttacggagttcaccattcactggatcagacaggctcctggccaggggccgctgtggcttggactgattaagcggtctggccgcctcatgacaagctatagatttcaggaccggctgtcccttcgcagagatcggtctaccggcacagtgttcatggaactgcgcgggctcagaatcgacgataccgccgtctactattgtgcgcgggacggactgggcgaagtggctcccgcctacctgtatgggattgatgtttggggacaaggcagcacagtgatcgtcacctccgccagcacgtct

SEQ ID NO: 42724 - RNA, 396 nt, synthetic construct
  misc_feature 1..396: note = derived and/or modified sequence opt5 from anti-HIV_Chain
  source 1..396: mol_type = other RNA
caggtgcaactgctccagagcggcgccgaggtcaagaaacccggggcttccgttaaggtgtcttgcaaagtgagcggatacaccctgacagaactttccatccactgggtcagacaggcccctggcaaggggctggagtggatgggaggcttcgacccggaagatgacgaggcgatttatgaacccaaatttcaggggcggctcacgatgaccgaggatacatctaccgacacagcttacatggagctgagctcccttcgctctgaagataccgccgtgtattactgtgccacagctgaccctttcaaggttgcccaagatgagggactgtatgtgatctttgactactggggccagggcaccctcgtcacggtgagctccgctagcaccaagggg

SEQ ID NO: 42725 - RNA, 396 nt, synthetic construct
  misc_feature 1..396: note = derived and/or modified sequence opt5 from anti-HIV_Chain
  source 1..396: mol_type = other RNA
caggtgcaactggtccagagcggcgccgaggttaagaaacccggggcttccgtgaaggtgtcttgcaaagtcagcggatacaccctcacagaactgtccatccactgggtgagacaggcccctggcaaggggcttgagtggatgggaggcttcgacccggaagatggggaggcgtcttttgaacccaaattccagggacggctgacgatgaccgaggacacaagcaccgatacagcttatatggagctctcctctctgcgcagcgaagacaccgccgtttactattgtgccacagctgatccttttaaggtggcccaagacgagggcctttacgtcattttcgattattggggccaggggaccctggtgacggtttccagcgcttctaccaaggga

SEQ ID NO: 42726 - RNA, 396 nt, synthetic construct
  misc_feature 1..396: note = derived and/or modified sequence opt5 from anti-HIV_Chain
  source 1..396: mol_type = other RNA
ggcgtgcacttccaggggcatctggtccaaagcggaggcggggttaagaaacccggatcctctgtgaccatcagctgcctcgcctccgagtacacatttacggagttcaccattcactggatcagacaggctcctggccaggggccgctgtggcttggactgattaagcggtctggccgcctcatgacaagctatagatttcaggaccggctgtcccttcgcagagatcggtctaccggcacagtgttcatggaactgcgcgggctcagaatcgacgataccgccgtctactattgtgcgcgggacggactgggcgaagtggctcccgcctacctgtatgggattgatgtttggggacaaggcacaaccgtgatcgtcacgagcgcctccaccagc

SEQ ID NO: 42727 - RNA, 396 nt, synthetic construct
  misc_feature 1..396: note = derived and/or modified sequence opt5 from anti-HIV_Chain
  source 1..396: mol_type = other RNA
caggtgcaactgggcgagagcgggggaggcctcgtcgaacccgggggatccctgagactttcttgcgccgctagcggcttcctgttttccgactaccagatgtcttggatccggctcgcccctgggaagggactggagtggattagcttcatctccggctttggctctgtttattacgcggatagcgtggaagggcgcttcaccatttccagagacaacgctcggaatagcctttatctgcagatgaacaatctccgcgccgaggatacagccgtgtactattgtgctagagcctacggaacgggcaactggcgggggctgtattactactattacggaatggacgtctggggccacgggaccacagtgaccgtttcttccgctagcacaaaagga

SEQ ID NO: 42728 - RNA, 399 nt, synthetic construct
  misc_feature 1..399: note = derived and/or modified sequence opt5 from anti-HIV_Chain
  source 1..399: mol_type = other RNA
caggtgcaactggtccagagcggcaccgccctcaagtcccccgggtctagcgctaaactgtcctgcacagttcttggagacgagttcggcacgtactttatctcttggattagacaggcccctgggcagggactggaatgggtgggcgggatcgtgccgcacagccaactccagtcctctgcgcagaagttccatggacggattatcattagcgctggcgccggcgtcacaccccctgtggtttccctgcagcttaccaacctgacctttgaggatacagggacctatttctgtgcccgcgaaagaggacggcaccgcgaccccaaaacaggcgatgctctcagagggcggtactttgacttctggggacgcggcaccgggctgagagtgagcacgtct

SEQ ID NO: 42729 - RNA, 399 nt, synthetic construct
  misc_feature 1..399: note = derived and/or modified sequence opt5 from anti-HIV_Chain
  source 1..399: mol_type = other RNA
gaggtgcagctggtccaaagcggcgggggactcgttaagcccggcgggtccctgagactttcttgcgccgctagcggattcacctttaaaaacgcctggatgtcctgggtgcggcaggcgcctggcaaggggctggaatgggtgggacacatcaaatctaagacagacggcggcacgattgattacgctgccccggtcaaagggcgcttcaccatcagcagagacgattccaagaatacactctatctgcagatgaactctcttaagattgaggacaccgccgtgtactattgtacaaccgatatcggaagcggccgggggtgggactttcattactatgattccaatgactggggacagggcacactggttaccgtgagctctgcttccacgaaaggg

SEQ ID NO: 42730 - RNA, 399 nt, synthetic construct
  misc_feature 1..399: note = derived and/or modified sequence opt5 from anti-HIV_Chain
  source 1..399: mol_type = other RNA
caggtgcaactggtcgagagcggcgggggagttgtgcagcccggcagatccctccggctgttctgcgccgcttctgggtttgccttcaatacctacggaatgcactgggtgcgccaggcgcctggcaaggggcttgaatgggtcgctgtgacatggcatgacggaagccagaaatattacgccgattccgttaagggcagatttacgatctctcgggacaatagcaaaaacaccctgtatctccaaatgaactccctgcgcgccgaggatacagctatttactattgtgcctctgaccagggcgggttcgatgacagctccggatactttgctccgggcgggatggatgtgtggggaagaggcaccacagtcatcgtgagctctgcccccaccaagggg

SEQ ID NO: 42731 - RNA, 399 nt, synthetic construct
  misc_feature 1..399: note = derived and/or modified sequence opt5 from anti-HIV_Chain
  source 1..399: mol_type = other RNA
ggctacagcgaggtgcagctggtccaatccgggcccggactcgttaagccttctcagaccctgagccttacatgcacggtgtccggcgggtctatcagcaacggaggccactattggaattggattagacagcatccggggaaaggactggaatggatcggccacatttacaacatcgccaccacatattacaatccctccctcaagtctcgggtgagcatttccgtcgacaccagcaaaaaccagttctctctgaaactttccagcgtgacagctgccgataccgcggtttattactgtgctcgcggctctgggagatggacaatcggagcccggatctattttgacaattggggccaaggggccctggtggctgtctccagcgcctctaccaaggga

SEQ ID NO: 42732 - RNA, 399 nt, synthetic construct
  misc_feature 1..399: note = derived and/or modified sequence opt5 from anti-HIV_Chain
  source 1..399: mol_type = other RNA
cagctgcaactcaaggagagcggccccgggatggtgaaaccttccgaaaccctgtctcttacatgcagcgtctccggagcctctgttgtgagcgctaacgactactggggctggatcagacaggccccggggaagggactggagtgtattggcatcattctctatacggggtccaccttctacaatccctctctgcagagccgggtgacaatctcccgcgatcctagcaaaaaccacgtctctcttaccctgacatccgtgaccgcggctgacagcgccgtttattactgcgcccggattccctatcattctgaatcctactataatgtggtcatcggaggctttgatgtgtggggccaggggacaagagttaccgtgagctctgcttccacgaaggga

SEQ ID NO: 42733 - RNA, 399 nt, synthetic construct
  misc_feature 1..399: note = derived and/or modified sequence opt5 from anti-HIV_Chain
  source 1..399: mol_type = other RNA
tgccaggtgcaactggtcgagagcggcgggggagttgtgcagcccggcagatccctccggctgtcttgtgtggggagcggattcaccttttcctctagcggcatgcactgggtccgccaggcccctgggaagggacttgaatgggtggctgttatctcctctgacggcagcgatgagtactatggcgactccgtggaagggagattcacaattagccgggataactctaaaaatacgctgtttctccagctggactcccttgaggccgaagatagcgcggtctactattgcgctaagaccccgccccattacgacgccctgacaggatatccttcttccgtgctcgagttctggggcctggggaccctggttacagtgagctctgcctccaccaaagga

SEQ ID NO: 42734 - RNA, 399 nt, synthetic construct
  misc_feature 1..399: note = derived and/or modified sequence opt5 from anti-HIV_Chain
  source 1..399: mol_type = other RNA
caggtgcaactggtccagagcggcgccgacgttaagaaacccggggcttccgtgaaggtgtcttgcaaagtcagcggatacaccgtgtccgagctctctatccactgggttagacaggcccctggcaaggggctggaatggatgggaggcttcgatccggaggacgggaaaacagtgagcgcgcagaactttcaaggacgggtcacgatgaccgaagataagtccacaggcaccgctaatatggagcttcgctctctgagaagcgaagacacagccgtgtattactgtgccaccacagttcagctcattgtggatttctgcaacggcgggccctgttataattttgacgattggggacagggcaccctggtcacggtgtccagcgcttctaccaagggg

SEQ ID NO: 42735 - RNA, 399 nt, synthetic construct
  misc_feature 1..399: note = derived and/or modified sequence opt5 from anti-HIV_Chain
  source 1..399: mol_type = other RNA
ggcctggacctcgagcacgatgggcatcacaaggaagaacccagagccagcgtgaccgtctcctgcgaggcttctggatacaacttcgttaattatatcattcattgggtgcggctgacacctggccgcgggtttgagtggatgggaatgatcgacccgagacggggccgcccctggagcgcccagaaattccaagggagacttacgctgacccgggatattgactccgaacgcctctacatgcagctgtctggacttagaggcgatgacacagcggtgtatttttgtgctcggcaggagcctgatttccacgacggccatgggcacaccctgcgcggaatgtttgatagctggggccaggggtcccccgtctctgtgagctccgccagcacaaaggga

SEQ ID NO: 42736 - RNA, 399 nt, synthetic construct
  misc_feature 1..399: note = derived and/or modified sequence opt5 from anti-HIV_Chain
  source 1..399: mol_type = other RNA
caggtgagactggtccaaagcggcgcccagctcaagaaacccggggcttccgttaccgtgtcttgcgaggccagcggatacaacttcgtgaattatatcattaactgggtccggcagacacctggccgctcctttgaatgggtggggatgatcgacccgagacggggacgcccctggtctgcgcagaagttccaaggcagactgacgcttacccgggatattgacagcgagaaactgtacatgcacctctccgggctgcgcggagatgacacagctgtttattactgtgccagacaggattctgactttcatgatggccacggccatacccttcgggggatgttcgacagctggggacagggctcccctgtgacagtcagctctgcctccaccaagggg

SEQ ID NO: 42737 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcgttaagaccggggcctctgtgacaatcagctgcgagacggaaggatacaccttcgtgaactatattatccactgggtccggcagccccctggccgcgggtttgagtggctcggaatgattgacccgagaaatggccatccctggttcgggcagcggtttcgcggaagactgtcccttcggcgcgatagatctacagaaaccgtgttcatgacactgagcggcctcacctccgacgataacggcatctacttttgtgcgcggaatgagcctcagtattacgacgggtctggacacagcctgcccggcatgttcgattattgggggcaaggaacacgcgttgtggtctccagcgcttctaccaaaggc

SEQ ID NO: 42738 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcatgaagaccggggcctctgttacaatcagctgcgagacggaaggatacaacttcgtgaattatattatccactgggtgcggagaccccctggccgcgggtttgagtggctcggaatgattgacccgaaaaacggccatccctggttcgcgcaggctgtccgggggcgcctgtcccttagacgggatacctttaatgaagtggtttacatgacactgtctggactcaccagcgacgatacaggcctgtatttctgtgcccgcaacgagcctcagtaccacgacggcaatgggcattcccttcccggaatgtttgatttctggggccaggggaccctggtgacagtctctagcgcctccaccaaggga

SEQ ID NO: 42739 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcgttaagaccggggcctctgtgacaatcagctgcgagacggaaggatacaccttcgtgaactatattatccactgggtccggcagccccctggccgcgggtttgagtggctcggaatgattgacccgagaaatggccatccctggttcgggcagcggctgcagggacgcctttccctgagacgggatcgctctacagaaaccgtgtttatgacactcagcggcctgacctccgacgatacaggcatctacttctgtgcgagaaacgagcctcaatattacgacgggtctggacacagccttcccggcatgtttgattattgggggcagggaacccgggttgtggtctccagcgcttctacgaaaggc

SEQ ID NO: 42740 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcgttaagaccggggcctctgtgacaatcagctgcgagacggaaggatacaccttcgtgaaccacattatccattgggtccggcagccccctggccgcgggtttgagtggctcggaatgattgacccgagaaatggccacccctggttcgggcagcggctgcgcggaagactttccctgcggcgcgatagatctacagaaaccgtgtttatgacactcagcggcctgacctccgacgatatcggcatttatttctgtgcgcggaacgagcctcagtactttgacgggtctggacatagccttcccggcatgttcgattattgggggcaaggaacacgcgttgtggtctccagcgcttctaccaaaggc

SEQ ID NO: 42741 - RNA, 399 nt, synthetic construct
  misc_feature 1..399: note = derived and/or modified sequence opt5 from anti-HIV_Chain
  source 1..399: mol_type = other RNA
caggtgcaattctttcagagcggctcctctatgaagaaaagcggggcctccgtcaccatctcttgcgaggctacaggatacaacattaagaatcacatcctgcattgggttagacagaaacccggccgggggttcgaatgggtgggaatgattgaccctatcaacggccgcccgtggtttgggcaggccttcagaggacggctcacgctgacccgcgatcttagcacagagaccttttatatgtccctgtctggcctcacaagcgacgataccgcgacatacttctgtgctagacgggaagccgactatcacgatggcaatgggcataccctgcccggaatgtttgacttctggggccctgggacgcttgtgaccgtctccagcgcctctacaaaggga

SEQ ID NO: 42742 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcgttaagaccggggcctctgtgacaatcagctgcgagacggaaggatacaccttcgtgaactatattatccactgggtccggcagtcccccggccgcgggtttgagtggctcggaatgattgaccctagaaatggccatccgtggttcgggcagcggctgcgcggaagactttctctgcggcgcgatagaagcacagaaaccgtgtttatgacactctccggcctgacctctgacgatacagcgatctacttctgtgctcggaacgagccccagtattacgacggcagcgggcactcccttcctggaatgtttgattattggggccaagggacccgcgttgtggtcagctctgcctccacgaaagga

SEQ ID NO: 42743 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctatgaagaaacccggggcctctgtcaccatcagctgcgagacagaaggatacacgttcattaactatatcattcactgggttcggcagcctccgggccgcgggtttgagtggctcggaatgatcgaccccagaaatggccggccttggttcgggcagtccgtgcagggacgcctgtctcttagacgggatacctacacagaagtggtctatatgaccctgagcggcctcacatccgacgatgcgggcctgtacttttgtgctcgcaacgagccccaatatcatgacgggaatggacactctcttcctggcatgttcgattactgggggcagggaaccctggtggccgttagctccgccagcacaaagggc

SEQ ID NO: 42744 - RNA, 399 nt, synthetic construct
  misc_feature 1..399: note = derived and/or modified sequence opt5 from anti-HIV_Chain
  source 1..399: mol_type = other RNA
caggtgagactggtccaaagcggcgcccagctcaagaaacccggggcttccgttaccgtgtcttgcgaggccagcggatacaacttcgtgaattatatcattaactgggtccggcagacacctggccgcgggtttgaatgggtgggaatgatcgacccgagacggggccgcccctggtccgcgcagaagttccaagggagactgacgcttacccgggatattgactctgagaaactgtacatgcacctcagcggactgcgcggcgatgacacagctgtttattactgtgccagacaggattccgactttcatgatggccacgggcatacccttcggggaatgttcgactcttggggccaggggagccctgtgacagtctccagcgcctctaccaaggga

SEQ ID NO: 42745 - RNA, 399 nt, synthetic construct
  misc_feature 1..399: note = derived and/or modified sequence opt5 from anti-HIV_Chain
  source 1..399: mol_type = other RNA
caggtgcacaccttccaaagcggctcctctatgaagaaaagcggggcctccgtcacaatctcttgcgaggctacgggatacaacattaagaattatatcctgcattgggttagacagaaacccggccgggggtttgaatgggtgggaatgattgaccctatcaacggccgcccgtggttcgggcagccctttagaggacggctcaccctgacacgcgatcttagcaccgagacattctacatgtccctgtctggcctcaccagcgacgatacagccacctatttttgtgcgagacgggaagctgactaccacgatggcaatgggcatacgctgcctggaatgttcgacttttggggccccgggacccttattacagtgtccagcgcctctaccaaggga

SEQ ID NO: 42746 - RNA, 399 nt, synthetic construct
  misc_feature 1..399: note = derived and/or modified sequence opt5 from anti-HIV_Chain
  source 1..399: mol_type = other RNA
caggtgagactgttccaaagcggcgccgctatgaagaaacccggggcctccgtcaccatctcttgcgaggcgagcggatacaactttatgaattatttcgttcactgggtgcggcagcgccctggcagagggtttgaatggctcggaatgattaacccgcggggcgggcgcccctggtccgctcagtctgtgcagggaagactgacacttacgcgggacatcagcaccgagatgttctacatgcgcctggatggcctcagatccgacgatacagccacctatttttgtgcccggaatgaagctgactaccatgatggcaacgggcactctctgcgcggaatgttcgactattggggccaagggagccttattacagtctccagcgcctctaccaaggga

SEQ ID NO: 42747 - RNA, 399 nt, synthetic construct
  misc_feature 1..399: note = derived and/or modified sequence opt5 from anti-HIV_Chain
  source 1..399: mol_type = other RNA
caggtgcaactgttccagagcggcgccgctatgagaaagcccggggcctccgtcaccatctcttgcgaggcgagcggatacaactttatgaattatttcgttcactgggtgcggcagcgccctggcagagggtttgaatggctcggaatgattaacccgcggggcgggcgcccctggtccgctcagtctgtgcaaggaagactgacacttacgcgggacaccagcacagagatgttctacatgcgcctggatggcctcagatccgacgataccgccacatatttttgtgcccggaatgaagctgactaccatgatggcaacgggcactctctgcgcggaatgttcgactattggggccaggggagccttatcaccgtctccagcgcctctacaaaagga

SEQ ID NO: 42748 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctatcaagaaacccggggcctctgtcaccattagctgcgagacagaaggatacacgttcatcaactatattatccactgggttcggcagcctccgggccgcgggtttgagtggctcggaatgattgaccccagaaatggccggccttggttcgggcagtccgtgcagggacgcctgtctcttagacgggatacctacacagaagtggtctatatgaccctgagcggcctcacatccgacgataccggcctgtacttttgtgcgcgcaacgagccccaatatcatgacgggaatggacactctcttcctggcatgttcgatagctgggggcagggaacactggtggctgtttccagcgcctctaccaagggc

SEQ ID NO: 42749 - RNA, 399 nt, synthetic construct
  misc_feature 1..399: note = derived and/or modified sequence opt5 from anti-HIV_Chain
  source 1..399: mol_type = other RNA
caggtgagactgttccaaagcggcgccgctatgcggaagcccggggcctccgtcaccatctcttgcgaggcgagcggatacaactttctcaattatttcgttcactgggtgcgccagagacctggccgggggtttgaatggctgggaatgattaacccgcgcggcgggagaccctggtccgctcagtctgtgcagggacggcttacactgacgcgcgacaccagcacagagatgttctacatgagactcgatggcctgcggtccgacgataccgccacatatttttgtgcccgcaatgaagctgactaccatgatggcaacgggcactctcttagaggaatgttcgactattggggccaagggagcctgatcaccgtctccagcgcctctacaaaagga

SEQ ID NO: 42750 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctgtcaagaaacccggggcctctgttaccatcgtgtgcgagacagaaggatacaacttcattgactatatcattcactgggtgcggcagcctccgggccgcgggtttgagtggctcggaatgatcgatcccagaaatggccggccttggagcgggcagaaggtccatggacgcctgtccctttggagagacacgtctaccgaaaaagtgtacatgacactgaccggcctcacaagcgatgacaccggcctgtatttctgtgggcggaacgagccccagtaccacgatgacaatggacattcccttcctggcatgattgattattgggggcaaggaacaatggttaccgtgtctagcgcgtccacgaagggc

SEQ ID NO: 42751 - RNA, 399 nt, synthetic construct
  misc_feature 1..399: note = derived and/or modified sequence opt5 from anti-HIV_Chain
  source 1..399: mol_type = other RNA
caggtgagactgagccaatccggcgccgctatcaagaaacccggggcctctgtcaccattagctgcgagacagaaggatacacgttcatcaactatattatccactgggttcggcagcctccgggccgcgggtttgagtggctcggaatgattgaccccagaaatggccggccttggttcgggcagtccgtgcagggacgcctgtctcttagacgggatacctacacagaagtggtctatatgaccctgagcggcctcacatccgacgatgcgggccattacttttgtgctcgcaacgagccccaatatcacgacgggaatggacattctctgcctggcatgttcgattactgggggcagggaacccttgtggccgttagctccgccagcacaaagggc

SEQ ID NO: 42752 - RNA, 399 nt, synthetic construct
  misc_feature 1..399: note = derived and/or modified sequence opt5 from anti-HIV_Chain
  source 1..399: mol_type = other RNA
caggtgagactgttccaaagcggcgccgctatgcggaagcccggggcctccgtcaccatctcttgcgaggcgagcggatacaactttatgaattatttcgttcactgggtgcgccagagacctggccgggggtttgaatggctcggaatgattaacccgcgcggcgggagaccctggtccgctcagtctgtgcagggacggctgacacttacgcgcgacaccagcacagagatgttctacatgagactggatggcctccggtccgacgataccgccacatatttttgtgcccgcaatgaagctgactaccatgatggcaacgggcactctctgagaggaatgttcgactattggggccaagggagccttatcaccgtctccagcgcctctacaaaagga

SEQ ID NO: 42753 - RNA, 399 nt, synthetic construct
  misc_feature 1..399: note = derived and/or modified sequence opt5 from anti-HIV_LightChain
  source 1..399: mol_type = other RNA
atgaagctgcccgtgagactcctggtccttatgttctggatccctgccagctcctctgacattgttatgacccagagcccgctgtccctccccgtgacacctggcgagcccgcttctatcagctgccggtcctctcaacgcctgcttagctcctacgggcacacgtatctgcattggtacctccagaaacctggacagagcccccagctgctgatttatgaagtgtctaacagattttccggcgtccctgatcggttcagcgggtctggatccggcaccgactttacactcaagatcagccgcgtggaggccgaagatgttggggtgtactattgttctcaatccacccacgtcccgctgacattcggacagggcaccaaagtggagattaagagaaaa

SEQ ID NO: 42754 - RNA, 402 nt, synthetic construct
  misc_feature 1..402: note = derived and/or modified sequence opt5 from anti-HIV_Chain
  source 1..402: mol_type = other RNA
cagccctacatcgtgcaaagcggccctgccgtcaagggggctggatcctctgttaccgtgacatgcaaagtggacggcgatgacgatgggattttcagctttggaacgtatttcatggtctgggtgagacaggccccgggccaggggctgcagtacatgggaggcctcgttccctcctatgcgcctacctacgctcacaagtttgagggccggatcacaatttctgccgccgggacaccccctgtggtcagcctgacccttctgaacctcaccaatgacgatgctgccacatatttctgtgctcgcgaaagaggacggcattacgactccaaaacccgcgagaacagacggggccgctattttgatatgtgggggagaggaacgcggatcaccgtgtctccc

SEQ ID NO: 42755 - RNA, 402 nt, synthetic construct
  misc_feature 1..402: note = derived and/or modified sequence opt5 from anti-HIV_Chain
  source 1..402: mol_type = other RNA
cagccctacatcgtgcaaagcggccctgccgtcaagggggctggatcctctgttaccgtgacatgcagagtggacggcgatgacgatgggattttcaactttggaacgtatttcatggtctgggtgcggcaggccccgggccaggggctgcagtacatgggaggcctcgttcccagctatgcgcctacctacgctcacaaatttgagggccgcatcacaatttccgccgccgggacaccccctgtggtctctctgacccttatcaatctgaccaacgctgacgccgctacatatttctgtgccagagaacggggacgccattacgatagcaagaccagagagaatcggcgcggcagatattttgacatgtgggggcggggaacgcgcattaccgtgtccccc

SEQ ID NO: 42756 - RNA, 402 nt, synthetic construct
  misc_feature 1..402: note = derived and/or modified sequence opt5 from anti-HIV_Chain
  source 1..402: mol_type = other RNA
agagtgcacagccaggtccaactggttgagtccggccccgggctcgtgaagccttctcagaccctgagccttacatgcacggtgtccggaggctctatcagcaacgggggacattactggaattggattcggcagcacccgggcaaagggctggaatggatcggacatatttataacatcgccaccacatactataatccctccctcaagtctcgcgtcagcatttccgtggacaccagcaaaaaccagttctctctgaaactttccagcgttacagctgccgataccgcggtgtactattgtgctagaggctctggccggtggacaatcggggcccgcatctactttgacaattggggacaaggcgccctggtcgctgtgtccagcgcctctaccaagggg

SEQ ID NO: 42757 - RNA, 402 nt, synthetic construct
  misc_feature 1..402: note = derived and/or modified sequence opt5 from anti-HIV_Chain
  source 1..402: mol_type = other RNA
agcgtggacgagagactgctcgagttcggcgggcggctggtccagcccggaggctcccttcgcctgtcttgcagcgcctccgggtttaccttctctaacagcgctatgtcctgggttagacaagcccctggaaagggcctcgaatgggtgtctagcatcctgtccagcggggtgggaacattttacgcggattctgtcaaaggccggttcacggtgtcccgcgacaatagcagaaacaccctttatctgcagatgaagtctctccgggctgaagatacagccctgtactattgtgccaaagttcagattcagcaactgaattttggcgtgatcaccgacgctgggctcgatgtctggggaaagggcacaaccctgattgtgtccagcgcctctacaaaaggg

SEQ ID NO: 42758 - RNA, 402 nt, synthetic construct
  misc_feature 1..402: note = derived and/or modified sequence opt5 from anti-HIV_Chain
  source 1..402: mol_type = other RNA
gtgcagagccaagtctacctggttcagtccggcggggaggtgaagaaacccggatctagcgtgaaggtctcctgcaaagcctctggcgacagcttctcctctagcgtgatcacctgggttagacaggctcctgggcagggaccggaatggatgggccggattatccccgtgctcggggtcgccgcgtatgctcaaaacttttacggacgcgtgacaatttccgccgatacgagctctaataccgcctatatggagctgtccagccttagattcgaagacacagctgtgttttactgtgcccgggagaccggccgcggcgggaacctggctctcagacagtatttctttgattcttggggacagggcacactggttaccgtctccagcccttctacaaagggg

SEQ ID NO: 42759 - RNA, 402 nt, synthetic construct
  misc_feature 1..402: note = derived and/or modified sequence opt5 from anti-HIV_Chain
  source 1..402: mol_type = other RNA
cagctgcaactccaggagagcggccccgggctggtgaagccttccgaaaccctttctctgacatgcagcgtctccgacggatctatcaacagcaattcctactattgggcctggattagacagtctccgggcaaagggctcgagtggatcggaagcgtttactatttcggcgggacgtactattcccccagcctgaagtctcgggtgaccatgtccgtggatcgcagcaaaaaccagttttctcttaatgtctccagcgtgacagctgccgacaccgcgatttactattgtgctagacacgttcggccttacgatcgctctggataccccgaaagacctaactggttcgacccctggggccggggcacactggtgaccgtctccagcgcctccacaaagggg

SEQ ID NO: 42760 - RNA, 402 nt, synthetic construct
  misc_feature 1..402: note = derived and/or modified sequence opt5 from anti-HIV_Chain
  source 1..402: mol_type = other RNA
caggtgcaactgcaccagtggggcgccgggctcctgaagcccagcgacaccctttccctgacatgcggaatcctcggcgtctctcctccggggagcctgacgggatactattggacctggattagacagccccctggcaaagggcttgagtggatcggagaagtttaccattccggctctacaaactataatcccagcctggcttcccgggtgaccatttctatgggcacaaccaagacacagttcagcctccgcctgacctccgtgacggccgcggatagcgctgtctactattgtgcctctgggaaagtgtggggaatcaccgccagacctcgggacgctggcctggatgtttgggggcaaggaacaaccgtgacagtcacctccgccagcacgaagggc

SEQ ID NO: 42761 - RNA, 402 nt, synthetic construct
  misc_feature 1..402: note = derived and/or modified sequence opt5 from anti-HIV_Chain
  source 1..402: mol_type = other RNA
caggtgcaactggtccagagcggcgccgaggttaagaaacccgggtcctctgtgaaggtgagctgcagagcttccggaggctctttcgggaactacgccatcaattgggtccggcaggcgcctatgcagggactcgaatggatgggcgggattatcccgatttttggaaccacaaactatgctcaaaatttccgcggcagagtgacgatcaacgccgacacctttacaaataccgttaacatggatctgagctcccttcggtctgaggacacagccgtgtactattgtggccgcagcattaatgctgccgtccccgggctggaaggagtgtactattactatggcatggctgtttgggggcagggaaccacagtgaccgtctccagcgcctctacgaaaggc

SEQ ID NO: 42762 - RNA, 402 nt, synthetic construct
  misc_feature 1..402: note = derived and/or modified sequence opt5 from anti-HIV_Chain
  source 1..402: mol_type = other RNA
ttcgtgcagctggtcgagagcggcgggggactcgttcaacccggcgggtccctgagactttcttgcgccgctagcggatttaacttcaatacctactggatgaactgggtgcggcaggcccctggcaaggggctggaatgggtggcgaatatgaaagaggacggatccgaaaagtattacgtcgattctgtgaaaggccgctttacaatcagcagagacaacgctaaaaattccctctatctgcagatgaactctcttcgggccgaggatacggccgtttactattgtgctcgcaatccggaaagcagatgcattgtgggccggaaccgcgggtggtgtagatacttcgacctgtggggacggggctccctcgtcaccgtgagccccgcctctacaaagggg

SEQ ID NO: 42763 - RNA, 405 nt, synthetic construct
  misc_feature 1..405: note = derived and/or modified sequence opt5 from anti-HIV_Chain
  source 1..405: mol_type = other RNA
cagctgcaactcgaccagcccggcgccgctatgaaaagcctggggtcctctcttaccatcacatgcagagtgagcggagatgacctgggctccttccactttgggacgtacttcatgatttgggtccggcagggacctggccaggggctcgagtatatgggaggcatcctgccgtctaccaagacacccacctacgcccataagtttcgcggcagagttagcatttccgcgcctggggtgccccctgtgctttctctggctctcacaaacctgacctatgatgacacagccacctacttctgtgcccgggaacgcggaagacactttgagcccaaaaatcgggatcatctggaaggcaagttcctcgacctgtgggggcgcggaacgtttgtcagagtgagccct

SEQ ID NO: 42764 - RNA, 405 nt, synthetic construct
  misc_feature 1..405: note = derived and/or modified sequence opt5 from anti-HIV_Chain
  source 1..405: mol_type = other RNA
caggtgcaactggtccagcccggcaccgccatgaaaagcctcgggtcctctctgacaatcacgtgcagagttagcggagacgatcttggctccttccactttgggacctacttcatgatttgggtgcggcaggctcctggacagggcctggagtatatgggagggatcctcccgtctacaaagacccccacatacgcccataagtttcgcggcagagtgagcatttccgcgcctggcgtgccccctgtcctgtctcttgctctgaccaacctcacatatgacgataccgccacgtacttctgtgcccgggaacgcgggagacactttgagcccaaaaatcgggacaacctggaaggaaagttctttgatctgtggggccgcgggaccttcgttagagtgagccct

SEQ ID NO: 42765 - RNA, 405 nt, synthetic construct
  misc_feature 1..405: note = derived and/or modified sequence opt5 from anti-HIV_Chain
  source 1..405: mol_type = other RNA
caggtgcaactggtccagcccggcaccgccatgaagacactcgggagctccctgacgatctcttgcagagttagcggagacgatggcaacttccactttgggacctacttcatggcttgggtgcgccaggtgcctggacagggccttgagtatatgggagggattctgccgtccacaaaatctcccacctacgcccataagtttcggggcagagtcagcatctccacagcgggcgtgcctcccgttgtgtctctcgctctgaccaatcttacatatgacgataccgccacgtacttctgtgcccgggaacgcgggagacactatgacagcaaaaagcaagagaactaccggggaaaatttttcgatctgtggggccgcgggacctgggtcagagtgtcccctaca

SEQ ID NO: 42766 - RNA, 405 nt, synthetic construct
  misc_feature 1..405: note = derived and/or modified sequence opt5 from anti-HIV_Chain
  source 1..405: mol_type = other RNA
cacctggtgcagagcggcaccgaggtcaagaaacccgggtcctctgttacagtgagctgcaaggcctacggagtgaacacgttcggcctctatgctgtcaattgggtgagacaagcccctgggcagtccctggaatacatcggacagatttggcggtggaaatctagcgcgtcccatcactttcgcggcagagttcttatctctgctgtggacctgaccgggagctccccgcccattagctctctcgagatcaagaacctgacatccgatgacaccgccgtctatttctgtacaaccacaagcacctacgatcagtggtctggacttcatcacgacggcgtgatggccttttccagctggggccaagggacgctgatttctgtttccgctgccagcaccaaagga

SEQ ID NO: 42767 - RNA, 405 nt, synthetic construct
  misc_feature 1..405: note = derived and/or modified sequence opt5 from anti-HIV_Chain
  source 1..405: mol_type = other RNA
caggtgcaactggtccagagcggcgccgaggttaagaaacccgggtcctctgtgaaggtgagctgcaaggcttccggaggcaccttctctacatacgcctttagctgggtcagacaggcgcctatcgaagggctcgagtggatgggaggcattatcccgattttcgggacggaaaactatgctcagaaatttcaaggacgggtgaccatcacagccgacaaatccacctctacagcctacatggagctgagctcccttcgcagcgaagataccgctgtttattactgtgccagagaccggtcttccgctattggctattgcagctctatctcctgttacaagggcagcttcgatatctgggggcagggaacaatggtgaccgtctcttccgccagcacgaagggc

SEQ ID NO: 42768 - RNA, 405 nt, synthetic construct
  misc_feature 1..405: note = derived and/or modified sequence opt5 from anti-HIV_Chain
  source 1..405: mol_type = other RNA
caggtgcaactggtccagagcggcgccgaggttaagaaacccgggtcctctgtgaaggtgagctgcaaggcttccggaggcaccttctctacatacgcctttagctgggtcagacaggcgcctgggcagggactcgaatggatgggcgggatcattccgatcttcggaacggagaactatgctcaaaaatttcagggccgggtgaccattacagccgacaaatccacctctacagcctacatggaactgagctcccttcgcagcgaggataccgctgtttattactgtgccagagaccggtcttccgctatcggctattgcagctctatttcctgttacaaggggagcttcgatatctggggacagggcacaatggtgaccgtctcttccgccagcacgaagggg

SEQ ID NO: 42769 - RNA, 405 nt, synthetic construct
  misc_feature 1..405: note = derived and/or modified sequence opt5 from anti-HIV_Chain
  source 1..405: mol_type = other RNA
gaggtgcagctggtcgaaagcggcgggggactcgttcaacccggcgggtccctgagactttcttgcgccgctagcggattcaccttttcctcttacagcatgaactgggtgcggcaggcccctggcaaggggctggagtgggtgtcctatatctctggaagctcctacacaatttattacgcggacagcgtccgcggcagattcacgatctctcgggataatgctaaaaactccctctatctgcagatgaatagccttcgcgacgaagataccgccgtgtacttttgtgccagagctacaccgcccaaccctctgaatctctataactacgactcttccggcagctctttcgattactgggggcagggaaccctggttacagtgtccagcgcctccaccaagggc

SEQ ID NO: 42770 - RNA, 405 nt, synthetic construct
  misc_feature 1..405: note = derived and/or modified sequence opt5 from anti-HIV_Chain
  source 1..405: mol_type = other RNA
gaggtgcagctggtccaaagcggcgccgaagttaagaaacccgggtcctctgtgaaggtgagctgcaaggcttccggaggcaccttctctacatacgcctttagctgggtcagacaggcgcctgggcagggactcgagtggatgggcgggatcattccgatcttcggaacggaaaactatgctcagaaatttcaaggccgggtgaccattacagccgacaaatccacctctacagcctacatggagctgagctcccttcgcagcgaagataccgctgtttattactgtgccagagaccggtcttccgctatcggctattgcagctctatttcctgttacaaggggagcttcgatatctggggacagggcacaatggtgaccgtctcttccgccagcacgaagggg

SEQ ID NO: 42771 - RNA, 405 nt, synthetic construct
  misc_feature 1..405: note = derived and/or modified sequence opt5 from anti-HIV_Chain
  source 1..405: mol_type = other RNA
gaggtgcagctggtcgaaagcggcgccgaggttaagaaacccgggtcctctgtgaaggtgagctgcaaggcttccggaggcaccttctctacatacgcctttagctgggtcagacaagcgcctgggcagggactcgaatggatgggcgggatcattccgatcttcggaacggagaactatgctcagaaatttcagggccgggtgaccattacagccgacaaatccacctctacagcctacatggaactgagctcccttcgcagcgaggataccgctgtttattactgtgccagagaccggtcttccgctatcggctattgcagctctatttcctgttacaaggggagcttcgatatctggggacaaggcacaatggtgaccgtctcttccgccagcacgaagggg

SEQ ID NO: 42772 - RNA, 405 nt, synthetic construct
  misc_feature 1..405: note = derived and/or modified sequence opt5 from anti-HIV_Chain
  source 1..405: mol_type = other RNA
cccctggtgcagctcgagcctagcggcgtcgaagttaagaaaagaggggcctccgtgaaggtgtcttgcaaagtcagcggatactccctgaccgagctttctatgcactgggtgcggcaagctccgggcaaggggctggaatggatgggcagcttcgaccccctcgatggagacacaatctatgcccagaaatttcaggggcgcgttacgatgaccgtggatacatccaccgacacagcgtacatggatctgtctagccttagattcgaggacaccgctgtctattactgtgccacaccttccaaggcctattactatgatagccccaactacgaaggagacttttacatggatgtgtggggcaagggcaccacggttattgtgtcttccgctagcaccaaaggg

SEQ ID NO: 42773 - RNA, 408 nt, synthetic construct
  misc_feature 1..408: note = derived and/or modified sequence opt5 from anti-HIV_HeavyChain
  source 1..408: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagctgacatccgatgacaccgccgtctatttctgtacaaccacaagcacctacgataaatggtctggacttcatcacgacggcgtgatggccttttccagccggggccaagggacgctgatctctgtttccgctgccagcaccaaggga

SEQ ID NO: 42774 - RNA, 408 nt, synthetic construct
  misc_feature 1..408: note = derived and/or modified sequence opt5 from anti-HIV_HeavyChain
  source 1..408: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagggactggaatacattggccagatctggcggtggaaatcctctgcgagccatcactttcgcgggagagttcttatttccgctgtggacctgaccggatctagcccgcccatctccagcctcgagattaaggtcacatctgatgacaccgccgtgtatttctgtacaaccacatccacctacgatgaatggagcgacctgcatcacgatggcgttatggccttttcttcctggggccaagggacgcttatcagcgtgtctgctgcctccaccaaagga

SEQ ID NO: 42775 - RNA, 408 nt, synthetic construct
  misc_feature 1..408: note = derived and/or modified sequence opt5 from anti-HIV_HeavyChain
  source 1..408: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagctgacatccgatgacaccgccgtctatttctgtacaaccacaagcacctacgatcggtggtctggacttcatcacgacggcgtgatggccttttccagctggggccaagggacgctgatctctgtttccgctgccagcaccaaagga

SEQ ID NO: 42776 - RNA, 408 nt, synthetic construct
  misc_feature 1..408: note = derived and/or modified sequence opt5 from anti-HIV_Chain
  source 1..408: mol_type = other RNA
tgcaaccccagagtgcacagcgaggtccagctggttgaatccggcgccgaggtgaagaaacctggggcttctgtgaaggtcgcctgtaaagtgagcggaaagaaactctccgacctgtctatccattgggttcggcaagcgccgggcaaggggcttgaatggatgggaggcttcgatgaggaagacgggaagattagctacgagcgcaaatttcagggaagagtgtccatgaccgaggatacagctcgggacacggccttcatggaaatgtctagcctgcgctccgatgacaccgccgtctatttttgcgctgccgctcccagactcgatctgggcgagcttagctctggcttccacttttgggggctgggaacactcgtgaccgtttccagcgcctctacaaagggc

SEQ ID NO: 42777 - RNA, 408 nt, synthetic construct
  misc_feature 1..408: note = derived and/or modified sequence opt5 from anti-HIV_Chain
  source 1..408: mol_type = other RNA
atctgggctcccctgattgccgtgaccttcctcgtcctgcactgcgagagccttggcacatgttgctgttgccaggcctccgggggaacgtttaacaccttcgcgatcaattgggttagacaagctcctggccaggggctggaatgggtgggaggcattatcccggtgtttgggacagcctcttacgcccagaagttccagggacgggtcaccgtgacaaccgacgagagccgcggcacagcttatatggaactcaactccctgagatctgaggataccgccgtttactattgtgctcggggccaaacggaccttaatgatgacctgtggagcgattactccacccccgggtttgactattggggacagggcacactcgtgaccgtctctagcgcctccacaaaaggg

SEQ ID NO: 42778 - RNA, 408 nt, synthetic construct
  misc_feature 1..408: note = derived and/or modified sequence opt5 from anti-HIV_Chain
  source 1..408: mol_type = other RNA
ctgcagcccagagtgcacagcgaggtccaactcgttgaatccggcgccgaggtgaagaaacctggggcttctgtgaaggtcagctgcaaagtgtccggatacaccctgtctgaccttagcatgcattgggttcggcaggccccgggcaaggggctggaatggatgggaggcttcgatgaggaagacggggagatcacatatgcgcagaaatttcagggacgcgtgtccatgacggaggatacctctagagacacagcttacatggaactcagctccctgcggagcgaggataccgccgtctattactgtgccacagctccccgccttgaactgggcgagctctcttccggcttccactattgggggctgggaaccctggtgacagttagctctgcctccaccaagggc

SEQ ID NO: 42779 - RNA, 408 nt, synthetic construct
  misc_feature 1..408: note = derived and/or modified sequence opt5 from anti-HIV_Chain
  source 1..408: mol_type = other RNA
cagagccaagtgcacctggtccagtccggcgccgaggttaagaaacccgggtctagcgtgaaggtgtcctgccaggcttctggaggcaccttcaacacatttgccatcaattgggtcagacaggcgcctgggcaaggactcgaatgggtgggcgggattatcccggttttcggaacggctagctacgcccagaaatttcagggccgggtgaccgtcacaaccgacgagtcccgcggcacagcctatatggaactgaactctcttagaagcgaggataccgctgtgtactattgtgcccgggggcagacagacctgaatgatgacctctggtccgattacagcacccccggattcgactattggggccaagggacgctggttaccgtgtcttccgctagcacaaaggga

SEQ ID NO: 42780 - RNA, 408 nt, synthetic construct
  misc_feature 1..408: note = derived and/or modified sequence opt5 from anti-HIV_Chain
  source 1..408: mol_type = other RNA
ggcagcgaggtgcagctggtcgaatccggggccgaggttaagaaaagaggagcttctgtgaaggtgagctgcaaagtctccggctactctctcaccgaactgagcatgcactgggtgcggcaagcccccgggaagggacttgagtggatgggctccttcgaccctctggatggggacacaatctatgcgcagaaatttcagggacgcgttacgatgaccgtggatacatctaccgacacagcttacatggatctcagctccctgagattcgaagacaccgccgtctattactgtgccacaccgagcaaggcttattactatgattctcccaactacgagggcgacttttacatggatgtgtggggcaaggggaccacggttattgtgtccagcgcctctaccaaagga

SEQ ID NO: 42781 - RNA, 408 nt, synthetic construct
  misc_feature 1..408: note = derived and/or modified sequence opt5 from anti-HIV_Chain
  source 1..408: mol_type = other RNA
caggtgcaactggtccagagcggcggggaggttaagaaacccggagcctccgtgaaggtgtcttgcaaagtcagcggctactccctcaccgaactgtctatgcactgggtgagacaggctcctgggaagggacttgagtggatgggcgttttcgacccgctggaaggggatggagtgtatgtccagaaatttcggggccgcgtgatcatgacagaggacacgagcaccgatacagcctacatggaactcacctccctgagatctgaggacacagcgatttattactgtgctaccaaggccaaggattattactatgagagctccgactacagcccctactattactattacatggatgtttggggcaaagggacaaccgtgacggtctcttccgccagcaccaaggga

SEQ ID NO: 42782 - RNA, 408 nt, synthetic construct
  misc_feature 1..408: note = derived and/or modified sequence opt5 from anti-HIV_Chain
  source 1..408: mol_type = other RNA
gaggtgcagctggtccaaagcggcgccgaagttaagaaacccggggcttccgtgaaggtgtcttgcaaagtcagcggatacaccctcacagagctgtccatgcactgggtgagacaggcccctggcaaggggcttgaatggatgggagttttcgacccgctggagggcgatggggtgtatgcggaaaaatttcggggacgcgtcatcatgacggaggacacctctacagataccggctacatggagctcacaagcctgagatccgaagacaccgctatttattactgtgccacaaaggccaaggattattactatgagtctagcgactactccccctactattactattacatggatgtgtggggcaaagggaccacggttaccgtgagctctgcttccacaaaggga

SEQ ID NO: 42783 - RNA, 408 nt, synthetic construct
  misc_feature 1..408: note = derived and/or modified sequence opt5 from anti-HIV_Chain
  source 1..408: mol_type = other RNA
caggtgcaactggtccagagcggcgccgaggttaagaaacccggggcttccgtgaaggtgtcttgcaaagccagcggatacaccttcacaagatatcacatccattgggtccggcacgcgcctggccaggggctcgaatggatgggaaagattaacccgtcccgcgcttctacgaaatacgccaagaagtttcaggacagagtgaccatgacacgggataccagcacatccaccgtttatatggagctgtctagccttcgcggcgacgatacagccgtgtactattgtgggagagaaatgggaaccttcacgctgctcggcgtcgtgatcgaccattacgatttttatcccatggacgtttggggccaagggacccctgtgacagtctccagcgcttctaccaaagga

SEQ ID NO: 42784 - RNA, 408 nt, synthetic construct
  misc_feature 1..408: note = derived and/or modified sequence opt5 from anti-HIV_Chain
  source 1..408: mol_type = other RNA
agcagacccccttcctgcctgctcggctgttggtgctgttctgggttcctgcttccggccgtgatcctgcccaacctccacagcccttgcctgtcccttctggagtctcagccccctagcctcgctgacctggtctccgcctttgcggttatggatattcccatctacattggaacctatcggtctcaagctagcctgcattccagctctacaaagttccctacggactttctcggctcccagaccgggagcgtggccgtgggacagggccagatctctcatctgcgctccgtcgaatggagacttcggatgtgggagttcattacagccctgaaagtgcacatgtttctcagccgctctgatagagggccgcggtggaagaatgtttccagcctgcttaactcccgc

SEQ ID NO: 42785 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttattatctctgctgtggaccttaccgggagctccccgcccattagccctctggagatcaagaacctcacatctgatgacaccgccgtctatttctgtacaaccacatccaccagcgatcggtggtctggactgcatcacgacggcgtgatggccttttccagctggggccaagggacgcttatctctgtttccgctgccagcaccaaagga

SEQ ID NO: 42786 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttattatctctgctgtggaccttaccgggagctccccgcccattagctctctggagatcaagaacctcacatccgatgacaccgccgtctatttctgtacaaccgccagcacatacgataaatggtctggactgcatcacgacggcgtgatggctttttccagctggggccaagggacccttatctctgtttccgccgctagcacgaaggga

SEQ ID NO: 42787 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggccgagccctcccatctccagcctcgagattaagaacctgacatctgatgacaccgccgtctatttctgtacaaccacatccacctacgataaatggagcggacttcatcacgacggcgtgatggccttttcttcctggggccaagggacgctgatcagcgtttctgctgcctccaccaaggga

SEQ ID NO: 42788 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttgccgtgagctgcaaggcttacggagtgaacacattcggcctctatgccgtcaattgggtgagacaggcgcctgggcagtccctggaatacattggacagatctggcggtggaaatctagcgcttcccatgactttcgcggcagagttattatctctgccgtggatcttacggggagctccccgcccattagctctctggagatcaagaacctcacctccgacgatacagccgtctatttctgtaccgctacaagcacccctgactactggtctggactgcaccatgatggcgtgatggccttttccagctggggccaagggacacttatctctgtttccgctgccagcaccaaagga

SEQ ID NO: 42789 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccggggtcaagaaacccggatcctctgttacagtgagctgcaaggcctacggcgtgaacacgttcgggctctatgctgtcaattgggtgagacaggcccctggacagggcctggagtacattgggcagatctggcggtggaaatcctctgcgagccatcactttcgcggaagagttcttatttccgctgtggacctgaccggctctagcccgcccatcacatccctcgaaattaagaacgtcaccagcgatgacacagccgtgtatttctgtaccacaacctctacgtacgataaatggtccggcctgtatcatgacggggttatggcctttagctcttggggacaaggcacccttatctccgtgagcgctgcctctacaaagggg

SEQ ID NO: 42790 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttattatctctgctgtggaccttaccgggagctccccgcccattagctctctggagatcaagaacctcacatccgatgacaccgccgtctatttctgtacaaccacaagcacctctgattactggtccggactgcatcacgacggcgtgatggcctttagctcttggggccaagggacgcttatctccgttagcgctgcctccaccaaagga

SEQ ID NO: 42791 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagaacctgacatccgatgacaccgccgtctatttctgtacaaccacaagcacctacgatcggtggtctggacttcatcacgacggcgtgatggccttttccagctggggccaagggacgctgatctctgtttccgctgccagcaccaaagga

SEQ ID NO: 42792 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcagaaagcccgggtcctctgttacagtgagctgcaaagcctacggagtgaacacgttcggcctctatgctgtcaattgggtgcggcaggcccctgggcagtccctggaatacattggacagatctggcgctggaagtctagcgcgtcccatcactttagaggccgggttcttatttctgctgtggacctgaccgggagctccccgcccatcagctctctcgagattaaaaacctgacatccgatgacaccgccgtctatttctgtacaaccacaagcacctacgataagtggtctggacttcatcacgacggcgtgatggccttttccagctggggccaagggacgctgatctctgtttccgctgccagcaccaaagga

SEQ ID NO: 42793 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagaacctgacatccgatgacaccgccgtctatttctgtacaaccacaagcacctacgatcaatggtctggacttcatcacgacggcgtgatggccttttccagctggggccaggggacgctgatctctgtttccgctgccagcaccaaagga

SEQ ID NO: 42794 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtctcctgggtgagacaggcccctgggcagcggctggaatacattggacagatccgcagatggaaatctagcgcgtcccatcactttcggggccgcgttaccgtgtctgctgtcgacccgacagggagctcccctcccattagctctcttgagatcagagatctgaccacagacgataccgccgtgtatttctgtacaaccacgtccaccagcgactactggtctggactccataatgaacggggcacagccttttccagctggggccaagggaccctgatttctgtttccgctgccagcacaaaggga

SEQ ID NO: 42795 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagggactggaatacattggccagatctggcggtggaaatcctctgcgagccatcactttcgcgggagagttcttatttccgctatcgacctgaccggatctagcccgcccatttccagcctcgagatcaagaacgtgacatctgatgacaccgccgtctatttctgtacaaccatgtccacatacgataaatggagcggcctgcatcacgacggcgtgatggccttttcttcctgggggcaaggaacccttatcagcgtttctgctgcctccacgaagggc

SEQ ID NO: 42796 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacgaagtgaacacgttcggactctatgctgtcaattgggtgagacaggcccctggccagtccctggagtacattgggcagatctggcggtggaaatctagcgcgtcccatcactttcgcggaagagttcttatttctgctgtggacctgaccggcagctccccgcccatcagctctctcgaaattaagaacgtcacatccgatgacaccgccgtgtatttctgtacaaccacaagcacccatgataaatggtctgggctgcaccatgacggagttatggccttttccagctggggccaaggcacgcttatctctgtgtccgctgccagcaccaagggg

SEQ ID NO: 42797 - RNA, 411 nt, synthetic construct
  misc_feature 1..411: note = derived and/or modified sequence opt5 from anti-HIV_HeavyChain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagggactggaatacattggccagatctggcggtggaaatcctctgcgagccatcactttcgcgggagagttcttatttccgctgtggacctgaccggatctagcccgcccatctccagcctcgagattaagaacgtcacatctgatgacaccgccgtgtatttctgtacaaccacatccacctacgataaatggagcggcctgcatcacgacggcgttgtggccttttcttcctgggggcaaggaacgcttatcagcgtctctgctgcctccaccaagggc

SEQ ID NO: 42798 - RNA, 411 nt, synthetic construct
  misc_feature 1..411: note = derived and/or modified sequence opt5 from anti-HIV_Chain
  source 1..411: mol_type = other RNA
caggtgaccctggtccaaagcggcgccgaggttaagaaacccggggcttccgtgagaatctcttgccgggccagcggattcacatttgacgattactccgactattctttcattcctacgacctacctcatccactggtttcgccaggcgccgggccaggggctggaatggatggcttggattaacagcgtgaatggaggcagaaacatcgcccggcagttccaagggcgcgtcacagtggccagagatcggtccaattctattgcttttcttgagttcagcggactgcgccatgacgataccgccgtttatttttgtgctagagaccggcgcgatgacgatagagcctggctcctggacccctggggccagggcacacgggtgaccgtctccagcgcgtctacaaagggg

SEQ ID NO: 42799 - RNA, 411 nt, synthetic construct
  misc_feature 1..411: note = derived and/or modified sequence opt5 from anti-HIV_Chain
  source 1..411: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagaacctgacatccgatgacaccgccgtctatttctgtacaaccacaagcacctacgataaatggtctggacttcatcacgacggcgtgatggccttttccagctggggccaagggacgctgatctctgtttccgctgccagcaccaaggga

SEQ ID NO: 42800 - RNA, 414 nt, synthetic construct
  misc_feature 1..414: note = derived and/or modified sequence opt5 from anti-HIV_Chain
  source 1..414: mol_type = other RNA
gtggtccagctggttcaaagcggcgccgaggtgagaaagcccgggtcctctctcaaagtgagctgcaagtcctctggaggcaccttcagccggtttgtcgtgaactgggttcgccaggctcctgggcagggactggaatggatgggcgggatgatcccgattttcggaatcgccaaatacgcgcagaagtttcaagacagagtgacaatgacggctgatgagtccaaaaataccgtctatcttgacttctctagcctgcggtccgatgacacagccgtgtactattgtgcccgcgatagaggcgacacccggctcctggattacggcgactatgaagatgagcgctactattacgggatggacgtttggggacagggcacaaccgtgattgtcagctctgcttccacaaagggg

SEQ ID NO: 42801 - RNA, 414 nt, synthetic construct
  misc_feature 1..414: note = derived and/or modified sequence opt5 from anti-HIV_Chain
  source 1..414: mol_type = other RNA
caggtgcaactggtccagagcggcgccgaggttagaaagcccgggtcctctctcaaagtgagctgcaagtcctctggaggcaccttcagccggtttgtggtcaactgggtgcgccaggctcctgggcagggactggaatggatgggcgggatgatcccgattttcggaatcgccaaatacgcgcaaaagtttcaggacagagttacaatgacggctgatgagtccaaaaataccgtgtatcttgacttctctagcctgcggtccgatgacacagccgtctactattgtgcccgcgatagaggcgacacccggctcctggattacggcgactatgaagatgagcgctactattacgggatggacgtgtggggacagggcacaaccgttattgtgagctctgcttccacaaagggg

SEQ ID NO: 42802 - RNA, 414 nt, synthetic construct
  misc_feature 1..414: note = derived and/or modified sequence opt5 from anti-HIV_Chain
  source 1..414: mol_type = other RNA
gaggtgcagctggtcgaaagcggcgccgaggttagaaagcccgggtcctctctcaaagtgagctgcaagtcctctggaggcaccttcagccggtttgtggtcaactgggtgcgccaagctcctgggcagggactggaatggatgggcgggatgatcccgattttcggaatcgccaaatacgcgcagaagtttcaggacagagttacaatgacggctgatgagtccaaaaataccgtgtatcttgacttctctagcctgcggtccgatgacacagccgtctactattgtgcccgcgatagaggcgacacccggctcctggattacggcgactatgaagatgagcgctactattacgggatggacgtgtggggacaaggcacaaccgttattgtgagctctgcttccacaaagggg

SEQ ID NO: 42803 - RNA, 414 nt, synthetic construct
  misc_feature 1..414: note = derived and/or modified sequence opt5 from anti-HIV_Chain
  source 1..414: mol_type = other RNA
caggtgcaactggtcgagagcggcgccgaagttagaaagcccgggtcctctctcaaagtgagctgcaagtcctctggaggcaccttcagccggtacgtggtcaactgggtgcgccaggctcctgggcagggactggagtggatgggcgggatcattccgatctttggaattgccaaatatgcgcagaagttccaagacagagttacaatgacggctgatgaacccaaaaataccgtgtaccttgactttaactccctgcggtctgatgacacagccgtctattactgtgcccgcgatagaggcgacacccggctcctggattatggcgactacgaggatgaacgctattactacgggatggacgtgtggggacagggcacaaccgttatcgtgagctccgctagcacaaagggg

SEQ ID NO: 42804 - RNA, 414 nt, synthetic construct
  misc_feature 1..414: note = derived and/or modified sequence opt5 from anti-HIV_Chain
  source 1..414: mol_type = other RNA
caggtgcaactggtccagagcggcgccgaggttagaaagcccgggtcctctctcaaagtgagctgcaagtcctctggaggcaccttcagccggtacgtggtcaactgggtgcgccaggctcctgggcagggactggaatggatgggcgggatgatcccgatttttggaatcgccaaatatgcgcaaaagttccaggacagagttacaatgacggctgatgagtccaaaaataccgtgtaccttgacttttctagcctgcggtccgatgacacagccgtctattactgtgcccgcgatagaggcgacacccggctcctggattatggcgactacgaagatgagcgctattactacgggatggacgtgtggggacagggcacaaccgttattgtgagctctgcttccacaaagggg

SEQ ID NO: 42805 - RNA, 414 nt, synthetic construct
  misc_feature 1..414: note = derived and/or modified sequence opt5 from anti-HIV_Chain
  source 1..414: mol_type = other RNA
caggtgcaactggtccagagcggcgccgaggttagaaagcccgggtcctctctcaaagtgagctgcaagtcctctggaggcaccttcagccggtacgtggtcaactgggtgcgccaggctcctgggcagggactggaatggatgggcgggatcattccgatctttggaattgccaaatatgcgcaaaagttccaggacagagttacaatgacggctgatgagtccaaaaataccgtgtaccttgacttttctagcctgcggtccgatgacacagccgtctattactgtgcccgcgatagaggcgacacccggctcctggattatggcgactacgaagatgagcgctattactacgggatggacgtgtggggacagggcacaaccgttatcgtgagctctgcttccacaaagggg

SEQ ID NO: 42806 - RNA, 414 nt, synthetic construct
  misc_feature 1..414: note = derived and/or modified sequence opt5 from anti-HIV_Chain
  source 1..414: mol_type = other RNA
caggtgcaactggtcgagagcggcgccgaagttagaaagcccgggtcctctctcaaagtgagctgcaagtcctctggaggcaccttcagccggtacgtggtcaactgggtgcgccaggctcctgggcagggactggagtggatgggcgggatcattccgatctttggaattgccaaatatgcgcagaagttccaagacagagttacaatgacggctgatgaatccaaaaataccgtgtaccttgacttttctagcctgcggtccgatgacacagccgtctattactgtgcccgcgatagaggcgacacccggctcctggattatggcgactacgaggatgaacgctattactacgggatggacgtgtggggacagggcacaaccgttatcgtgagctctgcttccacaaagggg

SEQ ID NO: 42807 - RNA, 414 nt, synthetic construct
  misc_feature 1..414: note = derived and/or modified sequence opt5 from anti-HIV_Chain
  source 1..414: mol_type = other RNA
caggtgcaactggtccagagcggcgccgaggttagaaagcccgggtcctctctcaaagtgagctgcaagtcctctggaggcaccttcagccggtacgtggtcaactgggtgcgccaggctcctgggcagggactggaatggatgggcgggatcattccgatctttggaattgccaaatatgcgcaaaagttccaggacagagttacaatgacggctgatgagcccaaaaataccgtgtaccttgactttaactccctgcggtctgatgacacagccgtctattactgtgcccgcgatagaggcgacacccggctcctggattatggcgactacgaagatgagcgctattactacgggatggacgtgtggggacagggcacaaccgttatcgtgagctccgctagcacaaagggg

SEQ ID NO: 42808 - RNA, 414 nt, synthetic construct
  misc_feature 1..414: note = derived and/or modified sequence opt5 from anti-HIV_Chain
  source 1..414: mol_type = other RNA
gtggtccagctggttcaaagcggcgccgaggtgagaaagcccgggtcctctctcaaagtgagctgcaagtcctctggaggcaccttcagccggtacgtcgtgaactgggttcgccaggctcctgggcagggactggaatggatgggcgggatgatcccgatttttggaatcgccaaatatgcgcagaagttccaagacagagtgacaatgacggctgatgagtccaaaaataccgtctaccttgacttttctagcctgcggtccgatgacacagccgtgtattactgtgcccgcgatagaggcgacacccggctcctggattatggcgactacgaagatgagcgctattactacgggatggacgtttggggacagggcacaaccgtgattgtcagctctgcttccacaaagggg

SEQ ID NO: 42809 - RNA, 414 nt, synthetic construct
  misc_feature 1..414: note = derived and/or modified sequence opt5 from anti-HIV_Chain
  source 1..414: mol_type = other RNA
ttcatctgctttagcgtggtcgttagactgctcgagttcggcgggcggctggtgcagcccggaggctcccttcgcctgtcttgtagcgcctccgggtttaccttctctaacagcgctatgtcctgggtgagacaagcccctggaaagggcctcgaatgggtctctagcattctgtccagcggggtgggaacattttacgcggactctgttaaaggccggttcacggtgtcccgcgataatagcagaaacaccctttatctgcagatgaagtctctccgggctgaggacacagccctgtactattgcgccaaagtccagatccagcaactgaattttggcgtgattaccgatgctgggctcgacgtttggggaaagggcacaaccctgatcgtgtccagcgcctctacaaaaggg

SEQ ID NO: 42810 - RNA, 414 nt, synthetic construct
  misc_feature 1..414: note = derived and/or modified sequence opt5 from anti-HIV_Chain
  source 1..414: mol_type = other RNA
caggtgcaactggtccagagcggcgccgaggttagaaagcccgggtcctctctcaaagtgagctgcaagtcctctggaggcaccttcagccggtacgtggtcaactgggtgcgccaggctcctgggcagggactggaatggatgggcgggatcattccgatctttggaattgccaaatatgcgcaaaagttccaggacagagttacaatgacggctgatgagtccaaaaataccgtgtaccttgacttttctagcctgcggtccggcgatacagccgtctattactgtgcccgcgacagaggcgatacccggctcctggactatggggattacgaagacgagcgctattactacggaatggatgtgtggggccaggggacaaccgttacagtgagctctgcttccaccaaggga

SEQ ID NO: 42811 - RNA, 417 nt, synthetic construct
  misc_feature 1..417: note = derived and/or modified sequence opt5 from anti-HIV_Chain
  source 1..417: mol_type = other RNA
caggtgcaactggtcgagagcggcgccgaagttaagaaacccgggtcctctgtgaaggtgagctgcaaggcttccggaggcaccttcaacatctttgccttctcttgggtcagacaggcgcctgggcagggactcgagtggatgggcgggattatcccgatttttgctagccccaattacgcccagcggttccaaggacgcgtgacaatcacggccgacgaatccacctctacagttcacatggagctgagctcccttagaagcgaagataccgctatttattactgtgccaaagacgctcatatgcacatcgaggagcctcgggattatgactacatctggggcacatctccctattactttgattattggggccaggggaccctggtgacagtctccagcgcctctaccaaagga

SEQ ID NO: 42812 - RNA, 417 nt, synthetic construct
  misc_feature 1..417: note = derived and/or modified sequence opt5 from anti-HIV_Chain
  source 1..417: mol_type = other RNA
caggtgcaactggtcgagagcggcgccgaagttaagaaacccggggcttccgtgaaggtgtcttgcaaagccagcggatacaccttcacatcccacgacatcaactgggtcagacaggcgacgggccaggggctcgagtggatgggatggatgaatcctaactctggcgataccgggtatgctcataagtttcagggacgggtgacaatgacccgcaatacaccgattagcaccgcctacatggaactgtcctctcttagaagcgaggacacagccgtttattactgtgctcggggccgcgccacctccagaaacacgccctgggctcactattacgatagctctggctattacggggccggagactactggggccaagggaccctggtgacagtctccagcgcgtctaccaaagga

SEQ ID NO: 42813 - RNA, 417 nt, synthetic construct
  misc_feature 1..417: note = derived and/or modified sequence opt5 from anti-HIV_Chain
  source 1..417: mol_type = other RNA
caggtgcaaatcagacagagcggccccgggctggtcaagcctctcgagaccctgtccctttcttgcattgttttcggaggcagctttatcgcctaccactggacatggattcggcaggctccgctgaaagggctcgaatggatcggagacattgatcagggcggggacatcacgtattccccctctcttaagagccgcgtgaccatgtccgtggatagatctaaaagccaattctccctgaagctgagctctgtcacagccgcggacgctgccgtgtactattgtgttcggggacctcccaaccgctacgccgtgacctcctttacaagcggcacccatagagagcggtcttcctattacttcgattattggggccctgggacactcgtcaccgtgagctctgcttccacgaaagga

SEQ ID NO: 42814 - RNA, 423 nt, synthetic construct
  misc_feature 1..423: note = derived and/or modified sequence opt5 from anti-HIV_Chain
  source 1..423: mol_type = other RNA
aacggcgggagcctgagactctcctgccgggtgtctggattcggctttcacctgtacgagatgaattgggtccgccaggcccccgggaagggacttgaatggatcagctccatttctggcagcggggagtccacccattattctgacagcatcacaggaagattctccatgagccgggatgaagctaaagactctctgtacctccaaatgaacaatctgcgcgttgaggatacggccgtgtattactgtaccagaggcttttccatgggcgacgggacaggattcagctttgatacctggggccgggggacaatggtgaccgtctcttccggacttgacacagtgagcctggcgtctaccaagggcccttccgttttcccgctcgctccctgcagccgctccacgtctgatgccagactgagc

SEQ ID NO: 42815 - RNA, 423 nt, synthetic construct
  misc_feature 1..423: note = derived and/or modified sequence opt5 from anti-HIV_Chain
  source 1..423: mol_type = other RNA
caggtgcaactggtccagagcggcgccgaggttaagaaacccgggtcctctgtgaaggtgagctgcaaggcttccggaggcaccttctctacatacgccatcagctgggtcagacaggcgcctgggcagggactcgaatggatgggcgggattatcccgtccttttctatgagcaactatgctcaagacttccagggacggctgacgattaccgccgatgagtccacaagctctgtgtacatggaacttaattccctgcgcagcgaggacaccgccgtttattactgtgctagagattttccccggttccaccgcctcgtgggcaactatgacttttggagaggcacactggatcggttctcttacatggacctttgggggcgcggaaccgccgtcacagtgtccagcgcttctaccaaaggc

SEQ ID NO: 42816 - RNA, 423 nt, synthetic construct
  misc_feature 1..423: note = derived and/or modified sequence opt5 from anti-HIV_Chain
  source 1..423: mol_type = other RNA
ctggtgcagctcgtcgagagcggcgggggagttgtgcaacccggcagatccctgcggctttcttgcgccgctagcgggttcaccttttccacatacgccatgcactgggtgcgccaggcgcctggaaagggcctggaatgggtcgctgtgatctcttatgacgggagcaacaaattctacgccgattccgttaagggaagatttacgatttctcgggacaatagcaaaaacaccctctatctgcagatgaactcccttcgcgccgaggatacagctgtgtactattgtgccagaccgaagttcctgcccggcgctgacatcgtcgtggttgtggccgcgaccccttttgattactggggccaggggaatcccggacatcggctcctgagcttccaccaaggccctattgggctgccccctgga

SEQ ID NO: 42817 - RNA, 423 nt, synthetic construct
  misc_feature 1..423: note = derived and/or modified sequence opt5 from anti-HIV_HeavyChain
  source 1..423: mol_type = other RNA
atggagtggagcggcgtgttcatctttctgctctccgtcaccgccggggttcactctgaagtgcagctggtggagagcggaggcgggcttgtcaagcccggaggctccctgagactctcttgcgctgccagcgggtacacattctccaactattggattggatgggtgcggcaagcgcctggcaaaggcctggaatggatcggggacatttacccgggaggcaattatatccgcaacaatgagaagtttaaagataagacgaccctttctgctgacacaagcaaaaacaccgcctacctgcagatgaactccctcaagacagaagataccgccgtttattactgtgggagctctttcggatccaattatgtgtttgcttggttcacatactggggccaggggaccctggtcacggtgagctct

SEQ ID NO: 42818 - RNA, 423 nt, synthetic construct
  misc_feature 1..423: note = derived and/or modified sequence opt5 from anti-HIV_HeavyChain
  source 1..423: mol_type = other RNA
atggagtggagcggcgtgttcatctttctgctctccgtcaccgccggggttcactctcaggtgcaactggtgcagagcggacccgacgtcaagaaacctggcacatccatgaagatgtcttgcaaaacgagcgggtacaccttctccaactattggattggatgggtgagacaggctccgggccaggggcttgaatggatcggagatatttaccccggcggcaattatatccggaacaatgagaagtttaaagacaagacaaccctgacagccgatacctctacaagcaccgcgtacatgcaactcgggtccctgcgcagcgaagacacggctgtttattactgtggatcttccttcggcagcaactatgtgtttgcctggttcacctactgggggcagggaacacttgtcaccgtgtcttcc

SEQ ID NO: 42819 - RNA, 429 nt, synthetic construct
  misc_feature 1..429: note = derived and/or modified sequence opt5 from anti-HIV_Chain
  source 1..429: mol_type = other RNA
caggtgttcgtccaactggttcagagcggcgggggactcgtgcagcccggcgggtccgtgagactgtcttgcaccgccagcggatttcttttctccacatactctatgaactgggtccggcaggctcctggcaaggggctggagtgggtgagctccatctctacgaccagcaattatatttactatgccgactccgttaaaggacgctttacaatcagcagatctaacggccaaggctccctctacctgcagcttaatagcctgcgggtggaagataccgcggtctattactgtgctcgcgacacaaaggtgggggccccgagacaggattgctatgccatggacctctggggacagcgggatcacggccatcgcctgctgtctttccaccaagggcccattggactccctcccggcgctctgcttcag

SEQ ID NO: 42820 - RNA, 432 nt, synthetic construct
  misc_feature 1..432: note = derived and/or modified sequence opt5 from anti-HIV_Chain
  source 1..432: mol_type = other RNA
atcattctgttcctcgtggccaccgctacaggcgtccacagcgacatccagatgacgcaatccccctctagcctgtccgcctctgttggggatagagtgaccattacatgccgggcgagccagtccatcgaccgctaccttaactggtatcagcataagcctggaaaagctccgaagctgctcatttacgccgcctctaatctgcacaccgatgtgcccagcagattttccggcagcggggctggaacatatttcacccttacaatcacctctctgcagcctgaggactttgccacgtactattgtcaacagtcccatagcccctctttcggccaggaatcctacagcatcgcttttgggcagggaacccggctcgagattaaacgcacagtcgccgcgccttctgtgttcatctttcccccttccgatgaa

SEQ ID NO: 42821 - RNA, 432 nt, synthetic construct
  misc_feature 1..432: note = derived and/or modified sequence opt5 from anti-HIV_Chain
  source 1..432: mol_type = other RNA
ctgcagcaactccaggtgcccagactgagcatgtggcgggtcttcaaggttgccgctgccaccggcgcgcagacacttacggtggaggaacctgggtcctctgtgaaagtcagctgcaaggcttccggaggctctagcaccgcctacgggtattcctgggtgcgccaggccccgggacaaggctttgagtggatggggagaatcattcccttctacggaatcattacatatgctcctaaatttcagggccgggttaccatcacagccgaccgctctaccagcacagtgtacatggaactgacctccctcacgttcgctgataccgccctgtttttctgtgcgagagactttggcgatccccggaacgggtattacttcgacagctgggatcagggactttggctgacagtctcttccgccagcaccaagggc

SEQ ID NO: 42822 - RNA, 432 nt, synthetic construct
  misc_feature 1..432: note = derived and/or modified sequence opt5 from anti-HIV_Chain
  source 1..432: mol_type = other RNA
caggtgagactggagcaaagcggcgtcgccatgcggaagcccggggcttccgttaccctctcttgccaggccagcggatacaacttcgtgaaatatatcattcactgggtgcgccagaagcctggcctggggtttgaatgggtcggaatgatcgacccgtacagaggccggccctggtccgcgcataaattccaggggcgcctttctctgagcagagatacatccatggagattctctatatgacgctgacctctcttaagagcgacgatacagctacctacttttgtgcccgggccgaagctgcctccgacatccacagccgccctattatcctgacaggacccggcgagtatggcctcgatctggaacatatggactggacctggagaatcctgtgcctcctggctgtggcccctgggtgtcactctcaa

SEQ ID NO: 42823 - RNA, 435 nt, synthetic construct
  misc_feature 1..435: note = derived and/or modified sequence opt5 from anti-HIV_Chain
  source 1..435: mol_type = other RNA
atgttcctgtttctcgtggccggcgctaccggggtccagagccaagtttacctggtgcccttcggacctgaggtgaagaaaccgggctcctctgtcaaggtgagctgcaaagcctccggggactcttttacaagctccgttatcacgtgggtgagacaggcgcccggacagggccctgaatggatggggcgggtcattcccgtgcttggagttgctgcctatgcccagaagttctacggccgcgtgaccatcacagctgatacctctagcaacacagcctatatggaggtcaattccctgagatttgaagacaccgctgtgtactattgtgcccgggagacaggccgcgggggaaacctcgcgctgagacaatacttctttgatagctggggccaggggacccttgtgacggtctcttcccctagcaccaaagga

SEQ ID NO: 42824 - RNA, 438 nt, synthetic construct
  misc_feature 1..438: note = derived and/or modified sequence opt5 from anti-HIV_Chain
  source 1..438: mol_type = other RNA
caggtgcaactgcaggagagcggccccgggctcgtcaagccttccggaaccctgtctcttacatgcgccgttagcggcgcttccatctctagcagaaactggtggacgtgggtgcggcagccgcccgggaaaggactggaatggattggcgagatctacgaatccggggccaccaattataacccttctctcaagagccgcgtgacaatttccgtcgacaaaagcaagaatcagttctctctgagacttacctccgtgacagcggctgataccgccgtttacttttgtgcccggctgatgacattcggaggcctcatcggcaccctggactattgggggcaaggaacgctggtgaccgtcctccagccccctccccgcgctcacagataccatcctcggaacctgcttcaggagcacctgtgcgcccgcgtgatgccg

SEQ ID NO: 42825 - RNA, 444 nt, synthetic construct
  misc_feature 1..444: note = derived and/or modified sequence opt5 from anti-HIV_HeavyChain
  source 1..444: mol_type = other RNA
atggagtggagcggcgtgttcatctttctgctctccgtcaccgccggggttcactctgaagtgcagctggtggagagcggaggcgggcttgtcaagcccggaggctccctgagactctcttgcgctgccagcgggtacacattctccaactattggattggatgggtgcggcaagcgcctggcaaaggcctggaatggatcggggacatttacccgggaggcaattatatccgcaacaatgagaagtttaaagataagacgaccctttctgctgacacaagcaaaaacaccgcctacctgcagatgaactccctcaagacagaagataccgccgtttattactgtgggagctctttcggatccaattatgtgtttgcttggttcacatactggggccaggggaccctggtcacggtgagctctggagagtccctgaagcccctc

SEQ ID NO: 42826 - RNA, 444 nt, synthetic construct
  misc_feature 1..444: note = derived and/or modified sequence opt5 from anti-HIV_HeavyChain
  source 1..444: mol_type = other RNA
atggagtggagcggcgtgttcatctttctgctctccgtcaccgccggggttcactctcaggtgcaactggtgcagagcggacccgacgtcaagaaacctggcacatccatgaagatgtcttgcaaaacgagcgggtacaccttctccaactattggattggatgggtgagacaggctccgggccaggggcttgaatggatcggagatatttaccccggcggcaattatatccggaacaatgagaagtttaaagacaagacaaccctgacagccgatacctctacaagcaccgcgtacatgcaactcgggtccctgcgcagcgaagacacggctgtttattactgtggatcttccttcggcagcaactatgtgtttgcctggttcacctactgggggcagggaacacttgtcaccgtgtcttccggcgagagcctgaagcctctc

SEQ ID NO: 42827 - RNA, 447 nt, synthetic construct
  misc_feature 1..447: note = derived and/or modified sequence opt5 from anti-HIV_Chain
  source 1..447: mol_type = other RNA
caggccagactggaccaatggggcaccgggctcctgaagcccagcgagacactttccctgaaatgcgctgtgttcggagtcctctttacggattacaactggacctgggttcggcagtctcctggcaaggggctggaatggatcggacaccttgaccatcgcggcgggggaaattataacccgagcctggagtccagagtgacaatttctctcgattacagcaaagcccagttctccctgcacctgaagtctgtgaccgtcgcggacacagctctctattactgtgccggcgccgtgaaaggcttttggttcgatgaagtttataattggtttgggcccggagtgcgggagccttggctgcccagccctcagccccctccgcgcgctcatagatccagcccctggcaccctccccctcgggctccccttgtcaccgccacagtgccg

SEQ ID NO: 42828 - RNA, 447 nt, synthetic construct
  misc_feature 1..447: note = derived and/or modified sequence opt5 from anti-HIV_Chain
  source 1..447: mol_type = other RNA
caggccagactggaccaatggggcaccgggctcctgaagcccagcgagacactttccctgaaatgcgctgtgttcggagtcctctttacggattacaactggacctgggttcggcagtctcctggcaaggggctggaatggatcggacaccttgaccatcgcggcgggggaaattataacccgagcctggagtccagagtgacaatttctctcgattacagcaaagcccagttctccctgcacctgaagtctgtgaccgtcgcggacacagctctctattactgtgccggcgccgtgaaaggcctgtggtttgatgaaacctatacatggttcgggccctggagccagggaacccgggttacggtggcttccgccagcaccaagggcccttctgtctttccccttgctccttccagcaagtctacatccgggacccgcgacctgagc

SEQ ID NO: 42829 - RNA, 447 nt, synthetic construct
  misc_feature 1..447: note = derived and/or modified sequence opt5 from anti-HIV_Chain
  source 1..447: mol_type = other RNA
gccgctagactggaccagtggggcaccgggctcgtgaagcccagcgagacactgtcccttaaatgcgccgtcttcggagttgattttcctgactacacgtggacctgggcgcggcaagctccgggcaaggggctggaatggatcggacaccgcgatcatagaggcgggtctagctataacccctccctctctggacgggccacaattagcctggacacctccaaagcccagttctctcttcacatcaagagcgtgacagtggctgataccgccacatactattgtgctggcgccgtcgcgggcctgtggtttgaggacgcctacaattggttcgggccttggtcccagggaaccctcgtgacggttgctgccgctagcaccaaaggcccctctgtgtttcctctggccccctccagcaagtctacatccgggcatgcgagcgtcctg

SEQ ID NO: 42830 - RNA, 450 nt, synthetic construct
  misc_feature 1..450: note = derived and/or modified sequence opt5 from anti-HIV_Chain
  source 1..450: mol_type = other RNA
ctggcccagctcgagcaaagcggcgggggagtggtcaagcccggcgggtccctgagacttccttgcgctgcctctggattcacctttatcgactactatatggcgtggattcggctggctccgggcaaagggctcgaatggctgagctacatctccaagaacggagattatacaaaatactctgagagccttaagggccgcttcacgatttccagagacaatgccaaaaacctggttatcctccagctgaatcggctgcgcgccgatgacaccgctatttatttttgtgccagagctgatggcctcacatacttcggggaactgcttcagtatatctttgacctgtggggacagggcgcccgggtgatcgtgtctagcgcgtccaccaaggggcccagcgtcttccctctcgccccctcttccaagagcacatctggacacgcttccgtg

SEQ ID NO: 42831 - RNA, 459 nt, synthetic construct
  misc_feature 1..459: note = derived and/or modified sequence opt5 from anti-HIV_Chain
  source 1..459: mol_type = other RNA
caggtgcaactggtccagagcggcgccgaggttaagaaacccggggcttccgtgaaggtgtcttgcaaagtcagcggatacaccctcacagaactgtccatccactgggtgagacaggcccctggcaaggggcttgagtggatgggaggcttcgactctgaagatggggaggcgatttataaacagaactttcaaggacgggttacgatgaccgaagacacaagcaccgatacagcttacatggagctgtcccgcctcagatctgaggacaccgccgtgtattactgtgccacagctgatcggttcaaggtcgcccaggacgaaggcctgtttgtgatcttcgattattggggccaggggaatccgggacatcgccttctgagcctccaccagggccccattgggctgcctcccggaaccctgcctcccaaggctacgtccggccatgccgcgagacgg

SEQ ID NO: 42832 - RNA, 462 nt, synthetic construct
  misc_feature 1..462: note = derived and/or modified sequence opt5 from anti-HIV_Chain
  source 1..462: mol_type = other RNA
ctggtgcagctcgtccaaagcggcgccgaggttaagaaacccggggcttccgtgaaggtgtcttgcaaagtcagcggatactccctgaccgaactttctatccactgggtgagacaggcccctggcaaggggctggagtggatgggaggcttcgacagcgaagatggggaggcgatttataaacagaactttcagggacgggttacaatgacggaagacacctccacagataccgcttacatggagctctctcgcctgagaagcgaggacacagccgtgtattactgtgccaccgctgatccgttcaaggtcgcccaagacgaaggcctttttgtgatcttcgattattggggccaggggacaaccggacatcggctgctctccctgcaccagggcccccatcgcctgtacagcctcgggacgctgctttctagagctcctattgttcagacccacatggcc

SEQ ID NO: 42833 - RNA, 471 nt, synthetic construct
  misc_feature 1..471: note = derived and/or modified sequence opt5 from anti-HIV_Chain
  source 1..471: mol_type = other RNA
cagatccacctggtgcaaagcggcaccgacgtcaagaaacccgggtcctctgttacagtgagctgcaaggcctacggagtgaacacgttcggcctctatgctgtcaattgggtgagacaggcccctgggcagtccctggagtacattggacagatctggcggtggaaatctagcgcgtcccatcactttcgcggcagagttcttatttctgctgtggatctgaccgggagctccccgcccatcagctctctcgaaattaagaacctgacatccgacgataccgccgtctatttctgtacaaccacaagcacctacgaccaatggtctggacttcatcacgatggcgtgatggccttttccagccggggccaggggacgctgatctctgtttccgctgccagcaccaaaggaccttccgtgttccccctcgctccttctagcaagtccacatatggcctggcccatgtcctg

SEQ ID NO: 42834 - RNA, 477 nt, synthetic construct
  misc_feature 1..477: note = derived and/or modified sequence opt5 from anti-HIV_Chain
  source 1..477: mol_type = other RNA
cagcaccaactggtgccctgcgtcgccgaggttagaaagcctggcgctagcgtgaaagtgtcctgtaaggtctctgggtacaccctcacagaaatcagcatgcattgggtgcggcaggccccgggaaaaggcctggagtggatgggagggttcgaccgcgaagatggcgagacgatttatgcgcagaagtttcaggggagagttaccatgacagaagacacctccacagataccgcttacatggagctttctagcctgcggtccgaggacacagccgtgtattactgcgccaccacgtatctcgctgtcgtgcccgatggattcgacggctactctagctcctggtattggtttgatccttggggccaagggaccctggttacagtgagctctgcctccatgcagggacccatgcttctgagccctaccggcacactcctgccccgcgctcctctggtccagaccagaccggggccc

SEQ ID NO: 42835 - RNA, 642 nt, synthetic construct
  misc_feature 1..642: note = derived and/or modified sequence opt5 from anti-HIV_LightChain
  source 1..642: mol_type = other RNA
gacatcgtgattacccagagcacaaagttcatgtccacgtctgtcggcgatagagttagcattacctgcaaagcctcccaagacgtgtctacagctgtggcctggtaccagcagaagcccgggcagagccctaaactgctcatctattgggcgtccacccggcacacaggagtcccggatcgctttaccggctctgggagcggaacagactacaccctgacgatctccagagtgcaagctgaggatcttgccctgtattactgtcagcagcattataccacaccctggaccttcggcgggggaacaaagctcgaaattaaacggaccgttgccgctcctagctttgtgatctttcccccttctgacgagcagctgaagtccggcacggccagcgtcgtgtgccttctgaacaatttctacccccgcgaagctaaggttcaatggaaagtggataacgccctccagtctggcaattcccaggagagcgtcacagaacaggactctaaggattccacctatagcctgtcctctacactgaccctcagcaaagcggactacgagaagcacaaagtgtacgcctgtgaggtgacccatcaagggctgtccagccctgtcacaaagtctttcaacagaggagaatgc

SEQ ID NO: 42836 - RNA, 651 nt, synthetic construct
  misc_feature 1..651: note = derived and/or modified sequence opt5 from anti-HIV_Chain
  source 1..651: mol_type = other RNA
cagagcgtgctgacccaacccccttccgtctctgccgctccgggccagaaggttacaatcagctgctccgggtctagctccaacattggaaataactacgtgctctggtatcagcagttccccggcacggcccctaaactgcttatctacgggaataacaagagaccctctggcattcctgaccggtttagcggatccaaaagcgggacctctgcgacactgggaatcaccggcctccaaacaggcgatgaggctgactatttctgtgccacctgggattccgggctgagcgccgactgggtgtttggaggcgggacaaagctcaccgtcctgtctcagcccaaagctgccccttccgtgacgcttttcccgcccagctctgaggaactgcaggctaataaggccaccctggtttgcctcatttccgatttttaccctggagcggtgacagtcgcctggaaggctgacagctcccccgtgaaagccggcgttgaaaccacaaccccttctaagcagagcaacaataaatatgctgcctccagctacctgtctcttacgcccgagcaatggaagtcccaccgcagctattcttgtcaggtgacacatgaagggagcaccgtcgagaaaacagtggcgccgaccgagtgctcc

SEQ ID NO: 42837 - RNA, 657 nt, synthetic construct
  misc_feature 1..657: note = derived and/or modified sequence opt5 from anti-HIV_Chain
  source 1..657: mol_type = other RNA
gacatcgtgatgacccagagccccgattccctggccgtctctctcggcgagagagttacaatgaactgcaagagctcccaatctctgctttacagcacgaatcagaaaaactatctggcttggtaccagcagaagcctgggcaatccccgaaactcctgatttattgggccaattctaccgaaagcggagtgcccgaccggttctccggcagcgggtctggaacagattttacccttacaatctccagcgtgcaggcggaggacgtcgctgtgtactattgtcagcagtactattcttaccgcaccttcggcgggggaacaaagctggaaattaaaagaaccgttgccgccccttccgtgtttatctttccccctagcgatgagcaactcaagtctggcacggcttccgtcgtgtgcctgctgaacaatttctacccccgggaagccaaggttcagtggaaagtggacaacgctctccagagcggcaattcccaggagtctgtcaccgagcaagatagcaaggactccacatatagcctgtcttccacccttacactgagcaaagccgattacgaaaagcacaaagtgtatgcgtgtgaggtgacccatcaggggctctctagccctgtcacgaagtccttcaaccgcggagaatgc

SEQ ID NO: 42838 - RNA, 753 nt, synthetic construct
  misc_feature 1..753: note = derived and/or modified sequence opt5 from anti-HIV_SingleChain
  source 1..753: mol_type = other RNA
atgcaagtgcagctggagcagagcggcgccgaagtcaagaaacccggggcttccgttaaggtgtcttgccaggccagcggatacagattctccaactttaccgtgcactgggtccggcaggcgcctggccaacgcttcgagtggatggggtggatcaatccgtataacggaaataaagaattttctgctaagttccaggacagagtgacatttacggccgataccagcgccaacacagcttacatggagctccggtccctgcgctctgccgacaccgctgtttattactgtgccagagtgggcgaatgggggtgggatgacagcccccaggataattattacatggacgtctggggaaaaggcacaaccgtgattgtttccagcggcgggggaggctctgggggaggcgggtccggaggcggcgggagcgatatcgagcttacacagtctcctggaaccctgtccctcagccccggcgagcgggcgacgttctcttgccgctccagccattccattagatctcggcgcgtggcctggtatcaacacaagcctgggcaggctcccagactggtcatccatggagtgagcaaccgggcctccggcattagcgaccgcttttctgggtccggaagcggcaccgatttcacacttaccatcacaagagtggaacctgaggactttgctctgtactactgtcaggtctatggcgcctctagctacaccttcgggcagggaacgaagctcgaacggaaa

SEQ ID NO: 42839 - RNA, 1338 nt, synthetic construct
  misc_feature 1..1338: note = derived and/or modified sequence opt5 from anti-HIV_LightChain
  source 1..1338: mol_type = other RNA
gaggtgaagctggaagagagcggcgggggactcgtccagcccggcgggtccagaaaactgtcttgcgccgctagcggattcaccttttcctctttcggcatgcactgggttcggcaagcccctgaaaaggggcttgagtgggtggcgtacatcagctccggatctagcacactgcattatgctgacacggtgaaaggccgctttaccatttccagagataacccgaagaatacactcttcctgcagatgaaacttcccagcctgtgttacggcctcctggggtctcggaacctgtcccaccgcctcctgagccagaatgacacccctatctgccttacagtctcttccgccagcaccaagggaccctctgtgtttcctctggccccctccagcaagtccacatctggcgggaccgctgccctcggatgtctggttaaagattatttccctgaaccggtgacggtcagctggaactccggcgctcttaccagcggggtgcatacatttcccgccgttctgcagtcttccggactctacagcctgtctagcgtggtcaccgtgccttcctctagcctgggcacacaaacctatatttgcaatgtgaaccacaagccctccaatacgaaagtcgacaagaaagttgagcctaagagctgtgataagacacatacctgtcccccgtgccctgcgcccgagctcctgggcgggccttctgtgttcctttttcctcccaaacccaaggacacactgatgatctccagaaccccggaagtgacctgcgtcgtggttgatgtgagccacgaggaccccgaagtcaaattcaactggtacgtggatggagttgaggtgcacaatgccaagacaaaacctcgggaggaacagtataactctacgtaccgcgtcgtgtccgtcctcaccgtgctgcatcaggactggcttaatggcaaggagtacaaatgtaaggttagcaacaaggctctgcccgcccctattgaaaagacaatctccaaggctaaagggcagcccagagagccgcaagtgtataccctccctccctctcgggaagagatgacaaagaatcaggtcagcctgacctgcctggtgaaaggattttacccttccgatatcgccgttgagtgggaatctaacggccagcccgagaataactataagacgacacctcccgtgctcgacagcgatgggtccttctttctgtacagcaaacttaccgtcgacaaatctcgctggcagcaaggaaacgtgttctcctgtagcgtgatgcacgaagcgctgcataatcactatacccagaagtctctctccctgagcccgggcaaa

SEQ ID NO: 42840 - RNA, 1380 nt, synthetic construct
  misc_feature 1..1380: note = derived and/or modified sequence opt5 from anti-HIV_Chain
  source 1..1380: mol_type = other RNA
gaggtgcaactggtcgaaagcggcgggggactcgttaagcccggcgggtccctgagacttacctgcgtggcctctggattcacatttagcgacgtgtggctgaactgggtccggcaagctcctggcaaagggctcgagtgggtgggacgcatcaagtccagaacggatggcggcaccacagactacgccgcgtctgttaaagggcggttcaccattagccgcgatgactccaagaatacactgtatcttcagatgaactctctgaaaaccgaagatacagctgtgtacagctgtaccacggacggatttatcatgattagaggcgtctccgaggattattactattactatatggacgtgtgggggaagggaaccacagttaccgtgagctctgcctccacaaagggcccgagcgtcttccccctcgccccttcttccaaaagcacctctgggggaacggctgccctgggctgcctggtgaaggattactttcccgaacctgtgacagtctcctggaatagcggcgctctcacctccggggttcacacattccccgccgtgctgcagtctagcggactttactccctgagctctgtggtcaccgtgccttccagctctctcggcacccagacatatatctgtaacgttaatcataaaccgagcaacacgaaggtggacaaaaaggtcgagcccaagtcctgcgataaaacccacacatgtcctccctgccctgcgcccgagctgcttgggggaccgtctgtgtttctgttccctcccaagcctaaagacaccctcatgattagccggacacccgaagttacctgtgtggtcgtggatgtctcccatgaggaccccgaagtgaagtttaattggtacgttgacggcgtggaggtccacaacgccaaaacgaagcctcgcgaggaacaatataatagcacatacagagtggtttctgtgctgaccgtcctgcatcaggattggctcaacgggaaagagtataagtgcaaggtgtccaataaagctctgccggcccccatcgaaaagaccatcagcaaagctaagggacagcctcgggagccccaggtgtacacacttcctccctctcgcgacgaactgaccaaaaaccaagtttccctcacatgtctggtcaagggcttctatccgagcgatattgccgtggagtgggagtccaatggccagcctgaaaacaattacaagacgacaccccctgtgcttgactctgatgggagctttttcctgtactccaaactcaccgtcgacaagtctagatggcagcagggaaacgtgtttagctgctccgttatgcacgaggcgctgcacaaccattatacccagaaaagcctgtctctctcccccggc

SEQ ID NO: 42841 - RNA, 1413 nt, synthetic construct
  misc_feature 1..1413: note = derived and/or modified sequence opt5 from anti-HIV_Chain
  source 1..1413: mol_type = other RNA
atggagtggagcggcgtgttcatgtttctgctctccgtcaccgccggggttcactctcaggtgcaactgcagcagagcggacccgaagtggtcaagcctggcgcttccgtgaaaatgtcttgcaaggccagcgggtacacattcacgtcctatgttatccattgggtgagacagaaaccgggacaaggccttgactggattgggtacatcaacccctataatgatggaaccgactacgatgagaagtttaaaggcaaggcgacactgacctctgacacaagcacctccacagcttatatggaactcagctctctgcggtccgaggataccgccgtctactattgtgcccgcgaaaaggacaactacgctacgggcgcctggttcgcttactgggggcagggaacccttgtgacagttagctctgcctccaccaaaggccctagcgtgtttcccctggcgccttcttccaagagcacatccgggggaaccgccgctctcggctgcctggtcaaagattatttccccgagcctgtgacggtgtcttggaatagcggggccctgacatccggagtccacacctttccggctgttctccagagctctggcctgtactcccttagctctgtggtgacagtccccagctcctctctgggcacccagacctatatttgtaacgtgaatcataagcctagcaacacaaaagttgacaagaaggtggagcccaaatcctgcgataagacgcacacctgtcctccctgcccggcccctgagttcgaagggggacccagcgtctttctcttccctcccaaacccaaggacacactgatgatctctagaacccctgaagtgacatgtgttgtggtcgatgtgtcccatgaggacccggaggtcaaatttaattggtacgtggatggcgttgaagtgcacaacgcgaagaccaaaccccgggaggaacaatataatagcacgtaccgcgtcgtgtctgttcttacagtgctgcaccaggactggctcaacgggaaggagtataagtgcaaagtctccaataaggccctgcctgctagcattgagaaaaccatctccaaggccaaaggacagcccagagaacctcaggtgtacaccctgcccccgtctcgggacgagctcacaaagaaccaagtgagcctgacctgtcttgttaagggcttctacccttccgatatcgctgtcgaatgggagtctaatgggcagcccgaaaacaattataaaacaacgcctcccgtgctggacagcgatggatcctttttcctctacagcaagctgaccgtggacaaatctcgctggcagcaaggcaacgtcttctcctgcagcgtgatgcatgaggcccttcacaaccattatacacagaagtctctgtccctcagccctggcaaa

SEQ ID NO: 42842 - RNA, 645 nt, synthetic construct
  misc_feature 1..645: note = derived and/or modified sequence opt5 from anti-influenza_Fab
  source 1..645: mol_type = other RNA
atcgtgctgacccagagccccgccacactctccgtctctcctggcgagagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaacccgaagattttgccgtgtattactgtcagcattattctaattggcctccccgcctgacattcgggggaggcaccaaagtggagattaagagaacggtcgctgccccttccgtgtttatcttcccgcccagcgacgaacagctcaaatctggcaccgcgtccgttgtgtgcctgctgaacaatttttaccctcgggaggccaaggtccagtggaaagtggataacgctctccaaagcgggaatagccaggaatccgttacagagcaggacagcaaggattccacctattctctgagctccacacttaccctgagcaaggccgactacgagaaacacaaggtgtacgcttgtgaagtcacgcatcagggactctcttcccccgtgacaaaatctttcaaccgcggcgagtgc

SEQ ID NO: 42843 - RNA, 681 nt, synthetic construct
  misc_feature 1..681: note = derived and/or modified sequence opt5 from anti-influenza_Fab
  source 1..681: mol_type = other RNA
gtgcagctggtcgagagcggcgggggagttgtgcaacccggcaagtcccctagactctcttgcgccgctagcgggccgaccttctcctcttacgccgtgcactgggtccggcaggcgcccggaaaaggcctggaatgggtgacacttatcagctatgacggggctaaccagtactatgccgattccgttaagggacgctttacgatttctagagacaatagcaaaaacaccgtgtacctgcagatgaactccctccggcctgaggatacagccgtctattactgtgctgtgcccggccctgttttcggcatctttcccccttggagctatttcgacaattgggggcaaggcattctggtgaccgtctcttccgccagcacaaagggaccgtctgtgtttccccttgctccttccagcaaatctacctccgggggaacagccgcgctgggctgcctcgtgaaggattacttccccgaacctgtcaccgttagctggaactccggggccctgacgtctggagtgcatacctttcccgctgtgctgcagagctccggcctctacagcctgtcttccgtcgtgacagttccgagctctagccttggcacccagacatatatctgtaatgtgaatcacaagccttccaacaccaaagtcgacaagaaagtggagcccaagtcttgc

SEQ ID NO: 42844 - RNA, 1515 nt, synthetic construct
  misc_feature 1..1515: note = derived and/or modified sequence opt5 from anti-influenza_Fab
  source 1..1515: mol_type = other RNA
gccggcagcaccgctacactgtgcctcgggcaccatgccgtgcccaacggaacgatcgtcaagaccattacaaatgaccagatcgaggttaccaacgcgacagaactggtgcaatcctctagcaccggcgagatttgtgattcccctcaccagatccttgacgggaaaaattgcacactgattgatgctctcctgggagacccgcagtgtgatggcttccagaacaagaaatgggacctttttgtggaaagatctaaggcctacagcaattgctatccctacgatgtccctgactatgcctccctgcggtctctcgtggctagctccgggaccctggagttcaacaatgaatcctttaactggacgggagttacccaaaatggcacatcttccgcctgtatccgcagaagcaaaaactctttcttttcccggctgaattggctcacccatctgaacttcaagtaccccgctcttaatgtgacaatgcctaacaatgagcagtttgataagctgtatatctggggcgtccaccatcccgggaccgacaaagatcagattttcctctacgcccaggcgagcggacgcatcacggtgtctacaaagagatcccaacagaccgttagccctaacattggctcccggccgcgcgtgagaaacatcccctctcggattagcatctattggacaattgtcaaacctggggacatcctgcttatcaattccaccggaaacctgattgctccccgcggctactttaagatcagaagcgggaaatcttccattatgcggagcgatgcccctatcggaaagtgcaattctgagtgtattacccccaacggcagcatcccgaatgacaagcctttccagaacgtgaatcgcatcacatacggcgcctgccccagatatgtgaaacagaacacgctcaagctggctaccgggatgcggaatgtccctgaaaaacaaacacgcggaatttttggcgccatcgcggggttcattgagaacggatgggaaggcatggttgacgggtggtacggatttagacaccagaatagcgagggccggggccaggccgctgatctgaagtctacccaagccgctatcgaccagattaacgggaaactcaatagactgatcggaaagacaaacgagaaattccaccagatcgaaaaggagttcagcgaagtggagggccgcattcaggatcttgaaaagtatgtggaggacaccaaaatcgatctgtggtcctacaatgccgagctcctggtcgcccttgaaaaccaacatacgattgacctgacagatagcgagatgaacaagctctttgagaaaaccaagaaacagctgcgggaaaatgctgaagacatggggaacggatgtttcaagatctatcacaagtgcgataatgcgtgtattggctctatcagaaacgggacctacgaccatgatgtgtatcgcgacgaggccctgaataaccggtttcagattaaaggctccggaagactcgttccccgc

SEQ ID NO: 42845 - RNA, 657 nt, synthetic construct
  misc_feature 1..657: note = derived and/or modified sequence opt5 from anti-influenza_Fab
  source 1..657: mol_type = other RNA
caggtgcaactggtccagagcggcgggggagttgtgcagcccggcagatccctccggctgtcttgcgccgctagcgagttcacctttcgcatgtacgccacacactgggtgagacaggcgcctgggaagggacttgaatgggtcgctctgatctcctatgacggctctaacaaatactatgccgatagcgtgaaggggcggttcacgatttcccgcgacaattctatgaacaccgtttacctccaaatgaatacactgagaccggaggataccgccgtgtattactgtgctcgggaccttggaggctattttatccgcggcattatggatgtctgggggcagggaacactggtgaccgttagctccgccagcacaaaaggcccctctgtgttccctctcgctccctccagcgggggaaccgccgcgctgggctgcctggtcaaggactactttcctgaacccgtgacggtgtcttggaactccggggccctcaccagcggagtccatacattccctgctgttctgcagtcttccggcctttacagcctgtcctctgtggtgaccgtcccgagctccagcctcggcacacagacctatatctgtaatgtgaaccacaaaccctctaatacgaaggttgataagagagtggagcctaaa

SEQ ID NO: 42846 - RNA, 642 nt, synthetic construct
  misc_feature 1..642: note = derived and/or modified sequence opt5 from anti-influenza_Fab
  source 1..642: mol_type = other RNA
gagctgcagatgacccaaagccccagctctgtgagcgcctccgtcggcgacagagttacaatcacgtgccgggcttctcaggggattagctcctggctcgcctggtaccagcagaagcctggaaaagcgccgaagctgcttatctatgctgcctctagcctgcaatccggcgtgcccagccgcttctctgggtccggaagcggcaccgattttacactcaccatttcttccctgcagcctgaagacttcgccacatactattgtcagcaggctaacagctttccccttaccttcgggggaggcacaaaagtggagatcaagagaaccgtcgccgctccttctgtgtttatttttcccccttccgatgaacaactgaaaagcggcacggcctccgttgtgtgcctcctgaataacttctacccgcgggaggcgaaggtccagtggaaggtggacaatgccctgcagtctgggaacagccaggaatccgttaccgagcaagatagcaaagactctacatattccctcagctctaccctgacacttagcaaggctgattacgagaaacacaaggtgtatgcctgtgaagtcacccatcagggactgtcctctcccgtgacgaaatccttcaatcgcggcgagtgc

SEQ ID NO: 42847 - RNA, 993 nt, synthetic construct
  misc_feature 1..993: note = derived and/or modified sequence opt5 from anti-influenza_Fab
  source 1..993: mol_type = other RNA
gccgaccccggcgataccatctgcattgggtaccacgctaacaatagcacagacacggtggataccgtcctggagaagaacgttacagtgacccattccgtgaatctcctggaagactctcacaacggaaaactttgtaagctgaaaggcatcgcccctctccagctggggaagtgcaatattgcgggatggcttctgggcaacccggagtgtgatctcctgctgacagctagctcctggtcttatatcgtcgaaaccagcaattccgagaacgggacatgctaccccggagacttcattgattatgaggaactcagagagcaactgtctagcgtgtccagctttgaaaaattcgagatctttcctaagacctcttcctggcccaatcatgaaacgaccaagggcgttacagccgcctgtagctacgctggcgcctcttccttctatcggaaccttctgtggctcaccaaaaaggggagctcttaccctaaactgtccaagagctatgtgaataacaaaggaaaggaggtccttgtgctgtggggcgttcaccatccccctacagggaccgaccagcagtccctctaccagaatgctgatgcctacgtgtctgtcggaagctccaagtataaccgcagatttacgccggagatcgcggcccggcccaaagtgcgcgaccaagctggcagaatgaattactattggacactgctggaacctggggataccattacattcgaggccaccggaaacctcatcgctccctggtacgcctttgcgctgaaccggggcagcggctctgggattatcacctccgacgcccctgtgcacgattgcaatacaaagtgtcagacgccccacggagctattaacagctctcttccgttccagaatatccatcctgtcaccattggcgaatgccccaaatatgttcgcagcacaaagctgagaatggccaccgggctccggaacatcccttccatccagtctcgc

SEQ ID NO: 42848 - RNA, 537 nt, synthetic construct
  misc_feature 1..537: note = derived and/or modified sequence opt5 from anti-influenza_Fab
  source 1..537: mol_type = other RNA
ggcctgttcggggccatcgctggatttattgagggcgggtggaccggaatgatcgacggctggtacgggtatcaccatcagaacgaacaaggaagcggctacgccgcggatcagaagtccacacagaatgctattgacggcatcacgaacaaagtcaattctgtgattgagaagatgaacacccagttcacagccgttgggaaagaatttaataacctcgagagacggatcgaaaatctgaacaagaaagtggatgacggattccttgatatctggacctataatgccgagctgctcgtgctgcttgagaacgaacgcacactggactttcacgatagcaatgtcagaaacctctacgagaaggtgaagtcccaactgaaaaataacgctaaggaaattggcaatgggtgcttcgagttttatcataaatgtgacgatgcctgcatggagtctgttcggaacggaacctacgactatcccaagtacagcgaagagtccaaactgaaccgcgaagagatcgatggcgtgtctgggaga

SEQ ID NO: 42849 - RNA, 642 nt, synthetic construct
  misc_feature 1..642: note = derived and/or modified sequence opt5 from anti-influenza_Apo
  source 1..642: mol_type = other RNA
cagagcgtgctgacccaacccccttccgtctctgttgccccgggccagacagctagaatcacgtgcgggggaaacgacattggccgcaagagcgtgcactggaatcagcagaaacccgggcaagcccctgtgctcgtcgtgtgttacgattccgaccggccctctggaatccctgagagattcagcggctccaactctgggaataccgcgacactgaccattagccgggttgaagctggagatgaggccgactattactgccaggtgtgggattccagctctgaccatgtcatctttggcggcgggacaaaacttaccgtgctgggacagcccaaagccgctccttccgttacactcttcccgcccagctctgaggaactgcaggccaacaaggctacccttgtgtgtctgatttccgatttttatcctggcgccgtcacggtggcgtggaaagccgacagctctcccgtgaaggctggggtcgaaaccacaaccccttccaagcaaagcaataacaaatacgccgcttcctcttatctcagcctgacacccgagcagtggaagtcccaccgcagctactcttgccaggttacccatgagggatccacggtggaaaagacagtggccccgaccgagtgtagc

SEQ ID NO: 42850 - RNA, 687 nt, synthetic construct
  misc_feature 1..687: note = derived and/or modified sequence opt5 from anti-influenza_Apo
  source 1..687: mol_type = other RNA
gaggtgcagctggtccaaagcggcgccgaagttaagaaacccggggcttccgtgaaggtgtcttgcaaagccagcggatacaccttcacagactatcacatcaactgggtcagacaggcgcctggccaggggctcgagtggatgggatggattcatcccaattccggcgatacgaactacgctcagaagtttcaagggtgggtgaccatgacacgggacaccgccatctctacagcctatatggaagttaatggactgaaaagcgatgacaccgctgtgtactattgtgcccgcggcggccttgagccgagatccgtcgattactattactacgggatggacgtgtggggacagggcacaaccgttacggtgtctagcgcttccaccaaggggcctagcgtcttccccctggccccttcttccaagagcacatctggaggcaccgcggccctcgggtgcctggtgaaagattattttcccgaacctgtgacagtctcctggaacagcggagctcttacctctggcgttcacacgttcccggccgtgctgcagtccagcggcctctactccctgtctagcgtggtcacagtgccctccagctctctggggacccagacatatatttgtaatgttaaccataagccttccaataccaaagtggacaagcgggtcgagcccaaaagctgc

SEQ ID NO: 42851 - RNA, 333 nt, synthetic construct
  misc_feature 1..333: note = derived and/or modified sequence opt5 from anti-influenza-A_kappa_LightChain_V-Region
  source 1..333: mol_type = other RNA
gacatcgtgatgacccagagccccgattccctggccgtctctctcggcgctagagccacaattaactgcaagagctcccaatctgttacgttcaattacaaaaactatctggcgtggtaccagcagaagcctgggcagccgcccaaagtgcttatctattgggctagcgcccgggagtccggagtgcctgaccgcttttctggcagcgggtccggaaccgatttcacactgaccattagctctctccaagccgaagacgtcgctgtgtactattgtcagcagcactacagaacaccccctacctttggccaggggacaaaggttgagatcaaa

SEQ ID NO: 42852 - RNA, 333 nt, synthetic construct
  misc_feature 1..333: note = derived and/or modified sequence opt5 from anti-influenza-A_kappa_LightChain_V-Region
  source 1..333: mol_type = other RNA
gacatcgtgatgacccagagccccgattccctggccgtctctctcggcgagagagctacaattaactgcaagagctcccaatctgttagctccaataacaaaaattacctggcctggtatcagcagaagcctgggcagccgcccaaagtgcttatctactgggcgtctgctcgggaaagcggagtgcctgaccgcttctccggcagcgggtctggaacggattttaccctgacaatttccagcctccaagccgaggacgtcgccgtgtattactgtcagcagcactatagaacaccccctaccttcggccaggggaccaaggttgaaatcaaa

SEQ ID NO: 42853 - RNA, 333 nt, synthetic construct
  misc_feature 1..333: note = derived and/or modified sequence opt5 from anti-influenza-A_kappa_LightChain_V-Region
  source 1..333: mol_type = other RNA
gacatcgtgatgacccagagccccgattccctggccgtctctctcggcgagagagctacaattaactgccggagctcccaatctgttagctccaataacaagaatttcctggcctggtaccaggaaaaacctgggcagccgcccaaggtgcttatctattgggcgtctgctcgcgagagcggagtgcctgacagattttccggcagcgggtctggaacggatttcaccctgacaatttccggcctccaggccgaagacgtcgccgtgtactattgtcaacagcactaccggacaccccctacctttgggcagggaaccaaagttgagatcaag

SEQ ID NO: 42854 - RNA, 333 nt, synthetic construct
  misc_feature 1..333: note = derived and/or modified sequence opt5 from anti-influenza-A_kappa_LightChain_V-Region
  source 1..333: mol_type = other RNA
gacatcgtgatgacccagagccccgattccctggccgtctctctcggcgagagagctacaattaactgcaagagctcccaatctgttacgttcaattacaaaaactatctggcctggtaccagcagaagcctgggcagccgcccaaacttctgatctattgggcgagcacccgggaatccggagtgcctgaccgcttttctggcagcgggtccggaacagatttcaccctcacaattagctctctgcaagctgaggacgtggccgtctactattgtcagcagcactacagaacaccccctacctttggccaggggaccaaggtggaaatcaaa

SEQ ID NO: 42855 - RNA, 339 nt, synthetic construct
  misc_feature 1..339: note = derived and/or modified sequence opt5 from anti-influenza-A_kappa_LightChain_V-Region
  source 1..339: mol_type = other RNA
gacatcgtgatgacccagagccccgattccctggccgtctctctcggcgagagagctacaattaactgcaagagctcccaatctgttctgtacagctccaataacaaaaattatcttgcctggtaccagcagaagcctgggcagccgcccaaactgctcatctattgggcgtctacgcgggaaagcggagtgcctgaccgcttctccggcagcgggtctggaaccgattttacactgaccatttccagccttcaagctgaggacgtggccgtctactattgtcagcagtactattctacaccccctaccttcggccaggggacaaaggtggaaatcaaa

SEQ ID NO: 42856 - RNA, 333 nt, synthetic construct
  misc_feature 1..333: note = derived and/or modified sequence opt5 from anti-influenza-A_kappa_LightChain_V-Region
  source 1..333: mol_type = other RNA
gacatccagatgacccaaagccccgattccctggccgtgtctctcggcgctagagccacaattaactgcaagagctcccagtctgtcacgttcaattacaaaaactatctggcgtggtaccagcagaagcctgggcaaccgcccaaagttcttatctattgggctagcgcccgggagtccggagtgcctgaccgcttttctggcagcgggtccggaaccgatttcacactgaccattagctctctccaggccgaagacgtggctgtctactattgtcagcagcactacagaacaccccctacctttggccaagggacaaaggtggagatcaaa

SEQ ID NO: 42857 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatgctgattctgttaagggcagattcacaattagccgggacaattccaaaaacacgctgtacctccagatgaatagcctgcgcgccgaggataccgccgtgtattactgtgctaaggactctcaacttagatccctgctctattttgattggctgagccagggctacttcgactactgggggcagggaacactggtcaccgtgtcttcc

SEQ ID NO: 42858 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtccagagcggcgggggagttgtgcagcccggcagatccctccggctgtcttgcgtggccagcgggttcaccttttccacatacgctatgcactgggtccgccaggcccctggaagaggccttgagtgggtggcggttatctcttatgacgggaactacaagtattacgctgatagcgtgaaaggacggttctccatttctcgcgacaatagcaacaatacgctgcatctcgaaatgaacaccctgagaacagaggataccgccctttattactgtgccaaggactcccaactgcggagcctcctgtattttgaatggctgtctcagggctacttcgatccgtggggccaggggacactcgtcaccgtgtccagc

SEQ ID NO: 42859 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtccagagcggcgggggagttgtgcagcccggcagatccctccggctgtcttgcgccgctagcgggttcaccttttccacatacggaatgcactgggtgcgccaggcccctggcaaggggcttgagtgggtcgcggtgatctcttatgacggaaactacaaatattacgctgatagcgttaagggcagattcacgatttcccgggacaattctaaaaacaccctgtatctcgaaatgaatagcctgcgcacagaggataccgccctttactattgtgccaaggactcccaactgagaagcctcctgtactttgattggctgtctcagggctacttcgaccattgggggcagggaacactcgtgaccgtctccagc

SEQ ID NO: 42860 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtccagagcggcgggggagttgtgccccctggcagatccctccggctgtcttgcgccgctagcgggttcaccttttccacatacggaatgcactgggtgcgccaggccccgggcaaggggcttgagtgggtcgcggtgatctcttatgacggaaactacaaatattacgctgatagcgttagaggccggttcacgatttcccgcgacaattctaagaacaccctgaatctcgatatgaacagcctgagaacagaagacaccgccctttattactgtgccaaagattcccagctgcggagcctcctgtattttgactggctgtctcaaggctacttcgatcattgggggcagggaacactcgtgaccgtctccagc

SEQ ID NO: 42861 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctgtgatctcttatgacgccaactacaaatattacgccgatagcgttaaggggagattcacgatttcccgggacaattctaaaaacaccctgtatctccagatgaatagcctgcgcgctgaggatacagccgtgtactattgtgctaaggactcccaacttagaagcctgctctactttgaatggctgtctcagggatacttcgattattggggccagggcaccctggtcacagtgtccagc

SEQ ID NO: 42862 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtcgagagcggcgggggagttgtgcagcccggcagatccctccggctgtcttgcgccgctagcgggttcaccttttccacatacgccatgcactgggtgcgccaggcgcctggaaagggccttgaatgggtcgctgtgatctcttatgacgggaactacaaatattacgccgatagcgttaagggaagattcacgatttcccgggacaattctaaaaacaccctgtatctccagatgaatagcctgcgcgccgaggatacagctgtgtactattgtgccaaggactcccaacttagaagcctgctctactttgaatggctgtctcagggctacttcgatccgtggggccaggggaccctggtcacagtgtccagc

SEQ ID NO: 42863 - RNA, 387 nt, synthetic construct
  misc_feature 1..387: note = derived and/or modified sequence opt5 from anti-influenza-A_HeavyChain_V-Region
  source 1..387: mol_type = other RNA
caggtgcaactggtccagagcggcgggggagttgtgcagcccggcagatccctccggctgtcttgcgtggccagcgggttcaccttttccacatacgctatgcactgggtccgccaggcccctggaagaggccttgagtgggtggcggttatctcttatgacgggaactacaagtattacgctgatagcgtgaaaggacggttctccatttctcgcgacaatagcaacaatacgctgcatctcgaaatgaacaccctgagaacagaggataccgccctttattactgtgccaaggactcccaactgcggagcctcctgtattttgaatggctgtctcagggctacttcgatccgtggggccaggggacactcgtcaccgtgacatcc

SEQ ID NO: 42864 - RNA, 330 nt, synthetic construct
  misc_feature 1..330: note = derived and/or modified sequence opt5 from anti-influenza-A_LightChain_V-Region
  source 1..330: mol_type = other RNA
aacttcatgctgacccagccccctagcgcctccggcacaccggggcaaagagtgacgatctcttgcagcggatcctctagcaatattggcgggaacaccgtccactggtttcagcagctccccggaacagctcctaagctgcttatctacaccaattccctgcggccctctggcgttcctgaccgcttcagcgggtccaaaagcggaacatctgcctccctcgcgattagcggcctgcagtctgaggatgaagctgactattactgtgccgcctgggatgactcccttaacggccaagtgtttgggggaggcaccaagctgacagtgctc

SEQ ID NO: 42865 - RNA, 390 nt, synthetic construct
  misc_feature 1..390: note = derived and/or modified sequence opt5 from anti-influenza-A_HeavyChain_V-Region
  source 1..390: mol_type = other RNA
caggtgcaactgctcgagagcggagggggagtcgttcagcccggcagatccctgcggctttcttgcgccgctagcgggttcaccttttccaactacggaatgcactgggtgcgccaggcccctggcaaggggctggaatgggtggcgatcatttctttcgacggaagcaaaaagtattacgctaattccgtcaaaggcagatctacaatcagccgggataactccaagaatacgctcagcctgcagatgaactctcttggcccggaggacaccgccctgtattactgtgccaaactcccctccccttattactttgatagccgcttcgtgtgggttgctgcctctgcttttcatttctgggggcaaggcattctggtgacagtctccagc

SEQ ID NO: 42866 - RNA, 132 nt, synthetic construct
  misc_feature 1..132: note = derived and/or modified sequence opt5 from anti-influenza_Chain
  source 1..132: mol_type = other RNA
aacgtgcccgagtggagctacatcgtcgaaaaggccaatcctgctaacgacctgtgctatccgggcaatttcaacgattacgaggaactcaaacatctgctttccagaattaatcactttgagaagatccag

SEQ ID NO: 42867 - RNA, 162 nt, synthetic construct
  misc_feature 1..162: note = derived and/or modified sequence opt5 from anti-influenza_Chain
  source 1..162: mol_type = other RNA
agcggcagactggtgccccgggggtcccctggatctggctacatcccggaggctccccgcgacgggcaggcctatgtcagaaaggatggagaatgggttctcctgagcaccttccttggcaaacctattcccaaccctctgctcgggctggactccacagga

SEQ ID NO: 42868 - RNA, 291 nt, synthetic construct
  misc_feature 1..291: note = derived and/or modified sequence opt5 from anti-influenza_Chain
  source 1..291: mol_type = other RNA
atgagcctgctcaccgaggtggaaacacccatcagaaacgagtggggctgccggtgtaatgggtcctctgaccctctggccattgctgccaacatcattggaatccttcacctgattctctggatcctggatcgccttttctttaagtgcatctacagacggttcaaatatggcctgaaagggggaccgagcacggaaggcgtccccaagtccatgcgcgaggaatacagaaaggagcagcaatctgcggttgacgctgatgacgggcattttgtgagcattgagctcgaa

SEQ ID NO: 42869 - RNA, 300 nt, synthetic construct
  misc_feature 1..300: note = derived and/or modified sequence opt5 from anti-influenza_Chain
  source 1..300: mol_type = other RNA
atgaacaatgccaccttcaactgcacaaatatcaaccccattacgcacatcagaggcagcattatcattaccatctgtgtgtccctgatcgtcattctcatcgtttttgggtgcattgctaagatcttcattaataaaaacaattgtacaaacaatgtgatccgggtgcataagcgcattaaatgccctgactgtgagccgttttgcaacaagagagatgacatctctacaccccgggccggagtcgatatccctagcttcattctgcccggccttaatctgtccgaagggacccctaac

SEQ ID NO: 42870 - RNA, 300 nt, synthetic construct
  misc_feature 1..300: note = derived and/or modified sequence opt5 from anti-influenza_Chain
  source 1..300: mol_type = other RNA
gagctgacccagagcccctcctctctcagcgcctccgtgggcgactctgtcacaatcacgtgcagaaccagcgaacggatttccacatacctgaactggtatcaacagaagcctgggaaagctccgcgccttctggtttctggagccagcaccctccagggcggggtgccctccagattcagcggatctggctccgggacagcgtttaccctgacaatcaatagccttcagcctgaggatttcgctacctactattgtcaacagtcttactccacgcccctgacctttggaggcggcaca

SEQ ID NO: 42871 - RNA, 300 nt, synthetic construct
  misc_feature 1..300: note = derived and/or modified sequence opt5 from anti-influenza_Chain
  source 1..300: mol_type = other RNA
atgacccagagcccctcctctatgagcgtgtccctgggcgacacagtctctatcacgtgccacgccagccaagatatttccgggcatatcggatggctccagcagaagcctggcaaatctttcaaggggctgatttaccacggaaccaaccttgaggacggcgttccgagcagattttccgggagcggatctggcgctgatttctccctgacaatcagctctctcgaatccgaggactttgccgattattactgtgtgcagtatgtgcaattcccctggacctttggcgggggaacaaaa

SEQ ID NO: 42872 - RNA, 306 nt, synthetic construct
  misc_feature 1..306: note = derived and/or modified sequence opt5 from anti-influenza_Chain
  source 1..306: mol_type = other RNA
gacatccaggtgacccaaagcccctcctctctgagcgcctccgtcggcgatagagttacaatttcttgccgggctcagagcctctcctcttacctgcactggtatcagcagaagcctgggcaaccgcccaaacttctgatctacgccgcgacgaccctccagagcggagtgccttcccgcttcagcggctctgggtccggaacagactttaccctgacaattagcaccttccaggctgaggatgtggccacatattactgtcagcaatctagaacctttggccaggggacgaaggtcgaaatcaaa

SEQ ID NO: 42873 - RNA, 306 nt, synthetic construct
  misc_feature 1..306: note = derived and/or modified sequence opt5 from anti-influenza_Chain
  source 1..306: mol_type = other RNA
gacatccagatgacccaaagcccctcctctctgagcgcctccgtgggcgatagagtcacaatttcttgccgggctcagagcctctcctcttacctgcactggtatcagcagaagcctgggcaaccgcccaaacttctgatctacgccgcgacgaccctccagagcggagttccttcccgcttcagcggctctgggtccggaacagactttaccctgacaattagcaccttccaggctgaggatgtggccacatattactgtcagcaatctagaacctttggccaggggacgaaggtggaaatcaaa

SEQ ID NO: 42874 - RNA, 309 nt, synthetic construct
  misc_feature 1..309: note = derived and/or modified sequence opt5 from anti-influenza_Chain
  source 1..309: mol_type = other RNA
gacatccagattacccaaagcccctcctctctgagcgcctccgtgggcgatagagtcacaatcacgtgccggacctctcagagcctctcctcttacctgcactggtatcagcagaagcctgggaaagctccgaaacttctgatttacgccgcgagctccctccaaagcggagttccctctcgcttctccggcagcgggtctggaacagactttaccctgacaatctccagccttcagcctgaggatttcgctacctattactgtcagcagtctagaacatttggccaagggaccaaggtggaaattaag

SEQ ID NO: 42875 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagagtcacaattacgtgccggacctctcagagcctctcctcttacctgcactggtatcagcagaagcctgggaaagctccgaaacttctgatctacgccgcgagctccctccaaagcggagttccctctcgcttctccggcagcgggtctggaacagactttaccctgacaatttccagccttcagcctgaggatttcgctacctattactgtcagcagtctagaacatttggccaagggaccaaggtggaaatcaag

SEQ ID NO: 42876 - RNA, 309 nt, synthetic construct
  misc_feature 1..309: note = derived and/or modified sequence opt5 from anti-influenza_Chain
  source 1..309: mol_type = other RNA
gacatccaggtgacccaaagcccctcctctctgagcgcctccgtcggcgatagagttacaatttcttgccgggctagccagcgcctcaactcctacctgcactggtatcagcagacgcctgggcaagccccgaaacttctgatctacgcgacctctacactccagagcggagtgtcccccagattcagcggctctgggtccggaaccgactttacactgaccattagctctcttcagcctgaggatgtggctacatattactgtcagctgtcccggaccttcggccatgggacgaaggtcgaaatcaag

SEQ ID NO: 42877 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagagtcacaatttcttgccgggctagccagcgcctcaactcctacctgcactggtatcagcagacgcctgggcaagccccgaaacttctgatctacgcgacctctacactccagagcggagtttcccccagattcagcggctctgggtccggaaccgactttacactgaccattagctctcttcagcctgaggatgtggctacatattactgtcagctgtcccggaccttcggccatgggacgaaggtggaaatcaag

SEQ ID NO: 42878 - RNA, 309 nt, synthetic construct
  misc_feature 1..309: note = derived and/or modified sequence opt5 from anti-influenza_Chain
  source 1..309: mol_type = other RNA
gacatccaggtgacccaaagcccctcctctctgagcgcctccgtcggcgatagaattacaatctcttgccggacgagccagtccctccgctcttacctgcactggtatcagcagaagcctgggaaagctccgaaacttctgatttacgccagctccaccctccaaagcggagttccctctagattctccggcagcgggtctggaacagactttaccctgacaatctccaaccttcagcctgaggatttcgcgacctattactgtcagctgagccggacatttggccaggggaccaaggtggaaattaag

SEQ ID NO: 42879 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagaattacaatctcttgccggacgagccagtccctccgctcttacctgcactggtatcagcagaagcctgggaaagctccgaaacttctgatttacgccagctccaccctccaaagcggagtcccctctagattctccggcagcgggtctggaacagactttaccctgacaatctccaaccttcagcctgaggatttcgcgacctattactgtcagctgagccggacatttggccaggggaccaaggttgaaattaag

SEQ ID NO: 42880 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagagtcacaattacgtgccggacctctcagagcctctcctcttacacacactggtatcagcagaagcctgggaaagctccgaagctgcttatctacgccgcgagctcccgcctgagcggagttccctctagattctccggcagcgggtctggaaccgactttacactcaccatttccagcctgcaacctgaggatttcgctacatattactgtcagcagtctcggacctttggccaggggacgaaagtggaaatcaag

SEQ ID NO: 42881 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagagtcacaattacgtgccggacctctcagagcctctcctcttacacacactggtatcagcagaagcctgggaaagctccgaagctgcttatctacgccgcgagctcccgcggaagcggcgttccctctagattctccgggagcggatctggcaccgactttacactgaccatttccagcctccaacctgaggatttcgctacatattactgtcagcagtctcggacctttgggcagggaacgaaagtggaaatcaag

SEQ ID NO: 42882 - RNA, 309 nt, synthetic construct
  misc_feature 1..309: note = derived and/or modified sequence opt5 from anti-influenza_Chain
  source 1..309: mol_type = other RNA
gacatccagatgacccaaagcccctcctctctgagcgcctccgtgggcgatagagtcacaattacgtgccggacctctcagagcctctcctcttacgaccactggtatcagcagaagcctgggaaagctccgaagctgcttatctacgccgcgagctcccgcctgagcggagttccctctagattctccggcagcgggtctggaacagattttaccctcacaatttccagcctgcaacctgaggacttcgctacctattactgtcagcagtctcggacatttggccaggggaccaaagtggaaatcaag

SEQ ID NO: 42883 - RNA, 318 nt, synthetic construct
  misc_feature 1..318: note = derived and/or modified sequence opt5 from anti-influenza_Chain
  source 1..318: mol_type = other RNA
gagatcgtgatgacccagagccccgacacactgtccgtctctcctggcgaaagagccacgctcagctgccgggcttcccaatctgttaaccgcagactggcctggtaccagcagaagccggggcaggcgccccggcttctgattcacgatgctagcacccgcgccacaggaatccctgccagattctccggctctgggagcggaaccgagtttacactcaccatttccagcctgcaatctgaagacttcgctgtgtattactgtcagcagtatgataattggctttcctttggccaggggacacggctggagatcaaa

SEQ ID NO: 42884 - RNA, 318 nt, synthetic construct
  misc_feature 1..318: note = derived and/or modified sequence opt5 from anti-influenza_Chain
  source 1..318: mol_type = other RNA
gacatccagctgacccaaagcccctcctctctcagcgcctccgtgggcgatagagtcacaattacgtgccgggcttctcaggggatcctgaactgtcttgcctggtaccagcagaagcctggaaaagttccgaatctgctcatgtatgcggctagcaccctgcaatccggcgtgccctctcgcttcagcgggtccggatttggcacagacttcacccttacaattagctctctgcagcctgaggatgtggccacctactattgccagacatacgggggagtctccacctttggcggcgggacgaaggtggaaatcaga

SEQ ID NO: 42885 - RNA, 318 nt, synthetic construct
  misc_feature 1..318: note = derived and/or modified sequence opt5 from anti-influenza_Chain
  source 1..318: mol_type = other RNA
agctacgtgctgacccagcccccttccgtctctgttgccccgggccaaacagctagaatcagctgcgggggatccaacattggcgggaagtctgtgcactggtatcagcagaaacccggacaggcccctgtgctcgtcgtgtacgacgatagcggccggccctccgggatccctgagcgcttctctggaagcaattccggcgacacggcgaccctgacaattagcagagttgaagctggcgatgaggccgactatttttgtcaagtgtgggataacttcgggggagtctttggcaccgggacaaaggtgaccgttctt

SEQ ID NO: 42886 - RNA, 318 nt, synthetic construct
  misc_feature 1..318: note = derived and/or modified sequence opt5 from anti-influenza_Chain
  source 1..318: mol_type = other RNA
gacatccagatgacccaaagcccctcctctctgagcgcctccgtgggcgatagagtcacaattacgtgccggacctctcagagcatctcctcttacctcaactggtatcagcagaagcctgggaaagctccgaagctgcttatttacgccgcgagctccctgcaaagcggagttccctctcgcttctccggcagcgggtctggaacagactttaccctcacaatctccggcctgcagcctgaggatttcgctacctattactgtcagcagagctattctatgcccgcctttgggcaaggaacaaaacttgaaattaag

SEQ ID NO: 42887 - RNA, 318 nt, synthetic construct
  misc_feature 1..318: note = derived and/or modified sequence opt5 from anti-influenza_Chain
  source 1..318: mol_type = other RNA
gacatccagatgacccaaagccccctgtccgtgtctgtcagcgttggcgatagagtgacaattgcctgccgggcttcccagtctatcgacaagttcctcaactggtaccagcagaaacctgggaaggccccgaaactgcttatttatggagcgagcaatctgcactccggcgctccctctcgctttagcgcctccgggagcggaacggatttcaccctcacaatcaccaacattcaaacagaggactttgccacctacctgtgtcagcagtctttctccgtgcctgcttttggcgggggaacaaaggtcgaaatcaaa

SEQ ID NO: 42888 - RNA, 318 nt, synthetic construct
  misc_feature 1..318: note = derived and/or modified sequence opt5 from anti-influenza_Chain
  source 1..318: mol_type = other RNA
gacatccagatgacccaaagcccctcctctctgagcgcctccgtgggcgatagagtcacaattacgtgccgggcttctcagagcatctccacctacctcaactggtatcagaagcgccctgggaaagccccgaagctgcttgtttacggagcgtctacactgcagagcggcgtgccctccagattcagcgggtctggatccggcaccgactttacactcaccattgctagcctgcaacctgaggattctgccacatattactgtcagcagacctattccatcccccttttcgggcagggaacgcggctggaaattaaa

SEQ ID NO: 42889 - RNA, 318 nt, synthetic construct
  misc_feature 1..318: note = derived and/or modified sequence opt5 from anti-influenza_Chain
  source 1..318: mol_type = other RNA
gacatccagatgacccaaagcccctcctctctgagcgcctccgtgggcgatagagtcacaattacgtgccgggcttctcagagcatctccacctacctcaactggtatcagaagcgccctgggaaagccccgaagctgcttgtttacggagcgtctagcctgcagtccggcgtgcccagcagattctctgggtccggaagcggcacagactttaccctcacaattgcttctctgcaacctgaggattccgccgtgtattactgtcagcagacctatagcatcccccttttcgggcagggaacacggctggaaattaaa

SEQ ID NO: 42890 - RNA, 318 nt, synthetic construct
  misc_feature 1..318: note = derived and/or modified sequence opt5 from anti-influenza_Chain
  source 1..318: mol_type = other RNA
gacatccagatgacccaaagcccctcctctctgagcgcctccgtgggcgatagagtcacaattacgtgccgggcttctcagagcatctcccgctacctcaactggtatcagcagaagcctgggaaagccccgaagctgcttatttacggagcgtctaccctgcaaaatggcgctcccagcagattctccgggagcggatctggcacagactttaccctcacaatctccagcctgcagcctgaggattctgccacctatctttgtcagcagtcctacagcgttcccgccttcgggggaggcacaaaagtggaagtgaag

SEQ ID NO: 42891 - RNA, 318 nt, synthetic construct
  misc_feature 1..318: note = derived and/or modified sequence opt5 from anti-influenza_Chain
  source 1..318: mol_type = other RNA
ggcatccagatgacccaaagcccctcctctctgagcgcctccgtgggggacagagtcacaattacgtgccgggcttctcagagcatctcccgctacctcaactggtatctgcagaagcctggaaaagccccgaaacttctgatttctggcgcgagctccctccagagcggggttccctctagattctccggaaccggcagcgggacagagtttaccctgacaatctcttcccttcaacctgaagatttcgctacctactattgtcagcagacatttagcattcccctgttcggacagggcaccaaggtggagatcaag

SEQ ID NO: 42892 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtctctattacatgccaggctagccaggacatctcccggtacctcaactggtatcagcaaaagcctggggaggccccgaaactgcttatttacgatgcgtctaatctggaaacgggagttcccagccgcttctccggcagcgggtctggaaccgactttacattcaccatctccagcctccagcctgaggatattgctacatatttttgtcagcagtacggctatctgccccttaccttcgggcctggaacaaaggtggactctaaa

SEQ ID NO: 42893 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctttcagcgtgtccctgggcgatagagtcacaattacgtgcaaggcctctgaggacatctacaaccggctcgcttggtatcagcagaaacctgggaatgccccgcgcctgcttattagcgataccacaaacctgtggatcggagttccctccagattttctggcagcgggtccggaaaggactacaccctcagcattacatctctgcagtccgaagatgtggcgacctattactgtcaacagtattggagctctcggacattcggcgggggaaccaaacttgagatcaagcgc

SEQ ID NO: 42894 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctttcagcgtgtccctgggcgatagagtcacaattacgtgcaaggcctctgaggacatctacaaccgggttgcttggtatcagcagaaacctgggaatgccccgcgcctcctgatgagcgatgcgacctcccttggagctggcgtgccctctagatttagcgggtccggaagcggcaaggaccacacactgtctattacctccctccagacagaagatgtggccacctactattgtcaacagtactggaacacacggaccttcgggggaggcacgaaactggagatcaagcgc

SEQ ID NO: 42895 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagagcatctccacctacctcaactggtatcagcagaagcctgggattccgcccaaactgcttatcaatgttgcctctagcctgcaatccggagtgcctagccgcttctctggctccgggagcggaacagactttaccctcacaatttcttccctgcagcccgaggatttcgcgagctactattgtcagcagacctactcttcccctcccacatttggccaagggaccaaggtggaaatcaaa

SEQ ID NO: 42896 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctccacactgtctggcagcgtgggggatagagtcacgattacctgccgggcctcccagaacatcggaccttggctcgcttggtaccagcaggagtctggcaaggccccgaaactgcttattagccgcgcgtccatcctggaatctggggttcccagcagattctccggaacaggcaccgggacagagtttaccctcacaattagctctctgcaacctgacgatttcgctacctattactgtcagcactataatgcctactggggaacgtttggccagggcaccaaggtggaaatcaac

SEQ ID NO: 42897 - RNA, 321 nt, synthetic construct
  misc_feature 1..321: note = derived and/or modified sequence opt5 from anti-influenza_Chain
  source 1..321: mol_type = other RNA
gtgatctggatgacccagagcccctccctgctctctgccagcacaggcgacagagtcacgatttcctgccggatgtctcaagggatcagctcctacctggcttggtatcagcagaagcctggaaaagccccggagcttctgattcacaccgcgtacacactcaagtctggcgttcccagccgcttctccgggagcggatctggcaaagattttaccctgacaatctccgggcttcagagcgaagacttcgctacctattactgtcaacagtattactcttttccttatacattcggacagggcaccaaggtggagattaaa

SEQ ID NO: 42898 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacgtgagcacctggctggcctggtaccagctcaagcctgggaaagcgccgaagctgcttatctatgctgcctcctctctgcagagcggagtgccctcccgcttcagcggctctgggtccggaacagattttaccctcacagtcagctctctgcaacctgaggacttcgccacctactattgtcagcaggctaactcctttcccttcacatttggccctgggaccaaagtggatattaag

SEQ ID NO: 42899 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctccttcctctctgccagcgtgggcgatggggtcacaattacgtgcagagcttcccaggacatctacatttatctggcctggtaccagcagaagcctggaaaagcgccgaaacttctgatctatgctgcctctaccctccaaggcggggttcccagccggttttccggatctggcagcgggacagagttcaccctgacaattaacaatcttcagcctgaagattttgccacctacttctgtcagcagctgaacggatatcccctcacatttggcggcgggaccaaggtggagatcaag

SEQ ID NO: 42900 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctcctctctcagcgcctccgtgggcgatagagtcacactgacgtgccaggcttctcaggacattcggaagttccttaactggtaccagcaaaaacctgggaagggaccgaaactgctcatctatgatgccagcaatctgcagcgcggcgttccctccagattttctgggggaggcagcgggaccgacttcacacttattatctccagcctgcagcctgaggatgtgggaacctactattgtcagcaatacgacggcctcccctttacattcggcgggggaaccaagctggaaattaaa

SEQ ID NO: 42901 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctcctctctcagcgcctccattggcgatagagtgacaatcacgtgccaggcttctcaggacattcggaacagcctgaattggtacgagcacaagcctgggaaagccccgaaacttctgatccatgatgcgtccaacctcgaaaccggagtcccctctcgcttcagcggcgggggatccggcacagactttaccctgacaattagctctcttcagcctgaggatttcgctacctattactgtcaacaggccaattcctttcccctgacattcgggggaggcaccaaggttgaaatcaag

SEQ ID NO: 42902 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctcctctctcagcgcctccgtgggcgatagagtcacaattacgtgccgggcttctcaggggatccgcaacgacctgggatggtaccagcagaagcctggcaatgccccgaaaagacttattttcggggcgagctccctgcaatctggagttcccagccggttttccggcagcgggtctggaaccgagttcacactcaccatctccagcctgcagcctgaagattttgctacatattactgtcttcagcacaactcttatccctacaccttcggccagggcacaaagctggagattaaa

SEQ ID NO: 42903 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctcctctctcagcgcctccgtgggcgatagagtcacaattacgtgccgggcttctcagagcatctcccgctacctgaactggtatcagcagaagcctgggaaagccccgaagctgcttctcttcgcggcttctaccctgcttgacggagttcccagcagattttccggcagcgggtctggaacagatttcaccctgacaatttccagcctccaacctgaggactttgccacctactattgtcagcggaatcactctccctcctggacattcggccaggggacccgcgtggaaatcaaa

SEQ ID NO: 42904 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaatgacgtgccgggcttctcagaacattcgcagctacctcaattggtatcagcagagacctgggaccgccccgaagctgcttatctacgcggcttccacactgcactctggagttcccagccggttctccggcgggggaagcggcaccgactttacactcaccattaacaatctgcaacctgaggatttcgcctcttattactgtcagcagtcctatgacaacccccagacatttgggcaaggaaccaaagtggaaatcaag

SEQ ID NO: 42905 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggctaaccaggacatcgggatttacctcaattggtatcagcagaaccctggaaaggttccgaaactgcttctgcacggcgcctctagcctccaagggggagtgccctcccgcttctctgcgagcggctccgggaccgattttacactgaccatccatagccttcagcctgaggacctggctacatactattgtcagcagtctagacggctcccctacaccttcggacaaggcacacgcgtggaactgaag

SEQ ID NO: 42906 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctccacactgtctgccagcattggcgatagagtgacgattacctgccgggcttcccagtctatcgccagctggctcgcgtggtaccagcagaagcctgggaaagctccgaagctgcttatctatgaggccgtcaacctggaatccggagttccctctcgcttcagcggctccgggagcggaacagactttaccctcacaatttcttccctgcaacctgatgacttcgccacctacttttgtcagcactatggcacaatcagccagaccttcgggggaggcacgaaagtggagatcaag

SEQ ID NO: 42907 - RNA, 321 nt, synthetic construct
  misc_feature 1..321: note = derived and/or modified sequence opt5 from anti-influenza_Chain
  source 1..321: mol_type = other RNA
gacatccagatgacccaatccccctcctctctgagcgcctccgtgggcgatagagtcacaattacgtgccgggcttctcagagcatctcctcttacctcaactggtatcagcacaagcctgggaaagccccgaaggttctgatgtacgcggtgagcattcttcagtccggagtgcccagccgcttctctggctccgggagcggagctgactttaccctgacaatctcttccctccaacctgaggatttcgccacctattactgtcagcagagctattctagccccctgacatttggcgggggaaccaaagtcgaaattaag

SEQ ID NO: 42908 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagaacatcaagcgctacttcaattggtatcagcagaaacctgggaaggccccgaaactcctgatttacgcggctagcaaccttgagaatggagttccctccagattttctggcagcgggtccggaaccgacttcacactgaccatcagctctctccaacctgaagattttgccacatattactgtcagcagtccttcagcaagtcttggacctttggccaggggacaaacgtggacattaaa

SEQ ID NO: 42909 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagaacatctacaagtatctcaattggtaccagcagcgccctgggaaagccccgaagggactgattagcgcggcttccggccttcaatctggggttcccagcagattctccggaagcggctctgggaccgactttacactgaccatcacatccctccagcctgaggatttcgccacctattactgtcagcagagctattctccccctctgacatttggaggcggcacccgggtggaaattaaa

SEQ ID NO: 42910 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagctcctctgtgggcgatagagtcacaattacgtgccgggccagccagtccatcggggcttacgttaactggtatcagcagaaggccggaaaagcgcctcaagtgctcattttcggcgcttctaatctgcagagcggggtgccgtcccgctttagcggatctggctccgggaccgacttcacacttaccatcagctctctgcagcccgaggattttgccacatacttctgtcagcaaacctattccacacctattacctttggacagggcacgagactcgaaatcaag

SEQ ID NO: 42911 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaatttcttgccgggctagccagtccatctctacgtacctcaactggtatcagcagcaacctgggaaggccccgaaagttctgattttcggagcgaccaatcttcagagcggcgtgccctcccgctttagcgggtctggatccggcacagacttcaccctgacaatcagctctctccagcctgaggattttgctacctactattgtcagcaatcctacaacacacccctgattttcgggcagggaaccaaacttgaaatcaag

SEQ ID NO: 42912 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaatttcttgccgggctagccagtccatctctacgtacctcaactggtatcagcagcaacctgggaaggccccgaaagttctgattagcggagcgaccaatcttcagtccggcgtgcccagccgcttctctgggtccggaagcggcacagactttaccctgacaatctcttccctccagcctgaggatttcgctacctactattgtcagcaaagctacaacacacccctgatttttgggcagggaaccaaacttgaaatcaag

SEQ ID NO: 42913 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagactcacaattacgtgccgggcttctcagagcatctccacctacctgcactggtatcagcagaagcctgggaaagccccgaaacttctgatttacgcggcttctagcctccaatccggagtccccagccgcttctctggctccagaagcgggacagactttaccctgacaatctcttcccttcagcctgatgacttcgccacctattactgtcagcagagctattctccccctctgacatttggacccggcaccaaggttgatatgaag

SEQ ID NO: 42914 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagagcatctccaactacctcaattggtatcagcacaagcctggggaggccccgaaactgcttaactacgcggcttctagcctgcagtccggagttcccagccgcttctctgcctccggcagcgggaccgactttacactcaccatttcttccctgcaacctgaagatttcgccacatattactgtcagcagagctataatacccccatcacatttggacagggcaccagacttgagattaag

SEQ ID NO: 42915 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagagcatctccaactacctcaattggtatcagcacaagcctggggaggccccgaaactgcttaactacgcggcttctagcctgcagtccggagttcccagccgcttctctgcctccggcagcgggaccgactttacactctctatttccggactgcaacctgaagatttcgccacctattactgtcagcagagctataatacacccatcacctttggccctgggacaagacttgagattaag

SEQ ID NO: 42916 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagagcatctccacctacctcaactggtatcagcagaagcctgggaaagccccgaagctgcttatttacgcggcttctagcctgcactccggagttcccagccgcttctctggctccgggagcggaacagactttgccctcaccatctcttccctgcaacctgaggatttcgccacatattactgtcagcagagctattctccccctattacctttggccaggggacaagacttgaaatcaaa

SEQ ID NO: 42917 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaattacgtgccgggcttctcagaccatcagcacatacctcaactggtatcagcagaagtccgggaaagcccctaagctgcttatttacgcggcttctggactgcaaagcggcgttccgtcccgcttcagcgggtctggatccggcaccgactttacactcaccatcagctctctgcagcccgaggatttcgccacatatttttgtcagcagtcctacaatacccctcttacgttcgggcaaggaaccaaagtggaaattaag

SEQ ID NO: 42918 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctctgagcgcctccgtgggcgatagagtcacaatttcttgccgggctagccagtccatctctacgtacctcaactggtatcagcagcaacctgggaaggccccgaaagttctgattagcggagcgaccgaccttcagtccggcgtgcccagccgcttctctgggtccggaagcggcacagattttaccctgacaatctcttccctccagcctgaggacttcgctacctactattgtcagcaaagctacaatacacccctgatttttgggcagggaaccaaacttgaaatcaag

SEQ ID NO: 42919 - RNA, 321 nt, synthetic construct
  misc_feature 1..321: note = derived and/or modified sequence opt5 from anti-influenza_Chain
  source 1..321: mol_type = other RNA
gacatccaggtgacccaaagcccctcctctctgagcgcctccgtcggcgatagagttacaattacgtgccgggcttctcagaacatctacaagtatctcaattggtaccagcagcgccctgggaaagccccgaagggactgattagcgcggcttccggccttcaatctggggtgcccagcagattctccggaagcggctctgggaccgactttacactgaccatcacatccctccagcctgaggatttcgccacctattactgtcagcagagctattctccccctctgacatttggaggcggcacccgggtggacattaaa

SEQ ID NO: 42920 - RNA, 321 nt, synthetic construct
  misc_feature 1..321: note = derived and/or modified sequence opt5 from anti-influenza_Chain
  source 1..321: mol_type = other RNA
cagagcgtgctgacccaacccccttccgagtctgtcagcccgggccagacagcctccgttacgtgctctgggcacaagctcggagacaaatacgtgagctggtatcagcagaagcccggccaatcccctgtgctgcttatctaccaggataacagacggccctctgggattcctgaacgcttcatcggaagcaattccggcaacaccgctacactgaccattagcgggacacaggccctcgacgaggcggattattactgtcaggcttgggactcttccaccgccgtctttggaggcggcacaaaactgaccgtgcttggg

SEQ ID NO: 42921 - RNA, 321 nt, synthetic construct
  misc_feature 1..321: note = derived and/or modified sequence opt5 from anti-influenza_Chain
  source 1..321: mol_type = other RNA
gacatccagctgacccaaagcccctcctctctcagcgcctccgtgggcgatagagtcacaattacgtgccgggcttctcaggggatcagcacctacctggcctggtatcagcagaagcctggaaaagttccgaaacttctgatttacgcggcttccacactccaatctggcgtgcccagccgcttctccgggagcggatctggcaccgactttacactgaccatctccagccttcagcctgaggatgtggccacatattactgtcagaagtataactctgccccctccttcgggcctggaaccaaggtcgacattaaaaga

SEQ ID NO: 42922 - RNA, 321 nt, synthetic construct
  misc_feature 1..321: note = derived and/or modified sequence opt5 from anti-influenza_Chain
  source 1..321: mol_type = other RNA
agcgtgctgacccagcccccttccgcctctggcagcagagggcaatccatcacaatttcttgcacgggaagcacctccgacatcggctcttacaactatgtcagctggtaccagcagcacccggggacagctcccaaggttattctctatgaggtgtcccagcggcctagcggagtgcccgatcgcttctctggctccaaaagcgggaataccgcctttctgacagtctctggacttcaagcggaagacgaggctgattactattgtgcctcctacgccggcaacaatatctatgtgttcggcagcgggaccaaggttaca

SEQ ID NO: 42923 - RNA, 321 nt, synthetic construct
  misc_feature 1..321: note = derived and/or modified sequence opt5 from anti-influenza_Chain
  source 1..321: mol_type = other RNA
agcgccctgacccagcccccttccgcttctggcagcagagggcaatccatcacaatttcttgcacgggaagcacctccgacatcggctcttacaactatgtgagctggtaccagcagcacccggggacagcccccaaggtcattctctatgaggtttcccagcggcctagcggagtgcccgatcgcttctctggctccaaaagcgggaataccgcgtttctgacagtgtctggacttcaagctgaagacgaggccgattactattgtgcctcctacgctggcaacaatatctatgtcttcggcagcgggaccaaggtgaca

SEQ ID NO: 42924 - RNA, 321 nt, synthetic construct
  misc_feature 1..321: note = derived and/or modified sequence opt5 from anti-influenza_Chain
  source 1..321: mol_type = other RNA
gagatcgtgctgacccagagccccgccacactctccctgtctcctggcgaaagagctacgcttagctgccgggcctcccaatctgtcagcaccttcctggcgtggtaccagcagaagccggggcaggctccccgcctcctgatgtatgacgcctccaacagagccacaggcattcctgctcggttttctggaagcgggtccggaaccgatttcacacttaccatcagctctctggagcccgaagactttgccatttactattgtcaacagcgctcccactggcctcccatcttcggccaggggacaagactcgagattaaa

SEQ ID NO: 42925 - RNA, 321 nt, synthetic construct
  misc_feature 1..321: note = derived and/or modified sequence opt5 from anti-influenza_Chain
  source 1..321: mol_type = other RNA
gacatccagatgacccaaagccccgcctccctgtctgtgagcgtcggcgagacagttacgattacctgcagagcttccgaaaagatctactctaacctcgcctggtatcagcagaaagagggaaagagccctcagctgcttgtgtacgcggctattcggctggccgatggggtgccgtcccgcttctctggcagcgggtccggaacacaatttagcctcaaaatcaattctctgcagtccgaagacttcggcacctattactgtcagcacttttgggggacaccccttaccttcggagccggcacaaagctggagctcaaa

SEQ ID NO: 42926 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaagcgccgaagctcctgatttatgctgcctcctctcttcaaagcggagtgccctcccgcttcagcggctctgggtccggaacagattttaccctgacaatcagctctctccagcctgaggacttcgccacctacttttgtcagcaggctaactcctttccccctacattcggccaagggaccaaactggaaattaag

SEQ ID NO: 42927 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaagcgccgaagctcctgatttatgctgcctcctctcttcaaagcggagtgccctcccgcttcagcggctctgggtccggaacagattttaccctgacaatcagctctctccagcctgaggacttcgccacctacttttgtcagcaggctaactcctttccccctacattcggctgcgggaccaaactggaaattaag

SEQ ID NO: 42928 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaatgtccgaagctcctgatttatgcggcttcctctcttcaaagcggagtgccctcccgcttcagcggctctgggtccggaacagattttaccctgacaatcagctctctccagcctgaggacttcgccacctacttttgccagcaggccaactcctttccccctacattcggccaagggaccaaactggaaattaag

SEQ ID NO: 42929 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaagcgccgaagctcctgatttatgctgcctcctctcttcaaagcggagtgccctcccgcttcagcggctctgggtccggaacagattttaccctgacaatcagctctctccagcctgaggacttcgccacctactattgtcagcaggctaactcctttccccctacattcggccaagggaccaaactggaaattaag

SEQ ID NO: 42930 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaagcgccgaagctcctgatttatgctgcctcctctcttcaaagcggagtgccctcccgcttcagcggctctgggtccggaacagattttaccctgacaatcagctctctccagcctgaggacttcgccacctactattgtcagcaggctaactcctttccccctacattcggctgcgggaccaaactggaaattaag

SEQ ID NO: 42931 - RNA, 321 nt, synthetic construct
  misc_feature 1..321: note = derived and/or modified sequence opt5 from anti-influenza_Chain
  source 1..321: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaatgtccgaagctcctgatttatgcggcttcctctcttcaaagcggagtgccctcccgcttcagcggctctgggtccggaacagattttaccctgacaatcagctctctccagcctgaggacttcgccacctactattgccagcaggccaactcctttccccctacattcggccaagggaccaaactggaaattaag

SEQ ID NO: 42932 - RNA, 321 nt, synthetic construct
  misc_feature 1..321: note = derived and/or modified sequence opt5 from anti-influenza_Chain
  source 1..321: mol_type = other RNA
gagatcgtgctgacccagagccccgccacactctccctgtctcctggcgaaagagctacgcttagctgccgggcctcccgctctattaccacattcctggcgtggtaccaacagaagccggggcaggctcccagactcctgatctatgacgccagcaaccgggccaccggagtccctgctcgcttttccggctctgggagcggaacagatttcacccttacaattaattccctggagcccgacgattttgccatctactattgtcagcaaagagaccactggcctcccattttcggccaggggacccggctcgaaatcaaa

SEQ ID NO: 42933 - RNA, 321 nt, synthetic construct
  misc_feature 1..321: note = derived and/or modified sequence opt5 from anti-influenza_Chain
  source 1..321: mol_type = other RNA
gagatcgtgctgacccagagccccgccacactctccctgtctcctggcgaaagagctacgcttagctgccgggcctcccgctctattaccacattcctggcgtggtaccaacagaagccggggcaggctcccagactcctgatctatgacgccagcaaccgggccaccggagtccctgctcgcttttccggctctgggagcggaacagatttcacccttacaattaattccctggagcccgacgattttgccatctactattgtcagcaaagagaccactggcctcccattttcggctgcgggacccggctcgaaatcaaa

SEQ ID NO: 42934 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccggcacactctccctgtctcctggggaaagagccacgcttagctgccgggcttcccaaaccgtctctagctcctacctggcctggtatcagcagaagccgggacaggcgccccgcctcctgatttacggcgcttctagcagagccacagggatccctgaccggttctccggaagcggctctgggaccgattttacacttaccatttcccgcctggagcccgaagacttcgccgtttattactgtcaacagtatggaaacagcccttacacatttggccagggcaccaaactcgagatcaag

SEQ ID NO: 42935 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccggcacactctccgtctctcctggggaaagagccacgctgagctgccgggcttcccaatctattagctccggataccttgcctggtatcagcagaagccgggccaggcgccccgcctgctcatctacggggcttctagcagagccaccggcattcctgaccggttctccggaagcgggtctggaacagattttaccctgacaatctcccgccttgagcccgaagacttcgccgtttattactgtcaacagtatggcaccagccctcagacatttggccaggggaccaaagtggagattaag

SEQ ID NO: 42936 - RNA, 324 nt, synthetic construct
  misc_feature 1..324: note = derived and/or modified sequence opt5 from anti-influenza_Chain
  source 1..324: mol_type = other RNA
gaggtggtcctgacccagagccccggcacactctccctgtctcctgggcaaagagccacgcttagctgccgggcttcccagtctgttagctcctcttacctggcctggtatcagcagaagccgggacaagcgccccgcctcctgatctacgacgctagcaacagagccaccggcattcctgatcggttctccgggagcggatctggcacagactttacccttacaatctcccgcctggaacccgaggatttcgccgtgtattactgtcagcagtatgggagctctccttacacctttggacagggcacaaaactcgaaattaag

SEQ ID NO: 42937 - RNA, 324 nt, synthetic construct
  misc_feature 1..324: note = derived and/or modified sequence opt5 from anti-influenza_Chain
  source 1..324: mol_type = other RNA
gacatccagctgacccaaagcccctcctctctcagcgcctccgtgggcgatagagtcacaattacgtgccgggcttctcaggggatcattacctacctgaactggtatcagcagaagcctggaaaagccccgaaacttctgatctacgcgacatatagcctccaaaatggcgttccctcccgcttctctgggagcggatccggcaccgactttacactgaccattagctctcttcagcctgaggatttcgctacatactattgtcagcagtcctacagctctctgatgtttaccttcgggcaaggaacgaagctcgacatcaag

SEQ ID NO: 42938 - RNA, 324 nt, synthetic construct
  misc_feature 1..324: note = derived and/or modified sequence opt5 from anti-influenza_Chain
  source 1..324: mol_type = other RNA
gagaccgtgctgacacagagccccggcacgctctccctgacccctggggaaagagccacactttcttgccgggtcggacaaagcgtttccggctctcacctggcttggtaccagcagaagccggggcaggcgccccgcctcctgatctatggagccagctccagagctaccggcattcctgaccggttcgggggatctgtgagcggcacagattttacccttacaatctcccgcctggagcccgaagacagcgccgtgtactattgtcaacagtacggcgattctagatataccttcgggcagggaacgaaactcgagattaag

SEQ ID NO: 42939 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccggcacactctccctgtctcctggggaaagagccacgcttagctgccgggcttcccaatctgtcagctcctctcagctggcctggtaccagcagaagccgggacaagcgccccgcctcattatctatggcgctagcaccagagccacagggattcctgaccggttctccggaagcggctctgggaccgattttacactgaccatcggacgccttgagcccgaagacttcgccgtgtttttctgtcagcagtactccacaagccctcccacctttggccagggcacgaaagttgatttcaag

SEQ ID NO: 42940 - RNA, 324 nt, synthetic construct
  misc_feature 1..324: note = derived and/or modified sequence opt5 from anti-influenza_Chain
  source 1..324: mol_type = other RNA
gacatcgtgctgacccagagccccggcacactctccctgtctcctggggagagagccacgcttagctgccgggcttcccaatctgtcagctcctcttacctggcctggtatcagcagaagccgggacaggcgccccgcctcgttatgtacggcgctgccaccagagccacagggattcctgatcggttcagcggatccggcagcgggcccgactttaccctgacaatctctcgccttgaacctgaggatttcgctatgtattactgtcaacagtatggaaactcccccattacctttggccagggcacaagactggaaatcaaa

SEQ ID NO: 42941 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagccactggcctcccatcacctttggccaggggacaagactcgagattaaa

SEQ ID NO: 42942 - RNA, 324 nt, synthetic construct
  misc_feature 1..324: note = derived and/or modified sequence opt5 from anti-influenza_Chain
  source 1..324: mol_type = other RNA
agctacgagctgacccagcccccttccgtgtctgtcagcccgggccaaacagccagaatcacgtgctccggggacgctctccccaagcagaacgcctattggtaccagcagaaacctggacaagcgcccgttctgcttatttataaggattctgaacggcctagcggcatccccgagcgcttctccgggtctagctccggaaccacagtgaccctgacaattagcggcgtgcaggctgaagacgaggccgattactattgtcagtctgccgactccagcgggacctcttgggtctttggaggcggcacaaaactcaccgtgctg

SEQ ID NO: 42943 - RNA, 324 nt, synthetic construct
  misc_feature 1..324: note = derived and/or modified sequence opt5 from anti-influenza_Chain
  source 1..324: mol_type = other RNA
agctacgtgctgacccaggccccctccgtctctgttgctcctggccaaacagccagaatcacgtgcgggggaaacgcgattggcagcaagaaagtgcactggtatcagcataaggctgggcaggccccggtgctcgtcgtgtacgacgataccgaccggccctccggaatccctgagcgcttctctggcagcaattcctggtctacagccaccctgacaattaacagagttgaagctggggatgaggccgactattactgtcaggtgtgggattttaccatcgaccacgtcgtgttcggaggcggcacaaaacttaccgttctg

SEQ ID NO: 42944 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccggcacactctccctgtctcctggggaaagagccacgcttagctgccgggcttcccaatctgtcagctcctcttacctggcctggtatcagaagaaaccgggacaggcgccccgcctcctgatttacggcgctagcaccagagccacagggatccctgaccggttcaccggatccggcagcgggacagattttaccctttctatttcccgcctggagcccgaagacttcgccgtttattactgtcagcactttggaacaagcgtgttcacctttggcggcgggacgaaggtggagatcaaa

SEQ ID NO: 42945 - RNA, 324 nt, synthetic construct
  misc_feature 1..324: note = derived and/or modified sequence opt5 from anti-influenza_Chain
  source 1..324: mol_type = other RNA
gagatcgtgatgacccagagccccgccacactgtccgtctctcctggcgaaagagctacgctcagctgccgggcctcccaatctgttgggaacagcctggcgtggtaccagcagcgcccgggacaggctcccagacttctgatttatggcgcctccacccgggccacagggatccctccccgcttctctggaagcggctccgggaccgagtttacactcaccattagctctctgcaaacagaagacttcgctgtgtactattgtcagcagtacatcaattggagacctctttcctttggaggcggcaccaaggtggagattaaa

SEQ ID NO: 42946 - RNA, 324 nt, synthetic construct
  misc_feature 1..324: note = derived and/or modified sequence opt5 from anti-influenza_Chain
  source 1..324: mol_type = other RNA
caggagagcggcgccgaactggtgagacccggggcttccgtcaagctctcttgcaaagacagcggatacaccttcacaacgtattggatgaactgggttaagcaacggcctgagcagggcctggaatggatcgggcgcattgatccgtacgactccgagacccactataatcagaaatttaaggataaagccatccttacagtggacaagtctagcaacaccgcgtacatgcagctgtcctctctcacaagcgaagattccgctgtgtattactgtgtcagaggaggcagcaccgtggcctatttcggggtttggggacaaggc

SEQ ID NO: 42947 - RNA, 324 nt, synthetic construct
  misc_feature 1..324: note = derived and/or modified sequence opt5 from anti-influenza_Chain
  source 1..324: mol_type = other RNA
gagatcgtgctgacccagagccccggcacactctccctgtctcctggggaaagagccacgcttagctgccgggcttcccaacgcgtctctagctacctggcctggtatcagcagaagccgggacaggcgcccagactcctgatttacggcgcttccacccgggccgccgggatccctgaccgcttctctggaagcggctccgggacagattttacccttacaattagcagactggagcccgaagactctgctgtttattactgtcaacagtatggacggacccctctcacattcggcggcgggaccaaagtggagatcaagcgc

SEQ ID NO: 42948 - RNA, 324 nt, synthetic construct
  misc_feature 1..324: note = derived and/or modified sequence opt5 from anti-influenza_Chain
  source 1..324: mol_type = other RNA
gagatcgtgatgacccagagccccggcacactgtccctctctcctggggaaagagccacgctgagctgccgggcttcccaatctgtcagctcctcttaccttgcctggtatcagcagaagccgggacaggcgccccgcctgctcattttcggcgctagctccagagccaccgggatccctgaccggtttagcggatctggctccgggacagatttcaccctgacaattagccgccttgagcccgaagactttgccgtttactattgtcaacagtacggatcttccctgaccttcggcggcgggacaaaactcgagatcaagaga

SEQ ID NO: 42949 - RNA, 324 nt, synthetic construct
  misc_feature 1..324: note = derived and/or modified sequence opt5 from anti-influenza_Chain
  source 1..324: mol_type = other RNA
gagatcgtgctgtaccagagccccggcaccctctccctgtctcctggggaaagagccacacttagctgccgggcttcccaacgcgtctctagctatctggcctggtaccagcagaagccgggacaggcgcccagactcctgatttatggcgcttccacgcgggccgccgggatccctgaccgcttctctggaagcggctccgggaccgattttacacttaccattagcagactggagcccgaagactctgctgtttactattgtcaacagtacggacggacacctctcaccttcggcggcgggacaaaagtggagatcaagcgc

SEQ ID NO: 42950 - RNA, 324 nt, synthetic construct
  misc_feature 1..324: note = derived and/or modified sequence opt5 from anti-influenza_Chain
  source 1..324: mol_type = other RNA
gacatcgtgctgacccaggcccccagcgtctccgtttctcctggccaaacagctagcattacgtgctccggggatagactcggagagaagttcgcctcttggtaccagcagaaaccgggccagagccccgtgctggtgatctatgaagactccaagcggccttctgggattcccgatcgctttagcggatccaacagcggcaataccgcgacacttaccatctctgggacacaaattatggacgagggagatttcttttgtcaggcttgggactccagcaccgtcgtgttcggcggcgggacaaaactgaccgttctcggacag

SEQ ID NO: 42951 - RNA, 324 nt, synthetic construct
  misc_feature 1..324: note = derived and/or modified sequence opt5 from anti-influenza_Chain
  source 1..324: mol_type = other RNA
gacatcgagctgacccagagcccctccgtgtctgtcagccctggccaaacagcctccattacgtgctctggggataagctcggagacaagttcgtttgttggtaccagcagaaggctggccagagcccgatcgtggtgatttatcaagatgacaaaagaccctccgggatccctgaacggttttctggaagcaactccggcaataccgccacactgaccattagcgggacacaggcgatggatgaggctgactacttctgccaggcctgggattctaccacagtcgtgtttggaggcggcaccaaacttacggttctggggcag

SEQ ID NO: 42952 - RNA, 324 nt, synthetic construct
  misc_feature 1..324: note = derived and/or modified sequence opt5 from anti-influenza_Chain
  source 1..324: mol_type = other RNA
cagagcgtgctgacccaacccccttccgcctctggcagcagagggcagtccatcacaatttcttgcacgggaagcacctccgacatcggctcttacaactatgtcagctggtaccagcagcacccggggacagctcccaaggttattctctatgaggtgtcccaacggcctagcggagtgcccgatcgcttctctggctccaaaagcgggaataccgcctttctgacagtctctggacttcagaccgacgatgaagcggactactattgtgcttcctacgccggcaacaatatctatgtgttcggcagcgggacaaaggttacc

SEQ ID NO: 42953 - RNA, 327 nt, synthetic construct
  misc_feature 1..327: note = derived and/or modified sequence opt5 from anti-influenza_Chain
  source 1..327: mol_type = other RNA
aacttcatgctgacccagccccacagcgtgtccgagtctcctggcaagacagtcacgatcagctgcaccgggtccggaggcaatattgccagaaactacgttcaatggtatcagcagcggccggggtctgctcccgtgacagtgatcctcgaagacgataaacgccctagcggcattcccgacagattttccggatctatcgatcggagctccaatagcgcctctctgaccatttccgggcttcgcacagaggacgaagcgctgtactattgtcagagctacgatgactctgatctcgtcgtgttcggaggcggcaccaagctgaca

SEQ ID NO: 42954 - RNA, 327 nt, synthetic construct
  misc_feature 1..327: note = derived and/or modified sequence opt5 from anti-influenza_Chain
  source 1..327: mol_type = other RNA
atgctggagcccctccagatcctgagcatttgctccttcatcctttctgccctgcactttatggcttggaccattggccatctcaaccaaatcaagagaggggtgaatctgaaaattcagatccggaaccctaataaggaagccatcaaccgcgaggtcagcattcttagacacaattaccagaaagaaatccaggcgaaggagacaatgaaaaagattctgtccgacaacatggaagttctcggagatcatatcgtggtggagggcctgtctacggacgagattatcaagatgggggaaaccgtcctggaggtggaggaactccaa

SEQ ID NO: 42955 - RNA, 327 nt, synthetic construct
  misc_feature 1..327: note = derived and/or modified sequence opt5 from anti-influenza_Chain
  source 1..327: mol_type = other RNA
gacatcagactgacccagagccccgccacactctccgtgtctcctggcgagcgggctacgctgagctgccgcgcctcccactctgtcagcagaaaccttgcgtggtaccaacagaagccggggcgggctccccgcctgctcgtttatgatacctcctctagagccacaggcattcctgcccggttcagcggatccgggagcggaaccgaatttacactgaccatctcttcccttcagagcgaggacttcgctgtgtactattgtcagcaatacaataactggccccgcacatttggccaggggaccaaagtggatattaagagaacg

SEQ ID NO: 42956 - RNA, 327 nt, synthetic construct
  misc_feature 1..327: note = derived and/or modified sequence opt5 from anti-influenza_Chain
  source 1..327: mol_type = other RNA
gagatcgtgatgacccagagccccggcacactgtccctctctcctggggaaagagccacgctgagctgccgggcttcccaatctgtcagctcctcttaccttgcctggtatcagcagaagccgggacaggcgccccgcctgctcatttacggcgctagcaccagagccacaggggttcctgaccggttccacggaggcgggtccggaaccgattttacactgaccatcagccgccttgagcccgaagacttcgccgtgtattactgtcaacagtatgatacatcttccggcctgacctttggcgggggaacgaaagtggagattaag

SEQ ID NO: 42957 - RNA, 327 nt, synthetic construct
  misc_feature 1..327: note = derived and/or modified sequence opt5 from anti-influenza_Chain
  source 1..327: mol_type = other RNA
gagatcgtgatgacccagttccccgccacactgagcgtctcccctggcgaaagagttacgctctcttgccgggctagccaatccgtgtctaacaatctggcctggtaccagcagaagccggggcagccccctcgccttctgatttatgacgcgagcaccagagctacaggagtgcccgccaaattttccggcaccgggtctggaacagagttcaccctcagcatctccagcctgcaatctgaagattttgccgtctactattgtcagcagtaccacaactggcctccctcctatagcttcggccttgggacaaagctggagattaaa

SEQ ID NO: 42958 - RNA, 327 nt, synthetic construct
  misc_feature 1..327: note = derived and/or modified sequence opt5 from anti-influenza_Chain
  source 1..327: mol_type = other RNA
gagatcattctggcccagagccccggcaccctctccctgtctcctggggaaagagctacacttagctgccgggcctcccaattcgtgtctacgcgcagcctggcgtggtaccagcagagaccgggacaggctccccggctcctgatctatggcgcctcctctcgcgccaccgggattcctgacagatttagcggatccggcagcgggacagatttcacccttacaatctctcggctggagcccgaagactttgctgtctactattgtcaacactacggatattcccctcgctacgccttcggccagggcagcaaggttgagattaaa

SEQ ID NO: 42959 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccggcacactctccctgtctcctggggaaagagccacgcttagctgccgggcttcccacttcgtcaactaccgctctctggcctggtatcaacagaccccgggacaggttcccagactcctgatttacggcgcgagcacacgggctaccgggatccctgaccgcttttccggatctggcagcgggacagatttcacccttacaatttccagactggagcccgaagactttgccgtgtatttctgtcagcaatacggaggcagccctcggtatacctttggccaggggacgcgcctcgagatcaag

SEQ ID NO: 42960 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccggcacactctccctgtctcctggggaaagagccacgcttagctgccgggcttcccacttcgtcattggacgcgccgttgcgtggtaccaacagaagccgggccaggctcccagactgctcatctatggggcctctagccgggccaccggcattcctgaccgcttttccggatctgggagcggaacagatttcaccctgacaatctccagacttgagaccgaagactttgctgtgttctactgtcagcattatggcagctctccccggtacgcctttggccaagggacaaaactggagattaag

SEQ ID NO: 42961 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccctgtctcctggcgaaagagctacgcttagctgccgggcctcccaatctgtcgggaactacctggcgtggtatcagcagaagccgggacaggctccccgcctcctgatttacgacagctccaatagagcccctggcatccccgcccggttctctgggagcggatccggcaccgattttacacttaccattagctctctggctcctgaggacttcgccgtttattactgtcaacagcgctccaaatggccccctatgtatagctttgggcacggaacaaagctcgaaatcaaa

SEQ ID NO: 42962 - RNA, 327 nt, synthetic construct
  misc_feature 1..327: note = derived and/or modified sequence opt5 from anti-influenza_Chain
  source 1..327: mol_type = other RNA
caggccgtggtcacccaagagcccagcctgacagtttcccctggcgggacggtgaccctcacatgcggatctagcaccggcccggtgacatccgggcactacccctattggttccagcagaagcctggacaggctcccagaaccctgatctctgccacaagcaacacccattcctggacgcctgcgcggttttctggcagccttctcgggggacgcgctgccctgaccctgtccggcgcccaacccgaagacgaggctgattactattgtttccttagctactctggcgcctgggtctttgggggaggcacaaccctgacagtgctc

SEQ ID NO: 42963 - RNA, 327 nt, synthetic construct
  misc_feature 1..327: note = derived and/or modified sequence opt5 from anti-influenza_Chain
  source 1..327: mol_type = other RNA
gccatccagatgacccaaagcccctcctctctgagcgcttccgtgggcgacagagtcacaattacgtgccgggcctctcagaacatccgcagctacctcaattggtatcagcagaagcctgggaaagcgccgaacctgcttatttacggaaccacatccctggagtctggcgttcccagcagattctccgggagcggatctggcaccgattttacactcaccatctccagcctgcaacctgaagacttcgctacatattactgtcagcagtcttatcacacgccccagacctttgggcaaggaaccaaggtggagattaaacggaca

SEQ ID NO: 42964 - RNA, 327 nt, synthetic construct
  misc_feature 1..327: note = derived and/or modified sequence opt5 from anti-influenza_Chain
  source 1..327: mol_type = other RNA
gacatccagatgacccaaagcccctcctctctgagcgcctccgtgggcgatagaattacaatcacgtgccgggcctctcaggggattgacaactacctcgcctggttccagcagaagcctggaaaagtcccggagctgcttatctatgcggctagcaccctgcaatccggcgttccctctcgctttagcgggtccggaagcggcacagggttcaccctcacaatttcttccctgcagcctgaagatgtggccacctactattgtcagaagtacgacagcgctccccttacatttggaggcggcaccaaagtggatatcaagagaacg

SEQ ID NO: 42965 - RNA, 327 nt, synthetic construct
  misc_feature 1..327: note = derived and/or modified sequence opt5 from anti-influenza_Chain
  source 1..327: mol_type = other RNA
gacatccagctgacccaaagcccctcctctctcagcgcctccgtgggcgatagagtcacaattacgtgccgggcctctcaggggatcaccgactacctggcctggtatcagcagaagcctggaacaattccgaaacttctgatctacgcggctagcaccctccaatccggcgttccctctcgcttcagcgggggaggctatgggacagattttaccctgacaatttccagccttcagcctgaggacgtggccacctactattgtcagaagtacaactctgctcccctgacgttcggaggcggcaccaaagtggaaatcaagagaaca

SEQ ID NO: 42966 - RNA, 327 nt, synthetic construct
  misc_feature 1..327: note = derived and/or modified sequence opt5 from anti-influenza_Chain
  source 1..327: mol_type = other RNA
gacatcgtgatgacccagagccccttctccctgtctctcagccctggcgagagagccacactgtcctgccgggcttctcaaagcatttccaactaccttgcctggtatcagcagaagccggggcaggcgccccgcctgctcatctacgattctagcaatagagctacgggagtccctgcccggttttccggcagcgggtctggaaccgacttcacactgaccatttccagccttgaacccgaggattttgccgtttattactgtcaacagcgctctaactggatgtatacattcggccaggggaccaaagtggaaatcaagagaaca

SEQ ID NO: 42967 - RNA, 327 nt, synthetic construct
  misc_feature 1..327: note = derived and/or modified sequence opt5 from anti-influenza_Chain
  source 1..327: mol_type = other RNA
gacatccagatgacccaaagcccctcctctctgagcgcctccgtgggcgatagagtcacaattacgtgccgggcctctcaggggatcagctcctacctcgcctggtatcagcagaagcctggaaaagttccgaccctgcttatttacgacgcgtctacactgcgcagcggcgtgccctccagattcagcgggtctggatccgctaccgattttacactcaccatcagctctctgcaacctgaggacgtggccacatattactgtcagcggtataactccgctccccctattaccttcggccaggggacgcgccttgaaatcaagaga

SEQ ID NO: 42968 - RNA, 327 nt, synthetic construct
  misc_feature 1..327: note = derived and/or modified sequence opt5 from anti-influenza_Chain
  source 1..327: mol_type = other RNA
gagatcgtgatgacccagagccccggcacactgtccctctctcctggggaaagagccacgctgagctgccgggcttcccaatctgtcagctcctcttaccttgcctggtatcagcagaagccgggacaggcgccccgcctgctcatttacgacgctagctccagagccaccgatatccctgaccggttcagcggctctgggtccggaacagattttaccctgacaattagccgccttgagcccgaagacttcgccgtttattactgtcaacagtatgggtcttccctgtggacctttggccagggaacaaaagtggagatcaagaga

SEQ ID NO: 42969 - RNA, 327 nt, synthetic construct
  misc_feature 1..327: note = derived and/or modified sequence opt5 from anti-influenza_Chain
  source 1..327: mol_type = other RNA
agctacgtgctgacccagcccccttccgtctctgttgccccgggccaaacagctagaatcacgtgcgggggaaacaatattggcagcaagtccgtgcactggtatcagcagaaacccgggcaggcccctgtgctcgtcgtgtacgacgattctgaccggcccagcggaatccctgagcgcttctccggctctaacagcgggaataccgcgacactgaccatttccagagttgaagctggagatgaggccgactattactgtcaagtgtgggattctagctccgaccatgccgtctttggcggcgggacacagcttaccgtgctggga

SEQ ID NO: 42970 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctagaacctttggcggcgggacaaaagtggagatcaagcgg

SEQ ID NO: 42971 - RNA, 327 nt, synthetic construct
  misc_feature 1..327: note = derived and/or modified sequence opt5 from anti-influenza_Chain
  source 1..327: mol_type = other RNA
agctacgtgctgacccagcccccttccgtctctgttgccccgggccaaacagctagaatcacgtgcgggggaaacaatattggcagcaagggggtgcactggtatcagcagaagcccggacaggcccctgtgctcgtcgtgtacgacgattccgaccggccctctggcatccctgagcgcttcagcgggtccaactctggaaataccgcgacactgaccattagcagagttgaagctggcgatgaggccgactattactgtcaagtgtgggattccagctctgaccatgtcgtgtttggcgggggaacaaaacttaccgttctgggc

SEQ ID NO: 42972 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccggcacactctccctgtctcctggggaaagagccacgcttagctgccgggcttcccaatctgtcagctccaactacctgggatggacccagcagaagccgggccaggcgccccgcctcctgatttatggggcctctagcagagcttccggaatccctgaccggttcagcggcgggggatctggcacagattttacccttacaatttcccgcctggagcccgaagacttcgccgtttactattgtcaacagtacggcagctctcctctcacctttgggggaggcacaaaagtggagatcaagaga

SEQ ID NO: 42973 - RNA, 327 nt, synthetic construct
  misc_feature 1..327: note = derived and/or modified sequence opt5 from anti-influenza_Chain
  source 1..327: mol_type = other RNA
cagagcgtggtcacccaacccccttccgtttctgtggccccgggccagacagctagaatcacgtgcgggggaaacaatattggcagcaagtccgtgcactggtaccagcagaaacccgggcaagcccctgtcctggtggtttatgacgattctgaccggcccagcggaatccctgagcgcttctccggctctaacagcgggaataccgcgacactcaccatttccagagtggaagctggagatgaggccgactactattgtcaggtctgggattctagctccgaccattacgtgtttggcacaggcaccaaggttacagtgctgggg

SEQ ID NO: 42974 - RNA, 327 nt, synthetic construct
  misc_feature 1..327: note = derived and/or modified sequence opt5 from anti-influenza_Chain
  source 1..327: mol_type = other RNA
agctacgtgctgacccagcccccttccgagtctgtcgccccgggccaaacagctagaatcacgtgcgggggaaacaatattggccggaacagcgttcactggtatcagcagaagcccgggcaggcccctgtgctcgtggtctacgacgattccgaccgcccctctggaatccctgaaagattcagcggctccaaatctgggaataccgcgacactgattatcagccgggtggaggttggagatgaagctgactattactgtcaagtgtggcattccagctctgatcactatgtctttggcaccggcacaaaggtgaccgttcttggg

SEQ ID NO: 42975 - RNA, 327 nt, synthetic construct
  misc_feature 1..327: note = derived and/or modified sequence opt5 from anti-influenza_Chain
  source 1..327: mol_type = other RNA
gagatcgtgatgacccagagccccggcacactgtccctctctcctgggcaaagagccacgctgagctgccgggcttcccagtctgtcagctcctcttaccttgcctggtatcagcagaagccgggacaagcgccccgcctgctcatgtacggcgctagctccagagccaccgggattcctgaccggttcagcggatctggctccgggacagattttaccctgacaatcagccgccttgaacccgaggacttcgccgtttattactgtcagcagtatggatcttccagcctgacctttggcggcgggacaaaactcgaaattaagaga

SEQ ID NO: 42976 - RNA, 327 nt, synthetic construct
  misc_feature 1..327: note = derived and/or modified sequence opt5 from anti-influenza_Chain
  source 1..327: mol_type = other RNA
caggccggcctgacccaaccccctagcgtgtccgtcgctccggggcagacagccagaatcacgtgcggaggcaacaatattgggtctaagagcgttcactggtaccagcagaagcccggacaagcgcctgtgctcgtggtctatgacgattccgaccggccctctggcatccctgagcgcttcagcgggtccaactctggaaataccgctacactgaccattagcagagtggaagccggcgatgaggccgactactattgtcaggtttgggattccagctctgaccatgtggtctttggcgggggaacaaaacttaccgtgctgggc

SEQ ID NO: 42977 - RNA, 327 nt, synthetic construct
  misc_feature 1..327: note = derived and/or modified sequence opt5 from anti-influenza_Chain
  source 1..327: mol_type = other RNA
cagagcgtggtcacccaacccccttccgagtctgttgccccgggccagacagctagaatcacgtgcgggggacacaacattggcagcaattccgtgcattggtaccagcagaagcccgggcaagcccctgtgctggtcgtgtatgacaactctgatcggcccagcggaatccctgaacgcttctccggctctaatagcgggaacaccgcgacactcaccatttccagagttgaggctggagacgaagccgattactattgtcaggtgtggggctctagctccgaccactacgtctttggcacagggaccaaagtgacagttctggga

SEQ ID NO: 42978 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccggcacactctccctgtctcctggggaaagagccacgcttagctgccgggcttcccaatctgtcagctccaactacctgggatggtatcagcagaagccgggccaggcgccccgcctcctgatttacggggcctctagcagagcttccggaatccctgaccggttcagcggcgggggatctggcaccgattttacacttaccatttcccgcctggagcccgaagacttcgccgtttattactgtcaacagtatggcagctctcctctcacatttgggggaggcaccaaagtggagatcaagaga

SEQ ID NO: 42979 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattggccccctcgcctgacatttggcgggggatctaaagtcgagattaag

SEQ ID NO: 42980 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattatccccctcgcctgacatttggcgggggatctaaagtcgagattaag

SEQ ID NO: 42981 - RNA, 327 nt, synthetic construct
  misc_feature 1..327: note = derived and/or modified sequence opt5 from anti-influenza_Chain
  source 1..327: mol_type = other RNA
gagatcgtgatgacccagagccccgccacactgtccgtctctcctggcgaaagagctacgctcagctgccgggcctcccaatctgttgacagcaacctggcgtggtaccagcagaagccggggcaggctccccgccttctggtgtattccgcctctaccagagccacaggcattcctgctcggttcagcggatccgggagcggaaccgagtttacactcgccatctcttccctgcaaagcgaagatttcgctgtgtactattgtcagcactacaccaattggccccctcgccttacatttggcgggggatctaaagtcgagattaag

SEQ ID NO: 42982 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttagctccaaccttgcgtggtaccagcagaagccggggcaggctccccgcctgctcgtgtattctgccagcaccagagccacaggcattcctgctcggttctccggaagcgggtctggaaccgagtttacactggccatctccagccttcaatctgaagacttcgctgtgtactattgtcagcactacaccaattggccccctcgcctgacatttggcgggggatccaaagtcgagattaag

SEQ ID NO: 42983 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttgaccacaaccttgcgtggtaccagcagaagccggggcaggctccccgcctgctcgtgtatagcgcctccaccagagccacaggcattcctgctcggttctctggaagcgggtccggaaccgagtttacactggccatcagctctcttcaatccgaagatttcgctgtgtactattgtcagcattacaccaattggccccctcgcctgacatttggcgggggaagcaaagtcgagattaag

SEQ ID NO: 42984 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattggccccctcgcctgacatttggcgggggatctaaagtcgagattaag

SEQ ID NO: 42985 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattttccccctcgcctgacattcggcgggggatctaaagtcgagattaag

SEQ ID NO: 42986 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattttccccctcgcctgacattcggcgggggatctaaagtcgagattaag

SEQ ID NO: 42987 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattatccccctcgcctgacatttggcgggggatctaaagtcgagattaag

SEQ ID NO: 42988 - RNA, 327 nt, synthetic construct
  misc_feature 1..327: note = derived and/or modified sequence opt5 from anti-influenza_Chain
  source 1..327: mol_type = other RNA
gagaccacactgacgcagagccccgccaccctctccgtgtctcctggcgaaagagctacactgagctgccgggcctcccaagtcatctctcacaaccttgcgtggtaccagcagaagccggggcaggctccccgcctgctcatttatggagccagcaccagagcctccggcatccctgctcggttctctgggagcggatccggcacagactacaccctgacaattaccagccttcaatctgaggattttgccgtttattactgtcagcattattccaattggccccctcgcctgacgttcgggggaggcaccaaagtggaaatcaag

SEQ ID NO: 42989 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaatctgaggattttgccgtgtattactgtcagcattattccaattggccccctcgcctgacattcgggggaggcaccaaagtggaaattaag

SEQ ID NO: 42990 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaacccgaggattttgccgtgtattactgtcagcattattctaattggcctccccgcctgacattcgggggaggcaccaaagtggaaattaag

SEQ ID NO: 42991 - RNA, 327 nt, synthetic construct
  misc_feature 1..327: note = derived and/or modified sequence opt5 from anti-influenza_Chain
  source 1..327: mol_type = other RNA
gagatcgtgatgacccagagccccgccacactgtccgtctctcctggcgaaagagctacgctcagctgccgggcctcccaagttatttctcacaacctggcgtggtaccagcagaagccggggcaggctccccgccttctgatctatggagccagcaccagagcctccggcattcctgctcggttctctgggagcggatccggcacagactacaccctcacaatcaccagcctgcaatctgaggattttgccgtgtattactgtcagcattattccaattggccccctcgccttacattcgggggaggcaccaaagtggaaattaag

SEQ ID NO: 42992 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaatctgaggattttgccgtgtattactgtcagcattattccaattttccccctcgcctgacattcgggggaggcaccaaagtggaaattaag

SEQ ID NO: 42993 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctacggagccagcaccagagcctccggcattcctgctcggttctctgggagcggatccggcacagactacaccctgacaatcaccagccttcaatctgaggattttgccgtgtattactgtcagcattattccaattatccccctcgcctgacattcgggggaggcaccaaagtggaaattaag

SEQ ID NO: 42994 - RNA, 327 nt, synthetic construct
  misc_feature 1..327: note = derived and/or modified sequence opt5 from anti-influenza_Chain
  source 1..327: mol_type = other RNA
gagatcgtgctgacccagagccccgccacactctccgtctctcctggcgaaagagttacgctgagctgccgggcttcccaatctgtggccaacaatcttgcgtggtaccagcagaagccggggcagagcccccgcctgctcatttatggagcttccaccagagacacaggcatccctgcccggttctctgggagcggatccggcaccgagtttacactgaccattagctctcttcaatccgaagatttcgccgtgtactattgtcagcagtacaacaattggccccctatgtatacatttgggcagggaaccaaactggagatcaag

SEQ ID NO: 42995 - RNA, 327 nt, synthetic construct
  misc_feature 1..327: note = derived and/or modified sequence opt5 from anti-influenza_Chain
  source 1..327: mol_type = other RNA
gacatcgtgatgacccagagcccctccacactgtctgccagcgtcggcgatagagttacgattacctgccgggcttcccaatctatcgggaactggctcgcctggtaccagcagaagcctggaaaagcgccgaagctgcttatttataaagtgagcacactggagtccggcgtgccctctcgcttcagcgggtccggaagcggcaccgaatttacactcaccatcaattctctgcagcctgacgatttcgctacatactattgtcaaagatacacctccaacagccaggggtttacgttcggacagggcaccaaacttgagattaag

SEQ ID NO: 42996 - RNA, 327 nt, synthetic construct
  misc_feature 1..327: note = derived and/or modified sequence opt5 from anti-influenza_Chain
  source 1..327: mol_type = other RNA
gacatcgtgatgacccagagccccgccacactgtccgtctctcctggcgagagagctacgctcagctgccgggcctcccaagttgtggggaccaacctggcgtggtaccagcagaagccgggacaggctccccgccttctgatttatgccgcctctacaagagctaccggcatccctgcccggttcagcgggtccggatttggcacagatttcaccctcacaatttctagcctgcaatccgaagactttgctgtgtactattgtcagcagtacaataactggccccttagcttcgggggaggcaccaaagtcgagatccgcagaacg

SEQ ID NO: 42997 - RNA, 327 nt, synthetic construct
  misc_feature 1..327: note = derived and/or modified sequence opt5 from anti-influenza_Chain
  source 1..327: mol_type = other RNA
gacatccagatgacccaaagcccctcctctctgagcgcctccgtgggcgatagagtcacaattgtttgccgggcttctcaggggatcaacacgcacctccattggtaccagcagaagcctggaaaagccccgaagctgcttatttatagcgcgtccaccctgcacacaggcgtgccctctcgcctcagcgggtccggaagcggcaccgacttcacactgtctatctccagccttcaacctgaggattttgctacctactattgtcagcagtcttacaattatcccagaacattcgggcagggaaccaacgtggacattaaacggacg

SEQ ID NO: 42998 - RNA, 327 nt, synthetic construct
  misc_feature 1..327: note = derived and/or modified sequence opt5 from anti-influenza_Chain
  source 1..327: mol_type = other RNA
gacatcctgatgacccagagcccctcctctctcagcgcctccgtgggcgatagagtcacaattacgtgccgggcttctcaagacatccgcaacagactggcctggtaccagcagaagcctgggaaagcgccgaagcggcttatttatgctgccagctccctgcagtctggagttcccagccgcttctccggcagcgggtctggaaccgagtttacactcaccatcaattccctgcaacctgaagatttcgccacatactattgtcttcagcacaacagctacccctggacctttggccctgggacaaaagtggagattaagagaacc

SEQ ID NO: 42999 - RNA, 327 nt, synthetic construct
  misc_feature 1..327: note = derived and/or modified sequence opt5 from anti-influenza_Chain
  source 1..327: mol_type = other RNA
gacatcgtgatgacccagagccccgccacactgtccgtctctcctggcgagggggctacgctcagctgcagagcctcccaaggaattggctctaacctggcgtggtaccagcacaagccggggcaggctccccggcttctgatctatgccgccagcacccgcgctacaggagttcctgccagattctccggctctgggagcggaaccgaatttacactcaccatttccagcctgcagtctgaggatcttgctgtgtacttctgtcaacagtataatacatggcccctgacctttggcggcgggacgaaagtggaaatcattcggacc

SEQ ID NO: 43000 - RNA, 327 nt, synthetic construct
  misc_feature 1..327: note = derived and/or modified sequence opt5 from anti-influenza_Chain
  source 1..327: mol_type = other RNA
gacatcgtgatgacccagagcccctccacactgtctgccagcgtcggcgatagagttacgattacctgccgggcttcccaaacaatctaccgctggctcgcctggtatcagcagaagcctgggaaagcgccgaaggtgctgatttacaaggcttctacccttgagagcggagtgccctccagattctctggcagcgggtccggaacagaatttaccctggccatcagctctctccagcctgacgatttcgccacatattactgtcaacagtataactcctttccctaccggttcggccaggggaccaaagtcgagattaaacgcacg

SEQ ID NO: 43001 - RNA, 327 nt, synthetic construct
  misc_feature 1..327: note = derived and/or modified sequence opt5 from anti-influenza_Chain
  source 1..327: mol_type = other RNA
gacatcgtgatgacccagagcccctcctctctgagcgcctccgtcggcgatagagtttctattacatgccgggctagccaaacgatcacccgcttcctcaactggtaccagcagaagcctgggaaaggaccgaagctgcttatttatgccgcgtccacagtgcacagaggcgtgccctctcggtttagcgggtccggaagcggcaccgacttcacactgaccatctcttccctccagcctgaggattttgctacatactattgtcaacagagctactctgcccccttcacctttgggcctggaacgaccgtcgacattcgcagaaca

SEQ ID NO: 43002 - RNA, 327 nt, synthetic construct
  misc_feature 1..327: note = derived and/or modified sequence opt5 from anti-influenza_Chain
  source 1..327: mol_type = other RNA
gacatcgtgatgacccagccccctgccacactgagcgtctccccgggcgagagagctacgctctcttgcggggccagccaaggactgggctccaaccttgcgtggtaccagcagaagcccgggcaggctcctcggctgctcatttatgccgcctctacccgcgctacaggaatcaccgccagattcagcggctccgggtctggaacagaatttaccctgacaattaatagccttcaatccgaggatttcgctctgtactattgtcagcagtacacctattggcccctcacgtttggcggcgggaccaaagttgaaatcaagcggaca

SEQ ID NO: 43003 - RNA, 327 nt, synthetic construct
  misc_feature 1..327: note = derived and/or modified sequence opt5 from anti-influenza_Chain
  source 1..327: mol_type = other RNA
gacatcgtgctgacccagagccccgccacactctccgtctctcctggcgagagagctacgctgagctgccgggcctcccaatctgttaaccgcaatcttgcgtggttccagcagattccggggcaggctcccagactgctcatctttgatgccagcacccgggccgctgacattcctgcccgcttctccggaggcgggtctggagctgaatttacactgaccgtgagctcccttcaacccgaggatttcgccgtgtactattgtcagcagtacgacaagtggcctcccggctttgggcagggaacaaaagtcgaaatcaagagaacc

SEQ ID NO: 43004 - RNA, 330 nt, synthetic construct
  misc_feature 1..330: note = derived and/or modified sequence opt5 from anti-influenza_Chain
  source 1..330: mol_type = other RNA
cagagcgtgctgacccaacccccttccgcctctggcgctccggggcagagagtcacactcagctgctccggatctggcagcaacatcgggtccaatacggtttcttggtaccagcagctgcccggaaccgcccctaaacttctggtgttcacaaacaatcaacggcccagcggcgtgcctgaccgcttttccgggagcaagtctggaacctccgcgagcctcgctatttctggcctgcagtccgaggatgaagccgactattactgtgccgcttgggatgacagccttaacggccagctgttcgggggaggcacaaagctcaccgtcctg

SEQ ID NO: 43005 - RNA, 330 nt, synthetic construct
  misc_feature 1..330: note = derived and/or modified sequence opt5 from anti-influenza_Chain
  source 1..330: mol_type = other RNA
cagagcgtgctgacccaacccccttccgtctctgccgctccgggccagagagttacaatcagctgctccgggacgtctagcaacattggaaagaattacgtgtcctggtatcagcagctccccggcgccgcgcctaaactgcttatctacgacaacgataagcggccctctgggattcctgaccgcttcagcggatccaaaagcggcacctctgctacactggggatcaccggactccaaacaggcgatgaggccgactattactgtggcacctgggattccagcctgtctgtggggatgtttggaggcgggacaagacttaccgtcctg

SEQ ID NO: 43006 - RNA, 330 nt, synthetic construct
  misc_feature 1..330: note = derived and/or modified sequence opt5 from anti-influenza_Chain
  source 1..330: mol_type = other RNA
gagaccacactgacgcagagccccgccaccctctccgtgtctcctggcgaaagagctacactgagctgccgggcctcccaatctgtcagccgcaaccttgcgtggtaccagcagaagccggggcaggctcccagactgctcatctatggagcctcctctcgggccaccggcattcctgaccgcttcagcgggtccggaagcggcacagattttaccctgacaatctctagacttgagcccgaagacttcgctgtttactattgtcaacagtacgggtccagctctattacctttggacagggcacgcggctggagatcaaacgcaccgtg

SEQ ID NO: 43007 - RNA, 330 nt, synthetic construct
  misc_feature 1..330: note = derived and/or modified sequence opt5 from anti-influenza_Chain
  source 1..330: mol_type = other RNA
cagagcgtgctgacccaacccccttccgcctctggcacaccggggcagagagtcacgatcagctgctccggatctagctccaacattggctctaataccgttaactggtacaagcagctccccgggacagctcctcggctgcttatctatagcaatgaccagcgcccctccggagtgcctgatagattcagcggctctaagtccgggaccagcgcctctctggcgatttccggactccaaagcgaggacgaagctaactactattgtgccgcctgggatgactctctgtccggctgggtgtttggcgggggaacaaaacttaccgtcctg

SEQ ID NO: 43008 - RNA, 330 nt, synthetic construct
  misc_feature 1..330: note = derived and/or modified sequence opt5 from anti-influenza_Chain
  source 1..330: mol_type = other RNA
cagagcgccctgacccaacccagatccgtgtctggcagccctgggcagtccgtcacaatctcttgcacgggaagctcctctgacgttggcgctagcaactccgtgagctggtaccagcagcacccggggaaggcccccaaactcgtgatttatgatgtcaccgagcggccttctggagtgccccatcgcttctccggcagcaagtctgggaatacagcgtccctgaccgttagcggacttcaacctgaagacgaggctgattacttttgttgcgcctatggcggcaaatacctggtggtcttcgggggaggcacaaaggtgaccgttctc

SEQ ID NO: 43009 - RNA, 330 nt, synthetic construct
  misc_feature 1..330: note = derived and/or modified sequence opt5 from anti-influenza_Chain
  source 1..330: mol_type = other RNA
cagagcgccctgacccaacccgcttccgtgtctggcagccctgggcagtccatcacaatttcttgcacgggaaccagctccgacgtcggcgggtacaactatgtttcttggtaccagcagcacccgggaaaggcccccaaactcctgatctatgaggtgacaaattggcctagcggcgtgtccaacagattcagcgggtctaagtccggaaataccgcgagccttacaatttctggcctgcaagctgaagatgaggccgactactattgttccagctacgccgggtcttccacctgggtctttggcggaggcacacgggtgaccgttctc

SEQ ID NO: 43010 - RNA, 330 nt, synthetic construct
  misc_feature 1..330: note = derived and/or modified sequence opt5 from anti-influenza_Chain
  source 1..330: mol_type = other RNA
cagaccgtggtcacacaagagcccagcctgacggtttcccctggcgggaccgtgacactgacctgcgcctctagcacaggagctgtgacctcctcttacttcccgaactggtttcagcagaagcccggccaggcccctagacccctcatctatagcacaaccattcggcactcctggacgcctgcgcgcttctctgggagccttctgggaggcaaagctgccctcaccctgtccggggtccaacccgaagacgaggccgattactattgtcttctgtacagcggaggcgaccctgtggcttttggcgggggaacaaagctcaccgttctg

SEQ ID NO: 43011 - RNA, 330 nt, synthetic construct
  misc_feature 1..330: note = derived and/or modified sequence opt5 from anti-influenza_Chain
  source 1..330: mol_type = other RNA
cagagcgtgctgacccaatccccctctgtcagcgccgctcctggccagaaggttacaatctcctgctctgggagcgactccaacattggagattacttcgtgtgttggtatcagcacctcccgggcaaaccccctcagctgcttatctacgagaataacaagagaccctctgggattcctgaccggtttagcggatccaaaagcggcacgtctgccaccctggggatcacaggcattcaaaccggagatgaagcggactattactgcgctacatgggatggctccctcagcgcctgggtgttcgggggaggcaccaagctgacagtcctt

SEQ ID NO: 43012 - RNA, 330 nt, synthetic construct
  misc_feature 1..330: note = derived and/or modified sequence opt5 from anti-influenza_Chain
  source 1..330: mol_type = other RNA
cagagcgccctgacccaacccagatccgtgtctggcagccctgggcagtccatcacaatttcttgcacgggaggcagctccgacatcggggcttctaacagcgtctcctggtaccagcagcacccgggaaaggcccccaaactcgttattttcgatgtgaccgagcggcctagcggcgtgccccatcgcttttctgggtccaagagcggaaatacagcgtctctgaccgtctccggccttcaacctgacgatgaagctgactatttctgttgcgcctacggcgggaaatatctggtggtttttggaggcgggacaaaggtgaccgtcctc

SEQ ID NO: 43013 - RNA, 330 nt, synthetic construct
  misc_feature 1..330: note = derived and/or modified sequence opt5 from anti-influenza_Chain
  source 1..330: mol_type = other RNA
caggccgtggtcacccaagagcccagcctggctgtttcccctggcgggacagtgacgctgacctgcggatctagcacaggcgccgtgaccagagggcactacccgtattggttccagcagaagcccggacaggcgcctcgggctctcatctacgactccgccggcaaccgccattcttggacacccgccagatttagcgggtcccttctgggaggcaaagctgccctcaccctgtctggcgctcaacctgaagatgaggccgaatattactgtcttctgagctattccggggtctgggtgttcggaggcgggacaaagctcaccgttctg

SEQ ID NO: 43014 - RNA, 330 nt, synthetic construct
  misc_feature 1..330: note = derived and/or modified sequence opt5 from anti-influenza_Chain
  source 1..330: mol_type = other RNA
gagatcgtgatgacccagagccccgccacactgtccgtctctcctggcgaaagagttacgctcagctgccgggcttcccaatctattaccgacgggctggcctggtaccagcaaaagagcggacaggcgccgcgccttctgatctatggcgcttccacaagagccaccgggattcccgcccggttctctggaagcggctccgggacagagtttaccctcacaatcagctctctgcagtccgaagatttcgctgtgtactattgtcagcagtacaacaattggcctcccgtgacctttggacagggcacgaaagtcgagattaagcgcacc

SEQ ID NO: 43015 - RNA, 330 nt, synthetic construct
  misc_feature 1..330: note = derived and/or modified sequence opt5 from anti-influenza_Chain
  source 1..330: mol_type = other RNA
agctccgagctgacccagcccccttctgccagcggcacaccggggcaaagagtgacgatctcctgctctggaagcacctccaacattggctacaatcccgtctcttggtatcagcaggttcctgggacagctcccaagctcctgatctacagcaacaccgaacggccttccggagtgcccgaccgcttcagcggctctaaatccgggacaagcgcctctcttgcgatttccggactgcagagcgaggatgaagctgactattactgtgccgcctgggatgacaccctcaatggccctgtgtttggcgggggaacaaaggtcaccgtgctg

SEQ ID NO: 43016 - RNA, 330 nt, synthetic construct
  misc_feature 1..330: note = derived and/or modified sequence opt5 from anti-influenza_Chain
  source 1..330: mol_type = other RNA
cagagcgccctgacccaacccgcttccgtgtctggcagccctgggcagtccatcacaatttcttgcacgggaaccagctccgacgtcggcgggtacaactatgtttcttggtaccagcagcacccgggagaggcccccaagctcatgatcagcgatgtgtccaatagacctagcggcgtgtctaaccggttctccgggagcaaatctggaaatacagcgtccctgaccattagcggccttcaagctgaagacgaggccgattattactgtacatcttatacctccagcaacacactggtctttggcgggggaaccaagctcacggtgctg

SEQ ID NO: 43017 - RNA, 330 nt, synthetic construct
  misc_feature 1..330: note = derived and/or modified sequence opt5 from anti-influenza_Chain
  source 1..330: mol_type = other RNA
cagagcgtgctgacccaacccccttccgtctctgccgctccgggccagaaggttacaatcagctgctccgggtctagctccaacattggacacaatttcgtgtcttggtaccagcagctccccgccacggcgcctaagctgcttatctatgacaccgataagagacccagcggcattcctgaccggttttccgggagcaaatctggaacatccgctaccctgggcatcacagggctccaaaccggagatgaggccgactactattgtggcacatgggatagctctctgtccagcgtgattttcggcgggggaaccaaacttacggtcctg

SEQ ID NO: 43018 - RNA, 330 nt, synthetic construct
  misc_feature 1..330: note = derived and/or modified sequence opt5 from anti-influenza_Chain
  source 1..330: mol_type = other RNA
gacatccagatgacccaaagcccctccacactgtctgccagcgtgggcgatagagtcacgattacctgccgggcttcccagacaatcaacaattacctcgcctggtatcagcagaagcctgggaaagcgccgaagctgcttatttacaaggcttctagcctggagtccggagttccctctcgcttcagcggctccgggagcggaaccgaatttacactcaccatctcttccctgcaacctgacgatttcgccacatattactgtcaggagtataacaatgacagcccccttacctttggcgggggaacgaaagtggaaattaaaagaacc

SEQ ID NO: 43019 - RNA, 330 nt, synthetic construct
  misc_feature 1..330: note = derived and/or modified sequence opt5 from anti-influenza_Chain
  source 1..330: mol_type = other RNA
gacatcgagctgacccaggatcccagcgtgtccgtcgcccctggccaaacagctcggattccgtgcgttagattcaacatggggcccacgtctgtgcactggtaccagcagaagcctggacaggcccccgtgctcgtcgtgtatgacgatagcgaccgcccttccggcatccccgaaagattttctgggagcaattccggagattctgcgaccctgacaattagccgggttgaggctggcgacgaagccgattactattgtcaagtgtgggacatgtccagcgatcgcagagtcttcgggggaggcaccacacttaccgtgctgggccag

SEQ ID NO: 43020 - RNA, 330 nt, synthetic construct
  misc_feature 1..330: note = derived and/or modified sequence opt5 from anti-influenza_Chain
  source 1..330: mol_type = other RNA
gacatcgtgatgacccagagccccggcacactgtccctctctcctggggagagagccacgctgtactgccgggctagccaatccgtccgctctggatatcttgcctggtaccagcacaagccgggccaggcgcccctgctcctgttctatgatgctagcgggagagccaccggcattcctgaccggttttccggatctgggagcggaacagatttcacccttacaatctcccgcctggaacccgaggactttgccgtttactattgtctccagtacggcagctctcctagaaccttcggccaagggacaaaagtggaaattaagcggacc

SEQ ID NO: 43021 - RNA, 330 nt, synthetic construct
  misc_feature 1..330: note = derived and/or modified sequence opt5 from anti-influenza_Chain
  source 1..330: mol_type = other RNA
gacatcgtgctgacccagagcccctccttcctctctgccagcgtcggcgatagagttacaattacgtgccgggcttcccaactgatctctagctactttgcctggtatcagcagaagcctgggaaaccgcccaaacttctgatttacgcggcttccaccctccagtctggagtgcctagccgcttctccggcagcgggtctggaacacaattttccctgaccatcagctctcttcagcccgaggacttcgccacatattactgtcagcagctgaactcctatcctcccattacctttggccaagggacaagactcgaaatcaagcggacc

SEQ ID NO: 43022 - RNA, 330 nt, synthetic construct
  misc_feature 1..330: note = derived and/or modified sequence opt5 from anti-influenza_Chain
  source 1..330: mol_type = other RNA
gacatcaccctgacacagagccccgccacgctctccgtgtctcctggcgagagagctaccctgagctgccgggcctcccaatctgtcagctccaaccttgcgtggtaccagcagaagccggggcaggctccccgcctgctcatttatggagcctctaatagagccacagatatccctgctcggttcagcggctccgggagcggaaccgaatttacactgaccatttcttcccttcaaagcgaggacttcgccgtttactattgtcagcagtttaacgattggcccttcctgacatttggcgggggaaccaaagtggaaatcaagcgcacg

SEQ ID NO: 43023 - RNA, 330 nt, synthetic construct
  misc_feature 1..330: note = derived and/or modified sequence opt5 from anti-influenza_Chain
  source 1..330: mol_type = other RNA
gacatcgtgatgacccagagcccctccttcctgtctgccagcgtcggcgatagagttacaattacgtgccggacctcccaagtgatctctagctacctcgcttggtaccagcagcgccctgggaaggccccgaaactgcttatttacgcggcttccacactgcagtctggagtgcccagcagattttccggcagcgggtctggaacccggttctccctcacaatcagcaacctgcaacctgaggactttgccacctatttctgtcagcagcttacaacctatccccctattacgtttggccaggggacccgcctggaaatcaagagaaca

SEQ ID NO: 43024 - RNA, 330 nt, synthetic construct
  misc_feature 1..330: note = derived and/or modified sequence opt5 from anti-influenza_Chain
  source 1..330: mol_type = other RNA
gacatcgtgctgacccagagcccctccgtctctgttgcccctggccaaacagctagaattacgtgcgggggaaacgatatcggcagcaagtccgtgcactggtaccagcagaaaccggggcaggcccccgtgctcgtcgtgttcgacgatcgggaccgcccttctggcattcccgagagatttagcggatccaattctgggaacaccgcgacactgaccatcagccgggttgaagctggagatgaggccgactattactgtcaagtgtgggatattacatccgaccttgtcgtgttcggcggcgggaccaagctgacagttgtgggacag

SEQ ID NO: 43025 - RNA, 330 nt, synthetic construct
  misc_feature 1..330: note = derived and/or modified sequence opt5 from anti-influenza_Chain
  source 1..330: mol_type = other RNA
gacatcgtgatgacccagccccctggcacactgagcgtctccccgggggagagagccacgctctcttgccgggctagccaatccgtttctaccaacctggcctggtaccagcagaagcccggacaggcgcctcgccttctgattcacggcgctagcacaagagccaccgggatccccgcccggttctccggatctggcagcggggctgaatttacactcaccatttccagcctgcaatctgaggatgtggccgtgtattactgtcagcagtatgacaattggcttcctatcacattcggacccggcaccaaagtcgatattcagcgcacg

SEQ ID NO: 43026 - RNA, 330 nt, synthetic construct
  misc_feature 1..330: note = derived and/or modified sequence opt5 from anti-influenza_Chain
  source 1..330: mol_type = other RNA
gaccccatgctgacccagacagccagccctgtgtccgctgccgtcggcgggacggttaccatcaactgccaagcgtctcagagcgtgtacaataagaacaatctcgcttggtatcagcagaaactgggacaaccgcccaaacttctgatttacgccgcctccacactcacctctggcgtgcctagcagattcaaggggtccggatctggcacacagtttaccctgacaatcagcgatcttgagtgtgacgatgctgccacctattactgcgctggggactattccggaggcatttacgccttcggcgggggaacgaaggtcgaaatcaaa

SEQ ID NO: 43027 - RNA, 330 nt, synthetic construct
  misc_feature 1..330: note = derived and/or modified sequence opt5 from anti-influenza_Chain
  source 1..330: mol_type = other RNA
gagctggtgatgacccagacacccgccagcgtctccgctgccgttggcgggacggtgaccatctcttgccaaagctccgaatctgtgtacaagaacaataacctcgcgtggttccagcagaaactgggacagcctccgaaacttctgatttatgacgctagcaagctcgcctccggcgtcccctctagatttagcgggtccggaagcggcacacaattcaccctgacaatctctgatcttgagtgtgacgatgccgctacctactattgcgccggggactactccggaagcaattatgcttttggcggcgggacaaagctggaaattaaa

SEQ ID NO: 43028 - RNA, 330 nt, synthetic construct
  misc_feature 1..330: note = derived and/or modified sequence opt5 from anti-influenza_Chain
  source 1..330: mol_type = other RNA
gagcccatgctgacccagacagccagctccgtgtctgctgccgtcggcgggagcgttacgatctcctgccaatctagccagtccgtggactctaacaatcagctcagctggtaccagcaaaagcctggacagccgcccaaactgcttatttatgcggcttccaccctgacaagcggcgtgccttctagattcaaggggtccggaagcggcacccagtttacactcaccatctctgatctggaatgtgacgatgccgccacatactattgcgctggggactactccggaggcatttatgccttcggcgggggaaccgaggtcgtggttaaa

SEQ ID NO: 43029 - RNA, 330 nt, synthetic construct
  misc_feature 1..330: note = derived and/or modified sequence opt5 from anti-influenza_Chain
  source 1..330: mol_type = other RNA
gaccccatgctgacccagacagccgctagcgtgtccgccgcggtcggcgggacggttaccatctcttgccaaagctccgagtctgtgtacaagaacaataacctcgcttggttccagcagaaactgggacagcctccgacacttctgatttgggatgccagcaagctcgcctccggcgtgccctctagatttagcgggtccggaagcggcacccaattcacactgaccatctctgaccttgaatgtgatgacgctgccacatattactgcgctggggattattccggagtcaattacgcctttggcggcgggaccgaggtggttgtgaaa

SEQ ID NO: 43030 - RNA, 330 nt, synthetic construct
  misc_feature 1..330: note = derived and/or modified sequence opt5 from anti-influenza_Chain
  source 1..330: mol_type = other RNA
gagctggtgatgacccagacacccgccagcgtctccgctgccgttggcgggacggtgaccatctcttgccaaagctccgaatctgtgtacaagaacaataacctcgcgtggttccagcagaaactgggacagcctccgaaacttctgatttatgacgctagcaagctcgcctccggcgtcccctctagatttagcgggtccggaagcggcacacaattcaccctgacaatctctgatcttgagtgtgacgatgccgctacctactattgcgccggggactactccggaagcaattatgcttttggcggcgggacagaagtggttgtgaag

SEQ ID NO: 43031 - RNA, 330 nt, synthetic construct
  misc_feature 1..330: note = derived and/or modified sequence opt5 from anti-influenza_Chain
  source 1..330: mol_type = other RNA
gaccccatgctgacccagacagccagctccgtgtctgctacggtcggcgggaccgttacaatcagctgccaatcctctcagagcgtggataacaataaggacctcgcctggttccagcagaaacctggacactccccgaagctgcttatttactttgcgtctagactggctagcggcgtgccctcccggttcaaagggagcggatctggcacccattttacactcaccatctccgatctggagtgtgacgatgccgccacatattactgcgctggggactatagcggagccaactacgctttcggcggcgggaccaaacttgaaattaag

SEQ ID NO: 43032 - RNA, 330 nt, synthetic construct
  misc_feature 1..330: note = derived and/or modified sequence opt5 from anti-influenza_Chain
  source 1..330: mol_type = other RNA
gaccccatgctgacccagacagccagccctgtgtccgctgccgtcggcgggacggttaccatcaactgccaatctagccagtccgtgtacaataacaatagactctcttggttccagcagaagccgggacaaccccctaaactgcttatttatagcgcgtccacactggcttctggcgtgagctcccggtttaaggggagcggatctggcacccagttcacactcaccatctccgatctggagtgtgacgatgccgccacatactattgcgctggggactacagcggaggcatttatgcctttggcgggggaaccgaacttgagatcctg

SEQ ID NO: 43033 - RNA, 330 nt, synthetic construct
  misc_feature 1..330: note = derived and/or modified sequence opt5 from anti-influenza_Chain
  source 1..330: mol_type = other RNA
gagctggtgctcacccagacacccgccagcgtctccgctgccgttggcgggacggtgtctatcagctgccaatcctctcagagcgtgtacaagaacaataacctggcgtggttccagcagaaacttggacaacctccgaccctgctcatttgggacgcttccaagctggcctctggcgtccccagcagattttccgggagcggatctggcacacagttcacccttacaatctccgatctggaatgtgacgatgccgctacctattactgcgccggggactatagcggagtgaattacgcttttggcggcgggacaaaactcgagattaag

SEQ ID NO: 43034 - RNA, 330 nt, synthetic construct
  misc_feature 1..330: note = derived and/or modified sequence opt5 from anti-influenza_Chain
  source 1..330: mol_type = other RNA
gagctggacctcacccagacacccgccagcgtgtccgctgccgtcggcgggacggttaccatctcttgccaaagctccgaatctgtgtacaagaacaataacctggcgtggttccagcagaaacttggacagcctccgacactgctcatttgggatgctagcaagctggcctccggcgtgccctctagatttagcgggtccggaagcggcacccaattcacacttaccatctctgacctggagtgtgatgacgccgctacatattactgcgccggggattattccggagtcaattacgcttttggcggcgggaccgaagtggttgtgaaa

SEQ ID NO: 43035 - RNA, 330 nt, synthetic construct
  misc_feature 1..330: note = derived and/or modified sequence opt5 from anti-influenza_Chain
  source 1..330: mol_type = other RNA
gacatccagatgacccaaagcccctcctctctgagcgcctccgtgggcgatagagtcacaattacgtgccagtctagcgagtccgtttacaagaacaataacctcgcttggtatcagcagaaacctgggaagccgcccaaactgcttatctgggacgcctctaagctggcgagcggagtgccttcccggttcagcggctctgggtccggaaccgattttacactcaccattagctctctgcaacccgaagacgtggctacatactattgtgccggcgattactccggggtcaattatgccttcggaggcggcaccgaggtggttgtgaaa

SEQ ID NO: 43036 - RNA, 333 nt, synthetic construct
  misc_feature 1..333: note = derived and/or modified sequence opt5 from anti-influenza_Chain
  source 1..333: mol_type = other RNA
gacatcgtgatgacccagagccccgattccctggccgtctctctcggcgagagagctacaattaactgcaagagctcccaatctgttacgttcaataacaaaaattacctggcctggtatcagcagaagcctgggcagccgcccaaacttctgatctactgggcgagcacccgggaatccggagtgcctgaccgcttttctggcagcgggtccggaacagatttcaccctcacaattagctctctgcaagctgaggacgtggccgtctattactgtcagcagcactatagaacaccccctacctttggccaggggaccaaggtggaaatcaaa

SEQ ID NO: 43037 - RNA, 333 nt, synthetic construct
  misc_feature 1..333: note = derived and/or modified sequence opt5 from anti-influenza_Chain
  source 1..333: mol_type = other RNA
cagagcgccctgacccaacccgcttccgtgtctggcagccctgggcagtccatcacaatttcttgcacgggaaccggcagcgacgtcgggtcctctaacctcgttagctggtaccagcagcacccggccaaggcgcccaaactgatcatttatgaggtgacaaagagaccttccggagtgagcaatcggttctctggctccaaaagcgggaacaccgcttctcttacaatctccggactgcaagccgaagatgaggccgactactattgttgcagctacgctgggtcttccagctcccgcgtctttggcaccggcacaaaggtgaccgttctc

SEQ ID NO: 43038 - RNA, 333 nt, synthetic construct
  misc_feature 1..333: note = derived and/or modified sequence opt5 from anti-influenza_Chain
  source 1..333: mol_type = other RNA
cagagcgtgctgacccaacccccttccgcctctggcacaccggggcagagagtcacgatcagctgctccggatctaccagcaacattggctccaatgctgttaactggtaccagcagctccccgggacagcccctaagctgcttatctattctaataaccaacggcccagcggagtgcctgaccgcttctccggcagcaagtctgggacctccgcgagcctggctatttctggactccagtccgaggatgaagccgactactattgtgccgcttgggatgacagcctgtctggctcctgggtgtttggcgggggaacaaaacttaccgtcctg

SEQ ID NO: 43039 - RNA, 333 nt, synthetic construct
  misc_feature 1..333: note = derived and/or modified sequence opt5 from anti-influenza_Chain
  source 1..333: mol_type = other RNA
gagaccacactgacgcagagccccggcaccctctccctgtctcctggggaaagagccacacttagctgccgggtgtcccaatctgtcagctccaactacctggcttggtatcagcagaagccgggacaggcgccccgcctcctgatctacggcgcctctagcagagctaccgggattcctgaccggttctccggaagcggctctgggacagattttacccttacaatctcccgcctggagcccgaagacttcgccgtttattactgtcaacagtatggaaccagccctagagcctttggccacggcacgaaagtggagattaagcggaccgtg

SEQ ID NO: 43040 - RNA, 333 nt, synthetic construct
  misc_feature 1..333: note = derived and/or modified sequence opt5 from anti-influenza_Chain
  source 1..333: mol_type = other RNA
cagagcgtgctgacccaacccccttccgtctctggcgccccggggcagagagttacaatcagctgcggaggctcccggtctaacattggggctggatacgacgtgcactggtatcagcagttccccggcacggcccctaaggtggtcatctacgggaataacaatcgccccagcggagtgcctgatagattttccggctctaaaagcggcacctccgcgagcctcgctattacagggctgcaagccgaggacgaagccaactattactgtcagtcttatgataccaatcttggaggctccatcttcgggggaggcacacaggttaccgtgctg

SEQ ID NO: 43041 - RNA, 333 nt, synthetic construct
  misc_feature 1..333: note = derived and/or modified sequence opt5 from anti-influenza_Chain
  source 1..333: mol_type = other RNA
aacttcatgctgacccagccccacagcgtgtccgagtctcctggcaagacagtcacgatcagctgcaccgggtcctctggaagcattgcctccaattacgttcaatggtatcagcagagaccgggctctgctcccacaaccgtgatctacgaagactatcagcggcctagcggggtgcccgatcgcttttccggaagcattgactcttccagcaactctgcctccctcacaatcagcggcctgaaaaccgaggatgaagcggactactattgtcaatcttacgatgactccgatcatcttattttcgggggaggcacaaagctgaccgtcctc

SEQ ID NO: 43042 - RNA, 333 nt, synthetic construct
  misc_feature 1..333: note = derived and/or modified sequence opt5 from anti-influenza_Chain
  source 1..333: mol_type = other RNA
cagagcatgctgacccaacccccttccgcctctggcacaccggggcagagagtgacgatcagctgctccggatctagctccaacattggctctaataccgtcaactggttcaagcacctccccgggacagctcctaaactgcttatctaccggaatgacctgcgccccagcggagttcctgatagattttccggcagcaagtctgggacctccgccagcctcgcgatttctggactgcagtccgaggacgaagctgattattactgtgccacatgggacgatagccttaacggcttctatgtgtttggcaccgggacaaaagtgaccgtcctg

SEQ ID NO: 43043 - RNA, 333 nt, synthetic construct
  misc_feature 1..333: note = derived and/or modified sequence opt5 from anti-influenza_Chain
  source 1..333: mol_type = other RNA
gacatccagctgacccaaagcccctcctctctcagcgcctccgctggcgatagagtgtctatgacatgccgggccagccagattatctcctctagcctgaactggtaccagcagaagcctgggaaagcgccgaaacttctgatttatgctgcctccaatctccaaagcggagtcccctctcgcttctccggcagcgggtctggaacggactttaccctgacaatctccagccttcagcctgaggatttcgccacctactattgtcagcagtcttactccacaccccctgaactgacctttggcgggggaacaaaggttgacattaagagaacc

SEQ ID NO: 43044 - RNA, 333 nt, synthetic construct
  misc_feature 1..333: note = derived and/or modified sequence opt5 from anti-influenza_Chain
  source 1..333: mol_type = other RNA
agctacgtgctgacccagcccccttccgcctctggcacaccggggcaaagagtcacgatcagctgctccggatctaccttcaacattggcagcaatgctgttgactggtatcggcagctccccgggacagcccctaagctgcttatctactccaacaatcagcgcccctctggagtgcctgatagatttagcggctcccggagcgggacctctgcgtccctggctattagcggactccagtctgaggacgaagccgattattactgtgccgcttgggacgatatcctgaacgtgcccgtcttcggcggcgggacaaaacttaccgtgctggga

SEQ ID NO: 43045 - RNA, 333 nt, synthetic construct
  misc_feature 1..333: note = derived and/or modified sequence opt5 from anti-influenza_Chain
  source 1..333: mol_type = other RNA
cagagcgccctgacccaacccgctgccgtgtccggctctcctgggcagagcatcacaatttcctgcacgggaacctctagcgacgtcggcgggtacaactatgtttcctggtaccagcagcacccgggaaaggcgcccaaactcatgatctatgaggtgtctaatagacctagcggcgtgtccaaccggttcagcgggtctaagtccggaaatacagctagcctgaccatttctggccttcaagccgaagatgaggccgactactattgttccagctacacatcttccagcacctatgtctttggcacagggaccaaagtgacggttctggga

SEQ ID NO: 43046 - RNA, 333 nt, synthetic construct
  misc_feature 1..333: note = derived and/or modified sequence opt5 from anti-influenza_Chain
  source 1..333: mol_type = other RNA
agctacgtgctgacccagcccccttccgtctctggcacaccggggcaaagagttacgatcagctgctccggatctcggagcaacgtgggcgacaattccgtgtattggtaccagcacgtccccgagatggcccctaagctcctggtgtataaaaacacccagcgcccctctggggttcctgctagattcagcggatccaagagcggcacatctgcctcccttgcgattatcgggctgcagagcggagatgaagctgactactattgtgtggcctgggatgactctgtcgatggctacgtgtttggctccgggaccaaagttacagtgctcgga

SEQ ID NO: 43047 - RNA, 333 nt, synthetic construct
  misc_feature 1..333: note = derived and/or modified sequence opt5 from anti-influenza_Chain
  source 1..333: mol_type = other RNA
agcgtgctgacccagcccccttccgtctctgccgctccgggccaaaaggttacaatcagctgctccgggtctagctccaacattggaaatgactacgtgtcttggtatcagcagctccccggcacggcccctaaactgcttatctacgataacaataagagacccagcgggattcctgaccggttctccggaagcaaatctggcacctccgcgacactggggatcaccggactccagacaggcgatgaggctaactattactgtgccacctgggaccgcagacccacagcctatgtggtctttggcgggggaaccaagctgacggtgcttggc

SEQ ID NO: 43048 - RNA, 333 nt, synthetic construct
  misc_feature 1..333: note = derived and/or modified sequence opt5 from anti-influenza_Chain
  source 1..333: mol_type = other RNA
cagagcgccctgacccaacccagatccgtgtctggcagccctgggcagtccgtcacaatctcttgcacgggaaccagctccgacgttggcgggtacaactatgtgtcttggtaccagcagcacccgggaaaggctcccaaactcatgatttatgatgtgagcaagcggccttccggcgtccccgaccgcttcagcgggtctaaatccggaaatacagccagcctgaccatctctggccttcaagcggaggatgaagctgactactattgttccagctacacatcttccagcacccatgtgtttggcacagggaccaaggttacggtgctggga

SEQ ID NO: 43049 - RNA, 333 nt, synthetic construct
  misc_feature 1..333: note = derived and/or modified sequence opt5 from anti-influenza_Chain
  source 1..333: mol_type = other RNA
agctacgtgctgacccagcccccttccgcctctggcacaccggggcaaagagtcacgatcagctgctccggatctagctccaacattggctctaattatgtttactggtatcagcagctccccgggaccgctcctaagctgcttatctaccgggacggacagcgccccagcggcgtgcctgatagattctccgggagcaagtctggaacatccgccagcctggcgatttctggcctccggtccgacgatgaggctgactattactgtgccacctgggatgacaacctgagcggccccgtgtttgggggaggcacaaaacttaccgtcctgggg

SEQ ID NO: 43050 - RNA, 333 nt, synthetic construct
  misc_feature 1..333: note = derived and/or modified sequence opt5 from anti-influenza_Chain
  source 1..333: mol_type = other RNA
cagagcgccctgacccaacccgcttccgtgtctggcagccctgggcagtccatcacaatttcttgcacgggaaccagctccgacgtcggcgggtacaactatgtttcttggtaccagcagcacccgggaaaggcccccaaactcatgatctatgaggtgagcaatagaccttccggcgtgagcaaccggttctctgggtccaagagcggaaatacagcgtctctgaccatttccggccttcaagctgaagatgaggccgactactattgtagctcttacacatccagctccaccctggtctttggcacagggaccaaagtgacggttctcgga

SEQ ID NO: 43051 - RNA, 333 nt, synthetic construct
  misc_feature 1..333: note = derived and/or modified sequence opt5 from anti-influenza_Chain
  source 1..333: mol_type = other RNA
accgtgctgacacagccccctagcgtctccggcgccccggggcaaagagttacgatctcttgcaccggaagctcctctaacattggcgctgggtacgacgtgcactggtatcagcagctccccggaacagcccctaagctgcttatctacggcaatagcaaccggccctccggggtgcctgatcgcttctctggaagcaaatccggcaccagcgcgacactgggcattaccgggctccagacaggagacgaggctgattattactgtggcacctgggactcttccctgagcgcctatgtctttgggacgggaaccaaggtgacagttcttggc

SEQ ID NO: 43052 - RNA, 333 nt, synthetic construct
  misc_feature 1..333: note = derived and/or modified sequence opt5 from anti-influenza_Chain
  source 1..333: mol_type = other RNA
ggcagcgccctgacccagcccagatccgtgtctgggagccctggacaatccgtcacaatctcttgcacgggcaccagctccgacgttgggggatacaactatgtgtcttggtaccagcagcacccgggcaaggctcccaaactcatgatttatgatgtgagcaagcggccttccggggtccccgaccgcttcagcggatctaaatccggcaatacagccagcctgaccatctctggccttcaggcggaggatgaagctgactactattgttccagctacacatcttccagcacccatgtgtttgggacaggaaccaaggttacggtgctgggc

SEQ ID NO: 43053 - RNA, 333 nt, synthetic construct
  misc_feature 1..333: note = derived and/or modified sequence opt5 from anti-influenza_Chain
  source 1..333: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgattttcggcgctagcaccagagccacagggatccctgaccggttttccggaagcggctctgggaccgatttcacacttaccatttcccgcctggagcccgaagactttgccgttttctactgtcaacagtatggaagcctccctctgacatttggcggcgggaccaaagtggagatcaagggaacggtg

SEQ ID NO: 43054 - RNA, 333 nt, synthetic construct
  misc_feature 1..333: note = derived and/or modified sequence opt5 from anti-influenza_Chain
  source 1..333: mol_type = other RNA
gagatcgtgctgacccagagccccggcacactctccctgtctcctggggaaagagccacgcttagctgccgggcttcccaatctgtccgcagcaacaatctggcctggtaccagcacaagccgggacaggcgcccagactcctgattttcggcgcttcctctcgggccaccgggatccctgaccgctttagcggatccggcagcgggacagatttcacccttacaatttctagactggagcccgaagactttgccgtttattactgtcagcaatatggatccagccctgctctcaccttcggcggcgggacaaaagtggagatcaagcggacc

SEQ ID NO: 43055 - RNA, 333 nt, synthetic construct
  misc_feature 1..333: note = derived and/or modified sequence opt5 from anti-influenza_Chain
  source 1..333: mol_type = other RNA
cagagcctggaggaatccggcgggggactcgtgaagcccggcgggtctctgacccttacatgcacggtcagcggactgtccctctactctaacgagatcaattgggttagacaagcccctggcaacgggctggaatggattggagctatcgccggcagcggctccgcggactatgcttcttgggccaaagggcggagcaccattacacgcaataccgatcttaacacagtgaccctgaagatgacatccctcaccgccgctgacacggccacctacttctgtgctagcttttgggatctgtggggaccgggcacactggtgaccgtctcttcc

SEQ ID NO: 43056 - RNA, 333 nt, synthetic construct
  misc_feature 1..333: note = derived and/or modified sequence opt5 from anti-influenza_Chain
  source 1..333: mol_type = other RNA
cagagcgtggaggaatccggcgggggactggtcaagcccggcgggtctctcaccctgacatgcacggttagcggactttccctgtactctaacgagatcaattgggtgagacaagcccctggcaacgggctcgaatggattggagctatcgccggcagcggctccgcggactatgcttcttgggccaaaagccggtccaccattacacgcaataccaacctgaatacagtgacccttaagatgacaagcctgaccgccgctgatacggccacctacttctgtgcttctttttgggacctctgggggccgggaacactggtcaccgtgtccagc

SEQ ID NO: 43057 - RNA, 333 nt, synthetic construct
  misc_feature 1..333: note = derived and/or modified sequence opt5 from anti-influenza_Chain
  source 1..333: mol_type = other RNA
cagagcctggaggaatccggcgggggactcgtgaagcccggcgggtctctgacccttacatgcacggtcagcggactgtccctctactctaacgagatcaattgggttagacaagcccctggcaacgggctggaatggattggagctatcgccggcagcggctccgcggactatgcttcttgggccaaaagccggtccaccattacacgcaataccaaccttaatacagtgaccctgaagatgacaagcctcaccgccgctgatacggccacctacttctgtgcttctttttgggacctgtgggggccgggaacactggtgaccgtctccagc

SEQ ID NO: 43058 - RNA, 333 nt, synthetic construct
  misc_feature 1..333: note = derived and/or modified sequence opt5 from anti-influenza_Chain
  source 1..333: mol_type = other RNA
aacatcgtgctgacccagagccccgcctccctcgctgtctctctgggccaaagagccacaattagctgccgggcgtccgagtctgttgacatctacgggaatagcttcatgcactggtatcagcagaagcctggacagccgcccaaacttctgatttacctcgcttccaagctggaatgtggcgtgtgcgcccgctttaacgggtctggatgtagaacggatttcacccttgccatcgaccctgtggagggcgatgacggggctacatattactgccaacagaattatgaagatccctggacctttggaggcggcacaaaactggagattaag

SEQ ID NO: 43059 - RNA, 333 nt, synthetic construct
  misc_feature 1..333: note = derived and/or modified sequence opt5 from anti-influenza_Chain
  source 1..333: mol_type = other RNA
aacatcgtgctgacccagagccccgcctccctcgctgtctctcctggccaaagagccacaattagctgccgggcgtccgagtctatcgacatttacgggaatagcttcatgcactggtatcagaagaaaccgggacagccccctaagctgcttatctaccgcgcttccaacctggaatctggcgttcccgccagatttaatgggagcggatcccggacggatttcaccctcacaattgaccctgtggagggcgatgacggggccacctattactgtcagcaaaactatgaagatccctggacatttggaggcggcaccaaactggagatcaag

SEQ ID NO: 43060 - RNA, 333 nt, synthetic construct
  misc_feature 1..333: note = derived and/or modified sequence opt5 from anti-influenza_Chain
  source 1..333: mol_type = other RNA
gagatcgtgctgacccagagccccgccacactctccctgtaccctggcgaaagagctacgctttcttgccgggccagccaatccgtctctcgctatctggcgtggtaccagcagaagccggggcaggctcccagactcctgatttatgacgccagcaaccgggccaccggaatccctgctcgcttctccggctctgggagcggaacagattttacccttacaatttccagcctggagcccgaagacttcgccgtttactattgtcaacagagatctaattggctcaaaatcacctttggccaggggacacggctggagattaagggaaccgtg

SEQ ID NO: 43061 - RNA, 336 nt, synthetic construct
  misc_feature 1..336: note = derived and/or modified sequence opt5 from anti-influenza_Chain
  source 1..336: mol_type = other RNA
gacatcgtgatgacccagagccccgattccctggccgtctctctcggcgagagagctacaattaactgcaagagctcccaatctgttctgtacagctccaataacaaaaattatcttgcctggtaccagcagaagcctgggcagccgcccaaactgctcatcgactgggcgtctacgcgggaaagcggagtgcctgatcgcttctccggcagcgggtctggaaccgactttacactgaccatttccaaccttcaagtggaggatgtcgctgtgtattactgtcagcagtattacagaagcccctctttcggccaggggacaaagctggaaatcaaa

SEQ ID NO: 43062 - RNA, 336 nt, synthetic construct
  misc_feature 1..336: note = derived and/or modified sequence opt5 from anti-influenza_Chain
  source 1..336: mol_type = other RNA
gacatcgtgatgacccagacacccctgagcctctccgtcacgcctggccaaccggcctctattagctgcaagtcctctcagagcctgcttcactccgatgggaaaacctacctgtattggtacctccagaagcccggacagtctcctcaactgcttatctatgaggttagcaacagattctccggcgtgcccgaccggtttagcgggtctggatccggcacagatttcaccctgaaaattagccgcgtggaagctgaggacgtcggggtgtactattgtatgcagaatatcctcctgcctctgacatttggaggcggcaccaaggttgaaattaaa

SEQ ID NO: 43063 - RNA, 336 nt, synthetic construct
  misc_feature 1..336: note = derived and/or modified sequence opt5 from anti-influenza_Chain
  source 1..336: mol_type = other RNA
gagatcgtgatgacccagacacccctgagcctctccgtcacgcctggccaaccggcctctattagctgcagatcctctcagagcctgcttcactccgacgggaagacctacctgtattggtacctccagaaacccggacagcctccccaactgcttatctctgaagttttcaaccggtttagcggcgtgcctgatcgcttctccgggagcggatctggcacagactttaccctgaagatttccagagtggaggctgaagatgtcggggtgtattactgtatgcagagcctccagctgcccctgacattcggaggcggcaccaaagttgagatcaag

SEQ ID NO: 43064 - RNA, 336 nt, synthetic construct
  misc_feature 1..336: note = derived and/or modified sequence opt5 from anti-influenza_Chain
  source 1..336: mol_type = other RNA
gacatcgtgatgacccagagccccctgtccctccctgtcacaccgggcgagcccgcctctattagctgcagagcttcccaatctctgcttcacagcaacgggtacaattatctggattggtacctccagaagcctggacagtctccccagctgcttatccaactgggctccacgcgggccagcggggttcctgaccgcttctccggaagcggctctgggaccgattttacactcgaaatttccagagtggaggcggaagacgtgggagtctattactgtatgcaggctctgcagctgcccctcgccttcggccagggcacccggctggagatcaaa

SEQ ID NO: 43065 - RNA, 336 nt, synthetic construct
  misc_feature 1..336: note = derived and/or modified sequence opt5 from anti-influenza_Chain
  source 1..336: mol_type = other RNA
gacatcgtgatgacccagagccccctgtccctccctgtctctccgggcgagcccgccagcatttcctgcagatctagccaatccctgcttcacgggaacggatacaattatctggattggtacctccagaagcctggccagtctccccggctgcttatctatctggggagcaaccgcgcttccggagttcctgacagattcagcggctctgggtccggaacagattttacgctcaaaattagccgggtggaagccgaggacgtgggcgtctactattgtatgcaggcgctgcaaacacccctgaccttcggcgggggaaccaaggtggaaatcaaa

SEQ ID NO: 43066 - RNA, 336 nt, synthetic construct
  misc_feature 1..336: note = derived and/or modified sequence opt5 from anti-influenza_Chain
  source 1..336: mol_type = other RNA
cagagcgtgctgacccaacccccttccgtctctggcgccccggggcagagagttacaatcagctgcacgggatcctctagcaacattggcgctgggtacgacgtgcactggtatcagcagctccccggaaccgcccctaagctgcttatctacgataataacaatcggccctccggcgtgcctgaccgcttctctgggagcaaatccggagcgagcgcttctctggccattacaggcctccaagccgaggatgaagctcattattactgtcagtcctatgacaacagcctgtctggctccgtctttgggggaggcacccagcttacagtgctgagc

SEQ ID NO: 43067 - RNA, 336 nt, synthetic construct
  misc_feature 1..336: note = derived and/or modified sequence opt5 from anti-influenza_Chain
  source 1..336: mol_type = other RNA
cagagcgtgctgacccaacccccttccgtctctggcgccccggggcagagagttacaatcagctgcacgggatcctctagcaacattggctccgactacgatgtgcactggtataagcagctccccgggaccgctcctaaactgcttatcttcggaaattctaaccggcccagcggcgtgcctgaccgcttttccgggagcaagtctggaacatccgccagcctggcgattaccggcctccaggctgaggatgaagccgactactattgtcaatcttacgattccagcctgtctggcttccatgtctttgggtccggaacaaaagtgaccgttctt

SEQ ID NO: 43068 - RNA, 336 nt, synthetic construct
  misc_feature 1..336: note = derived and/or modified sequence opt5 from anti-influenza_Chain
  source 1..336: mol_type = other RNA
cagagcgtgctgacccaacccccttccgtctctgccgctccgggccagaaggttacaatcagctgctccgggtctagctccaacattggaaatgactacgtgtcttggtatcagcagctccccggcacggcccctaaactgcttatctacgataacaataagagacccagcgggattcctgaccggttctccggaagcaaatctggcacctccgcgacactggggatcaccggactccaaacaggcgatgaggctaactattactgtgccacctgggaccgcagacccacagcctatgtggtctttggcgggggaaccaagctgacggtgcttggc

SEQ ID NO: 43069 - RNA, 336 nt, synthetic construct
  misc_feature 1..336: note = derived and/or modified sequence opt5 from anti-influenza_Chain
  source 1..336: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagcaccagagccacagggatccctgaccggttctccggacgcggcagcgggaccgattttacacttaccatttcttccctggagcccgaagacttcgccgtttattactgtcaaaactatggaagcccttttctcttcacatttggccccggcaccaaagtggatatcaagagaacggtg

SEQ ID NO: 43070 - RNA, 336 nt, synthetic construct
  misc_feature 1..336: note = derived and/or modified sequence opt5 from anti-influenza_Chain
  source 1..336: mol_type = other RNA
gacatccagctgacccaaagccccctctcccctccggtgacactgggccagcccgcctctattagctgcagatcctctcagagccttctgtacacggatgggttcacctatctctcctggtaccaccagcggcctggacaatctccccgcagactgatctataagattagcaaccgggactccggcgtccctgatcgctttagcgggtctggatccggcacagacttcacccttaaaatcagcagagttgaggctgaagatgtgggggtgtactattgtatgcaggccacacattggcccctgacctttggagagggcacaaaggtcgaaattaaa

SEQ ID NO: 43071 - RNA, 336 nt, synthetic construct
  misc_feature 1..336: note = derived and/or modified sequence opt5 from anti-influenza_Chain
  source 1..336: mol_type = other RNA
gacatcgagctgacccaggaacccagcgcctccggcacacctgggcaaagagtgacgatttcttgcagcggagatacctccaacatcggctctaatacagtcagctggttccagctcctgccggggaccgctcccaaacttctgatttttacagacaaccagcggccttccggagttcccggccgcttctctgggagcaagtccggaaccagcgcctctctcgcgatctccggcctgcagagcgaggatgaaacagactactattgtgctgcctgggatgactctcttaatggctgggtgtttgggggaggcaccaagctgacggtgctcgggcaa

SEQ ID NO: 43072 - RNA, 336 nt, synthetic construct
  misc_feature 1..336: note = derived and/or modified sequence opt5 from anti-influenza_Chain
  source 1..336: mol_type = other RNA
gacatcgtgctgacccagagcccctccgcctctggcagccctgggcaatccgtcacaatttcttgcacgggaaccagctccgatgttggcgggtacgactatgtgtcttggtaccagcagcacccgggaaaggctcccaaactcatgatctatgaggtgagaaagcggcctagcggcgtccccgatcgcttctccgggagcaaatctggaaacacagcctccctgaccgtgagcggccttcaggcggaagacgaggcttactattactgtgcctcttatgccggcacatacattcatctgtttgggggaggcaccaagctcacagttctggggcaa

SEQ ID NO: 43073 - RNA, 336 nt, synthetic construct
  misc_feature 1..336: note = derived and/or modified sequence opt5 from anti-influenza_Chain
  source 1..336: mol_type = other RNA
caggagcaactgatggaaagcggcgggggactcgtgaagcccggcgggtccctgacccttacatgcacggtctctggactgagcctctactccaacgagatcaattgggttagacaggcccctggcaacgggctggaatggattggagctatcgccggctctggcagcgcggactatgcttcctgggccaaatctcggagcaccattacacgcaataccaaccttaatacagtgaccctgaagatgacatccctcaccgccgctgatacggccacctacttctgtgctagcttttgggacctgtgggggccgggaacactggtgaccgtctcttcc

SEQ ID NO: 43074 - RNA, 336 nt, synthetic construct
  misc_feature 1..336: note = derived and/or modified sequence opt5 from anti-influenza_Chain
  source 1..336: mol_type = other RNA
cagcaacagctgatggagagcggcgggggactcgtgaagcccggcgggtccctgacccttacatgcacggtctctggactgagcctctactccaacgaaatcaattgggttagacaggcccctggcaacgggctggagtggattggagctatcgccggctctggcagcgcggactatgcttcctgggccaaatctcggagcaccattacacgcaataccgatcttaacacagtgaccctgaagatgacatccctcaccgccgctgacacggccacctacttctgtgctagcttttgggatctgtgggggccgggaacactggtgaccgtctcttcc

SEQ ID NO: 43075 - RNA, 336 nt, synthetic construct
  misc_feature 1..336: note = derived and/or modified sequence opt5 from anti-influenza_Chain
  source 1..336: mol_type = other RNA
cagcaacagctggtggagagcggcgggggactcgtcaagcccggcgggtccctgacccttacatgcagagtttctggactgagcctcttctccaacgaaatcaattgggtgcggcaggcccctggcaacgggctggagtggattggagctatcggcggcgggggatctgccgactacgcgagctgggctaaatcccgctctacgattaccagaaatacaaaccttaataccgtgacactgcggatgaccagcctcacagccgccgataccgctgcctatttttgtgcttccttctgggacctgtggggcccggggacgctggtcaccgtgagctct

SEQ ID NO: 43076 - RNA, 336 nt, synthetic construct
  misc_feature 1..336: note = derived and/or modified sequence opt5 from anti-influenza_Chain
  source 1..336: mol_type = other RNA
gaggtgcagctggtcgaaagcggcgggggactcgttaagcccggcgggtccctgagactttcttgcgccgctagcggactgtccctcttctctaacgagatcaattgggtgcggcaagcccctggcaaagggctggaatggattggagcgatcggcggcgggggaagcgctgactacgcctcctgggccaagtctcgctttaccattagcagagataacgctaaaaattccctttatctgcagatgaacagcctccgggccgaggacacagctgtgtacttctgtgcctctttttgggatctgtggggcccggggacgctggtcaccgtgtccagc

SEQ ID NO: 43077 - RNA, 336 nt, synthetic construct
  misc_feature 1..336: note = derived and/or modified sequence opt5 from anti-influenza_Chain
  source 1..336: mol_type = other RNA
gacatcgtgatgacccagagccccctgtccctccctgtcacaccgggcgagcccgcctctattagctgcagatcctctcaaagcctgcttcggtccaacgggtacaattatctggattggtacctccagaagcctggacagtctccccagctgcttatctatctgggcagcaaccgcgcttccggggttcctgacagattcagcggatctggctccgggacggattttaccctcaaaattagccgggtggaagccgaggacgtgggagtctactattgtatgcaagcgctgcagacaccctacaccttcggccagggcacaaagctggaaatcaaa

SEQ ID NO: 43078 - RNA, 339 nt, synthetic construct
  misc_feature 1..339: note = derived and/or modified sequence opt5 from anti-influenza_Chain
  source 1..339: mol_type = other RNA
gacatcgtgatgacccagagccccgatttcctgcctgtctccctcggcgagagagccacaattaactgcaagtctagccaacgggttctgtactcctctaataacaaaaattatcttgcttggtaccagctgaagccggggcagccccctaaactcatcatttattgggccagcacgcgcgaatccggagtgcccgacagattttctggcagcgggtccggaaccgagttcacactgaccatcagctctcttcaggcggaagatgtggctgtctactattgtcaacagtactattcccggccttacacatttggccaggggaccaagctggagattaaa

SEQ ID NO: 43079 - RNA, 339 nt, synthetic construct
  misc_feature 1..339: note = derived and/or modified sequence opt5 from anti-influenza_Chain
  source 1..339: mol_type = other RNA
gacatcgtgatgacccagagccccgattccctggccgtctctctcggcgagagagctacaattaactgcaagagctcccaatctgttctgtacagctccaataacaaaaattatcttgcctggtaccagcagaagcctgggcagccgcccaaactgctcatctattgggcgtctacgcgggaaagcggagtgcctgaccgcatttccggcagcgggtctggagctgatttcaccctgacaatctccagccttcaagccgaggacgtggccgtctactattgtcagcagtactttgctacccccagaacattcggccaggggaccaaggtggaaattaaa

SEQ ID NO: 43080 - RNA, 339 nt, synthetic construct
  misc_feature 1..339: note = derived and/or modified sequence opt5 from anti-influenza_Chain
  source 1..339: mol_type = other RNA
gacatcgtgatgacccagtcccccgattccctggccgtctctctcggcgagagagctacaattaactgcaagagctcccaatctgttctgtacagctccaataacaaatctcaccttgcctggtatcagcagaagcctgggcagccgcccaaactgctcatctactgggcgagcacgcgggaatccggagtgcctgaccgcttcagcggctctgggtccggaaccgattttacactgattatcagctctcttcaagctgaggacgtggccgtctattactgtcagcagtattacttcagccccctgacctttggcgggggaacaaaggtggaaattaaa

SEQ ID NO: 43081 - RNA, 339 nt, synthetic construct
  misc_feature 1..339: note = derived and/or modified sequence opt5 from anti-influenza_Chain
  source 1..339: mol_type = other RNA
gacatcgtgatgacccagagccccgattccctggccgtctctctcggcgagagagccacaattaactgccggagctcccaatctatcttccacaatagcaacaatgaaaactacctggcctggtatcagcagaagcctgggcagccgcccaaacttctgatttactgggcgtccacgcgcgagtctggagttcctgacagatttagcggctccgggagcggaaccgatttcacactcaccatctcttccctgcaagctgaagacgtggccgtgtatttttgtcagcagtactataatgctccccttacattcggcgggggaaccaaggtcgagattaaa

SEQ ID NO: 43082 - RNA, 339 nt, synthetic construct
  misc_feature 1..339: note = derived and/or modified sequence opt5 from anti-influenza_Chain
  source 1..339: mol_type = other RNA
gagatcgtgctgacccagagccccctctccctgcctgtcacaccgggcgaacccgcctctattagctgcagatcctctcaaagccttctgcactccaacgggtacaattatctcgactggtacctgcagaagcctggacagtctccccagcttctgatctatctcggcagcaaccgggcttccggggttcctgatcgcttcagcggatctggctccgggacggactttaccctgaaaattagcagagtggaggccgaagatgtgggagtctactattgtatgcaagcgctgcagacacccctcaccttcggcggcgggacaaaggtggagatcaaacgg

SEQ ID NO: 43083 - RNA, 339 nt, synthetic construct
  misc_feature 1..339: note = derived and/or modified sequence opt5 from anti-influenza_Chain
  source 1..339: mol_type = other RNA
gacatcgtgctgacccagccccctagcgtctccgttgccccgggccaaacagctacgattacctgcgggggaaactacatcggctctaagagcgtgaattggtatcagcagagacccgggcacgcccctgtgctcgtcgtgtacgatgactccgatcggccctctggcattcctgaccgcttcagcggatccaactctagaagcacagcgaccacagctaccctgacaatctcccgggttgaggccggggatgaagccgactattactgtcaggtgtgggagaccagcgaagatctttgggtctttggaggcggcacgaaactgaccgtgctcgggcaa

SEQ ID NO: 43084 - RNA, 342 nt, synthetic construct
  misc_feature 1..342: note = derived and/or modified sequence opt5 from anti-influenza_Chain
  source 1..342: mol_type = other RNA
gacgtggtcatgacccagagccccgattccctggccgtttctctcggcgagagagctacaatcaactgcaagagctcccaatctgtgctgtacagctccaataacaaaaattatcttgcctggtaccagcagaagcctgggcagccgcccaaactgctcatttattgggcgtctacgcgggaaagcggagtgcctgaccgcttctccggcagcgggtctggaaccgattttacactgaccatctccagccttcaagctgaggacgtcgccgtgtactattgtcagcagtactattctacacccctgaccttcggcgggggaacaaaggttgatattaaaaga

SEQ ID NO: 43085 - RNA, 342 nt, synthetic construct
  misc_feature 1..342: note = derived and/or modified sequence opt5 from anti-influenza_Chain
  source 1..342: mol_type = other RNA
gacatccagatgacccaaagccccgattccctggccgtgtctctcggcgagaaggctacaattaactgcaaaagctcccagtctatcctgaatagctccaacaataagaactaccttgcctggtatcagcagaaacctgggcaaccgcccaagctgctcatttactgggcgtctacgagagaaagcggagtccctgaccggttctccggcagcgggtctggaaccgattttacactgaccatctccagccttcaggctgaggacgttgccgtgtattactgtcagcagtattactcttcccctcccacattcggccaagggaccaaagtggaaattaagcgc

SEQ ID NO: 43086 - RNA, 342 nt, synthetic construct
  misc_feature 1..342: note = derived and/or modified sequence opt5 from anti-influenza_Chain
  source 1..342: mol_type = other RNA
gagatcgtgctgacccagagccccgccacactctccctgtaccctggcgaaagagctacgctttcttgccgggccagccaatccgtctctcgctatctggcgtggtaccagcagaagccggggcaggctcccagactcctgatttatgacgccagcaaccgggccaccggaatccctgctcgcttctccggctctgggagcggaacagattttacccttacaatttccagcctggagcccgaagacttcgccgtttactattgttgcgatagacaacagcggtctaattggctcaaaatcacctttggccaggggacacgcctggagattaagggaaccgtg

SEQ ID NO: 43087 - RNA, 342 nt, synthetic construct
  misc_feature 1..342: note = derived and/or modified sequence opt5 from anti-influenza_Chain
  source 1..342: mol_type = other RNA
gacatcgtgatgacccagagccaaaagttcgtctccacatctgttggcgatagagtgagcgtgacgtgcaaagcctcccagaacgtcgggtctaatgtggcttggtaccagcacaagcccggacatagccctaccgccctgatttattccgcgtctcaccggtacagcggcgttccggaccgctttacagggtccgagagcggaaccgatttcacactcaccatctctaacgtgcagtccgaagacctggctgagtatttttgtcaacagtactatagctacccctatacattcggcgggggaaccaaacttgaaattaagagagccgatgccgctcctacg

SEQ ID NO: 43088 - RNA, 342 nt, synthetic construct
  misc_feature 1..342: note = derived and/or modified sequence opt5 from anti-influenza_Chain
  source 1..342: mol_type = other RNA
gacatcgagatgacccagagccccctgtccctccctgtgacaccgggcgaatctgccagcatttcctgcagatctagccaatccctgcttcactctaacgggtacaattatctggattggtacctccagaagcccggacagagccctcagctgcttatctatctgggctccagccgggcttctggggtccccgaccgcttctccggaagcggctctgggacggattttaccctcaaaatttccagagttgaggccgaagacgtgggagtgtactattgtatgcaaggcctgcagacaccttacaccttcggccaggggacaaagctggagatcaaacggacc

SEQ ID NO: 43089 - RNA, 342 nt, synthetic construct
  misc_feature 1..342: note = derived and/or modified sequence opt5 from anti-influenza_Chain
  source 1..342: mol_type = other RNA
gacatcgagatgacccagagccccctgtccctccctgtgacaccgggcgaacccgcctctattagctgcagatcctctcaaagcctgcttcactccaacgggtacaatcacctggcttggtatctccagaagcctggacggtctccccatctgcttatctacctggccagcacgcgcgcgtccggcgtccctgatagattcagcgggtctggatccggcaccgactttacactcaaaattagccgggttgaggctgaagatgtggggatctattactgtatgcagtctctgcagacctccattacattcggacaaggcacccgcctggagatcaagagaaca

SEQ ID NO: 43090 - RNA, 345 nt, synthetic construct
  misc_feature 1..345: note = derived and/or modified sequence opt5 from anti-influenza_Chain
  source 1..345: mol_type = other RNA
caggtgcaactggtccagagcggcgccgaggttaagaaacccgggtcctctgtgagagtgagctgcaagacctccggaggcacattctctagctacgctgtcacgtgggtgcggcaggcccctgggcagggactcgaatggatgggcgggatcattggaatgtttggcaccacaaactatgcgcaaaaattccagggccgcctgaccatcacagctgacgagatgacctccacagcctacatggaactttctagcctgagatccgaggataccgccgtttattactgtgctcgggggagctattactatgaaacgaccctcgactactggggacgcggcacactg

SEQ ID NO: 43091 - RNA, 345 nt, synthetic construct
  misc_feature 1..345: note = derived and/or modified sequence opt5 from anti-influenza_Chain
  source 1..345: mol_type = other RNA
gaggtgcagctggtccaaagcggcgccgaagttaagaaacccgggtcctctgtgaaggtgagctgcaaaacctccggaggcacattctctagctacgctgtcacgtgggtgagacaggcccctgggcagggactcgagtggatgggcgcgatcattgggatgtttggaaccacaaactatgctcagaagttccaaggccgggttaccatcacagccgacgaactgacctccacagcctacatggagctttctagcctgcgctccgatgacaccgctgtgtattactgtgccagaggcagctattactatgaatcttccctcgattactgggggaaaggaacgctg

SEQ ID NO: 43092 - RNA, 345 nt, synthetic construct
  misc_feature 1..345: note = derived and/or modified sequence opt5 from anti-influenza_Chain
  source 1..345: mol_type = other RNA
caggtgcaactggtccagagcggcgccgaggttaagaaacccgggtcctctgtgaaggtgagctgcaaaacctccggaggcacattctctagctacgctgtcacgtgggtgagacaggcccctgggcagggactcgaatggatgggcgggatcattggaatgtttggcaccacaaactatgcgcaaaagttccagggccgggttaccatcacagctgacgagctgacctccacagcctacatggaactttctagcctgcgctccgaggataccgccgtgtattactgtgctagagggagctattactatgaatcttccctcgactactggggacggggcacgctg

SEQ ID NO: 43093 - RNA, 345 nt, synthetic construct
  misc_feature 1..345: note = derived and/or modified sequence opt5 from anti-influenza_Chain
  source 1..345: mol_type = other RNA
gaggtgcagctggtccaaagcggcgccgaagttaagaaacccggggcttccgtgaaggtgtcttgcaaagccagcggatacaccttcacaggctattacgtctattgggtgagacaggcgcctgggcagggactcgagtggatgggctggatctccgcttacaacgggaatacgaactatgcccagaagtttcaaggacgggttaccattacagccgacaaatctaccagcacagcttacatggaactgtcctctcttcgcagcgaggataccgccgtgtattactgtgctagatcccggagcctggacgtctggggccagggcacaaccgtgacggtttcttcc

SEQ ID NO: 43094 - RNA, 345 nt, synthetic construct
  misc_feature 1..345: note = derived and/or modified sequence opt5 from anti-influenza_Chain
  source 1..345: mol_type = other RNA
gacatcgtgatgacccagagccccctgtccctccctgtcacaccgggcgagcccgcctctattagctgcagatcctctcaaagcctgcttcactccaacgggcatatctacttcgattggtatctgcagaagcctggacagtctccccagctcctgatttaccttgttagcaaacgggcttccggcgtgcctgaccgctttagcgggtctggatccggcacggatttcaccctgaagatcagcagagtggaagccgaggacgtcggggtgtattactgtatgcaagcgctcgaaacaccctttaccttcggacctggcacaaaagttcacattaagcggaccgtg

SEQ ID NO: 43095 - RNA, 345 nt, synthetic construct
  misc_feature 1..345: note = derived and/or modified sequence opt5 from anti-influenza_Chain
  source 1..345: mol_type = other RNA
cagagcgccctgacccaacccgcttccgtgtctggcagccctgggcagtccatcacaatttcttgcacgggaaccagctccgacgtcggcgcctacaactatgtttcttggtaccagcaccatccggggaaggcgcccaaactcatgatctatgatgtgacatacagacctagcggagtgtccacccggttcagcggctctaagtccgggaatacagctagcctgaccatttctggacttcaggccgaggacgaagccgattattactgttccagccaatctcgctccagcacactggtcatctttggcggcgggaccaaactcacggtgctgggacagcccaag

SEQ ID NO: 43096 - RNA, 345 nt, synthetic construct
  misc_feature 1..345: note = derived and/or modified sequence opt5 from anti-influenza_Chain
  source 1..345: mol_type = other RNA
gacatcgtgctgacccagagccccgtctccctcgccgtttctctgggcgagagcgctacagtgaactgcaagtcctctcaaagcgtgctttccaattctaaaaacctgaattacctcgcctggtatcagcacaagcctgggcagccgcccaaactgcttatttactgggcgagcacgagagaatccggagtccctgatcggttcagcggctctgggtccggaaccgactttacactgaccatcagctctctccaggctgaggatgtggccgtttattactgtcaacagcattattccattcccctgacattcggccctgggaccaaggtggacatcaaacgcaca

SEQ ID NO: 43097 - RNA, 348 nt, synthetic construct
  misc_feature 1..348: note = derived and/or modified sequence opt5 from anti-influenza_Chain
  source 1..348: mol_type = other RNA
gacatcgtgctgacccagagccccctctccctgcctgtcacaccgggcgagcccgcctctattagctgcagatcctctcaaagccttctggattccaacgggtacaattatctcgactggtacctgcagaagcctggacagtctccccagcttctgatctatctcgctagctaccgggcccctggcgttcccgatcgcttctccgggagcggatctggcacggactttaccctgaaaatttccagagtggaagcggaggatgtggggctgtattactgtatgcaagctctccagacacctccgatgtataccttcggacagggcacaaagctggaaatcaaacggacc

SEQ ID NO: 43098 - RNA, 351 nt, synthetic construct
  misc_feature 1..351: note = derived and/or modified sequence opt5 from anti-influenza_Chain
  source 1..351: mol_type = other RNA
ctggagagcggcgggggactcgtgcagcccggcgggtccctgagactttcttgcgccgctagcggaatcaccttctcctcttacgccatgagctgggtccggcaagcgcctggcaaggggctggaatgggtttccacagtgaactctggaggcggcagcacgtattacggggactccgtgcgcggaagatttaccattagccgggataattctaaatccacactctatctgcagcttaacagcctgcgcgctgaggacaccgccatctactattgtgccaaggataaaggcagaccgattttcgggctcgtcacaccctcttactatatggacgtgtggggaaatggcacc

SEQ ID NO: 43099 - RNA, 351 nt, synthetic construct
  misc_feature 1..351: note = derived and/or modified sequence opt5 from anti-influenza_Chain
  source 1..351: mol_type = other RNA
caggagcaactggtgcagagcggcgccgaagtcaagaaacccggggcttccgttaaggtgtcttgcaaagccagccggaagtccttcatcggatactatgtgcactgggtccggcaggcgcctggccaggggctcgagtggatgggatggatttctccggacagcgatgctaccaaatacgcccaaaagtttcagggctccgtgatcatgacacgcgacacgtctgttagcaccgtgtatatggaactgtccagacttacaagcgatgacaccgccctgtactattgtctcctgttcagagggggaaactctctttcctggggccagggcacactggtcaccgtgagctct

SEQ ID NO: 43100 - RNA, 351 nt, synthetic construct
  misc_feature 1..351: note = derived and/or modified sequence opt5 from anti-influenza_Chain
  source 1..351: mol_type = other RNA
caggtgcaactgcaggagagcggccccgggctcgtcaagccttccgaaaccctgtctcttacatgcacggttagcggatcctctatcagcaactactattggtcctggattagacagtctccgggcaaagggctggagtggatcggattcatttactatggcgggaataccaagtacaaccccagcctcaaatcccgggtgacaatcagccaggacacctctaagtcccaagtgagcctgacaatgtcttccgtcaccgccgctgaaagcgccgtgtatttttgtgcgcgcgcttcttgctccggaggctactgtattcttgattattggggccaggggacactggttacc

SEQ ID NO: 43101 - RNA, 351 nt, synthetic construct
  misc_feature 1..351: note = derived and/or modified sequence opt5 from anti-influenza_Chain
  source 1..351: mol_type = other RNA
gaggtgcagctggtcgaaagcggcgggggactcgttcaacccggcgggtccctgagactttcttgcgccgctagcggattcaccttttccatctacgccatgtcttgggtgcggcaggcgcctggcaaggggctggagtgggtgagcgctatttcctctagcggagactccacatattacgccgatagcgtcaaaggccgcttcacgatctctagagacaacgcccggaataccctctatctgcagatgaactcccttcgcgctgaagatacagccgtgtactattgtgctagagcctacggctatacctttgacccgtgggggcagggaacactggttaccgtgagctct

SEQ ID NO: 43102 - RNA, 354 nt, synthetic construct
  misc_feature 1..354: note = derived and/or modified sequence opt5 from anti-influenza_Chain
  source 1..354: mol_type = other RNA
caggtgcaactgcaggagagcggccccgggctcgtcaagccttccgaaaccctgtctcttacatgcacggttagcggatactccttcgactctggctattactgggggtggctgagacagccgcccggaaaaggcctcgagtggatcgggagcatttatcactcccggaacacctactataatccttctcttaagagccgcgtgacaatctccgtggataccagcaaaaaccagttttctctgcaactgtccagcgtcacagccgctgacaccgccgtgtactattgtgcgagaggaacatggtactcttccaatctccggtactggttcgatccctggggcaagggcaccctg

SEQ ID NO: 43103 - RNA, 354 nt, synthetic construct
  misc_feature 1..354: note = derived and/or modified sequence opt5 from anti-influenza_Chain
  source 1..354: mol_type = other RNA
cagcccgtgctgacccaacctccgagcgcctccgcttctctcggcgccagcgtcacactgacgtgcaccctttcctctgcgtacagcaactataaggttgactggtaccagcagagacccgggaagggacctcggttcgtgatgcgcgtgggcacagggggaatcgtcggctccaagggggatggcattcccgacagattttctgtgctgggaagcggcctcaatcggtatctgaccatcaaaaacattcaggaggaagatgagtccgactaccactgtggggctgatcatggaagcggctctaatttcgtttccccttatgtgtttgggggaggcacaaaacttaccgtcctg

SEQ ID NO: 43104 - RNA, 354 nt, synthetic construct
  misc_feature 1..354: note = derived and/or modified sequence opt5 from anti-influenza_Chain
  source 1..354: mol_type = other RNA
caggtgcaactggtccagagcggcgccgacgttaagaaacccgggtcctctgtgaccgtgagctgcaaggcttccggaggctctttcagcaactacgggatcaattgggtcagacaggcccctggacagggcctcgagtggatgggagggattatcccgctgattaacgcgcccaattatgctcctaaatttcaaggccgggtgacaatcacggccgatatgttctccaacattgtttctcttcagctgaccagcctccgcacagacgataccgccgtgtactattgtgctagacggaagatgacaaccgccatcgactactggggccaggggacactggtcaccgtgtccagc

SEQ ID NO: 43105 - RNA, 354 nt, synthetic construct
  misc_feature 1..354: note = derived and/or modified sequence opt5 from anti-influenza_Chain
  source 1..354: mol_type = other RNA
caggtgcaactggtccagagcggcgccgaggttaagaaacccgggtcctctgtgaaggtgagctgcagagaatccggaggcaccttcaacgggtacacaatcacgtgggtccggcaggctcctggacagggcctcgagtggatgggagggattatcccgatgatgggcaccgtgaattatgcccaaaaactgcagggccgcgttacaattaccacagactactttaccaagacagcgtatatggatcttaacaatctgagatctgaagacaccgctatgtactattgtgtgaaaatccggtacacggggcagcagctcctgtggggacaaggcacccttgtcacagtgagctcc

SEQ ID NO: 43106 - RNA, 354 nt, synthetic construct
  misc_feature 1..354: note = derived and/or modified sequence opt5 from anti-influenza_Chain
  source 1..354: mol_type = other RNA
caggtgcaactggtccagagcggcgccgaggttaagaaacccggggcttccgtgaaggtgtcttgcaaagccagcggacacaccttcacaggctactatatccattgggtcagacaggcgcctgggcagggactcgaatggatgggctggattaacccggactccggggctacgtctagcgcccaaaattttcagggacgggtgaccatgacaggcgatacctcctctagcacagcctacatggagctgtcccgccttagcttcgacgataccgctgtttattactgtgccagagtgctgtttacatctcccttcgacttttggggcgaagggaccctcgtcacggtgtccagc

SEQ ID NO: 43107 - RNA, 354 nt, synthetic construct
  misc_feature 1..354: note = derived and/or modified sequence opt5 from anti-influenza_Chain
  source 1..354: mol_type = other RNA
cagcccgtgctgagccaacctccgtccgcctctgctagcctcggcgcctccgtcaccctgacatgcacgctttctagcgggttcgacaactaccaggttgcgtggtatcagcagagacccggaaagggccctcggtttgtgatgcgcgtggggaatggaggcaacgtcgcttccaaaggggatggaatccccgacagattctctgtgagcggctccggcctgaatcggtacctcaccattaagaacatccaagaggatgacgaaagcgattattactgtggggccgaccacggatctggcaataactttgtttccccttatgtgttcgggggaggcacaaaactgaccgtcctt

SEQ ID NO: 43108 - RNA, 354 nt, synthetic construct
  misc_feature 1..354: note = derived and/or modified sequence opt5 from anti-influenza_Chain
  source 1..354: mol_type = other RNA
gaggtgcagctggtcgaaagcggcgccgaggttaagaaacccggggcttccgtgaaggtgtcttgcaaagccagcggatacaccttctccagatattacatccactgggtccggcaagcgcctggccaggaactcgagtggatggggtggattaacccggactctggagatacaaattatgctcagaagtttcgcggcagagtgacgatggcccgggacaccagcatctccacagtttacatggaactgaactctcttcgctatgatgacaccgccgtgtacttctgtgctagaattatctggagctccagcgggatggatgtctggggacagggcacaaccgtgacagtttct

SEQ ID NO: 43109 - RNA, 354 nt, synthetic construct
  misc_feature 1..354: note = derived and/or modified sequence opt5 from anti-influenza_Chain
  source 1..354: mol_type = other RNA
gaggtgcagctgctcgaaagcggcgggggagtcgttcaacccggcagatccctgcggctttcttgcgccgctagcgggttcacctttcgcacatacggaatgcactgggtgagacaggcccctggcaaggggctggagtgggtggcggtcatctcccatgacggaaatctcaaatattacggcggctctgtgaaggggcggttcacgattagccgcgataattccaaaaacgctctgtatcttcagatgaactctctgagagttgacgataccgccctctactattgtgcccggggaatcggcattacagacgcttttgatatccgcgggcagggaaccatggtggtcgtgagc

SEQ ID NO: 43110 - RNA, 354 nt, synthetic construct
  misc_feature 1..354: note = derived and/or modified sequence opt5 from anti-influenza_Chain
  source 1..354: mol_type = other RNA
gaggtgcagctggtcgaaagcggcgggggactcgttcaacccggcgggtccctgagactttcttgcaccgccagcggactgtccgtgtctagcacatacatgaactgggtgcggcaggctcctggcaaggggctcgagtgggtctccgtgttctattctgaaacgcgcacctactatgccgacagcgttaaaggaagatttacagtgtcccggcacaatagcaacaataccctgtaccttcagatgaactctctgcgcgtcgaggatacagcggtgtattactgtgctagagttcagcggctctcctatggcatggacgtgtggggccaagggaccacagtcaccgtgagctct

SEQ ID NO: 43111 - RNA, 354 nt, synthetic construct
  misc_feature 1..354: note = derived and/or modified sequence opt5 from anti-influenza_Chain
  source 1..354: mol_type = other RNA
gaggtgcagctggtcgaaagcggcgggggactcgttcaacccggcgggtccctgagactttcttgcaccgccagcggactgtccgtgtctagcacatacatgaactgggtgcggcaggctcctggcaaggggctcgagtgggtctccgtgttctattctgaaacgcgcacctactatgccgacagcgttaaaggaagatttacagtgtcccggcacaatagcaacaataccctgtaccttcagatgaactctctgcgcgcggaggatacagctgtctattactgtgccagagtgcagcggctctcctatggcatggacgtttggggccaagggaccacagtgaccgtcagctct

SEQ ID NO: 43112 - RNA, 354 nt, synthetic construct
  misc_feature 1..354: note = derived and/or modified sequence opt5 from anti-influenza_Chain
  source 1..354: mol_type = other RNA
gacatgcagctggtggagagcggcgggggactcgttccccctggcgggtccctgagactttcttgcgccgctagcggattctccgtctctgataattacatcaattgggtgcggcaagccccgggcaaggggctggactgggtgagcgtcttttattccgcggatcgcacctcttacgctgacagcgtgaaaggaagattcacagtttccagccacgattctaagaacacggtgtatctccagatgaactccctgcgggccgaagacaccgccgtctactattgtgctcgcgtgcagaaaagctactatggcatggatgtttggggccaggggacaaccgtgacagtctcttcc

SEQ ID NO: 43113 - RNA, 357 nt, synthetic construct
  misc_feature 1..357: note = derived and/or modified sequence opt5 from anti-influenza_Chain
  source 1..357: mol_type = other RNA
gaggtgcagctggtcgaaagcggccccgttctcgtgaagcctaccgagacactgacggtgacctgcacagtctccgggttctctgtggacaacgatagaatgggagttagctggatccggcaaccgcccggcaaagcccttgaatggctggctcacatcttttccaatgacgagaagtcttacagcacctccctccgctctagactgacaattagcaaagatacctccaagcgccaggtggtccttagcatgacagacatggatcctgtggacaccgccacgtattactgtgcgcgggctccctctgaatatgccgccatggatgtttgggggcagggaaccatggtgacagtctcc

SEQ ID NO: 43114 - RNA, 357 nt, synthetic construct
  misc_feature 1..357: note = derived and/or modified sequence opt5 from anti-influenza_Chain
  source 1..357: mol_type = other RNA
caggtgcaagtcgttcagagcggcaccgaggtgaagaaacccgggtcctctgtgaaggtcagctgccagacatccggaggcagattcatgtcttacgccatcacgtgggtgcggcaggctcctgggcaaggactggaatggatgggcgggattgttccggtgtttggaaccgccaactatgcgcagaaattccagggccgcgtcacaatcaccacagacgatagcaccagaacagcttacatggagctctcctctctgcggagcgaagacaccgccgtgtattactgtggctttcgctatgggtccggatacggcttcgatagctgggggcagggaacgcttgttaccgtgtcttcc

SEQ ID NO: 43115 - RNA, 357 nt, synthetic construct
  misc_feature 1..357: note = derived and/or modified sequence opt5 from anti-influenza_Chain
  source 1..357: mol_type = other RNA
gaggtgcagctggtcgaaagcggcgccggggttaagaaacccggatcctctgtgaaggtgagctgcaaggcttccggcaacaccttctctagcaatgccatctcctgggtcagacaagcgcctgggcagggactcgagtggatgggcgggattctgggaatgcttcggacaacgaactacgctcagaaatttcagggccgcgtgaccatcacagccgacgagttcatgaataccgcctatatggaactgtctagcctcacatccgaagataccgctgtttactattgtgccagaagctctggctactatccggactactttcacctgtgggggcaaggaacacttgtgaccgtctcc

SEQ ID NO: 43116 - RNA, 357 nt, synthetic construct
  misc_feature 1..357: note = derived and/or modified sequence opt5 from anti-influenza_Chain
  source 1..357: mol_type = other RNA
caggtgcaactgcaggagagcggccccgggctcgtcaagccttccgaaaccctgtctcttacatgcacggttagcggatcctctatcagcaactactattggtcctggattagacagtctccgggcaaagggctggagtggatcggattcatttactatggcgggaataccaagtacaaccccagcctcaaatcccgggtgacaatcagccaggacacctctaagtcccaagtgagcctgacaatgtcttccgtcaccgccgctgaaagcgccgtgtatttttgtgcgcgcgcttcttgctccggaggctactgtattcttgattattggggccaggggacactggttaccgtgagc

SEQ ID NO: 43117 - RNA, 357 nt, synthetic construct
  misc_feature 1..357: note = derived and/or modified sequence opt5 from anti-influenza_Chain
  source 1..357: mol_type = other RNA
gaggtgcagctggtcgaaagcggcgggggactcgttcaacccggcgggtccctgagaatctcttgcgccgctagcggattcaccgtgtcctctaactacatgagctgggtgcggcaggcccctggcaaggggcttgagtgggtctccgtgatttattctggaggcagcacatactatgcggactccgttaaaggccgctttagcttctctagagataattccaagaacacggtgtttctgcagatgaatagcctccgggctgaagacaccgccgtctactattgtgcccgctgcctgtctagaatgcgggggtacggacttgatgtgtggggccaggggacaaccgttacagtgtcc

SEQ ID NO: 43118 - RNA, 357 nt, synthetic construct
  misc_feature 1..357: note = derived and/or modified sequence opt5 from anti-influenza_Chain
  source 1..357: mol_type = other RNA
caggtgcaactgcaggagagcggccccgggctcgtcaagccttccgaaaccctgtctcttacatgcacggttagcggagcctccatctctagcgactactggtcctggattagactgccgcccggcaaagggctcgagtggatcggatatatttacaaccggggctctaccaagtatacacctagcctgaaatcccgcgtgaccatcagccttgatacagctgaaaatcagttctctctgagactccggtccgtgaccgccgcggacacagctatttactattgtgcccgccacgtcgggggacatacctacggcatcgattattggggccaggggacgctggtgaccgttagctct

SEQ ID NO: 43119 - RNA, 357 nt, synthetic construct
  misc_feature 1..357: note = derived and/or modified sequence opt5 from anti-influenza_Chain
  source 1..357: mol_type = other RNA
caggtgcaactgcaggagagcggccccgggctcgtcaagccttccgaaaccctgtctcttacatgcacggttagcggagcctccatctctagcgactactggtcctggattagactgccgcccggcaaagggctcgagtggatcggatatatttacaaccggggctctaccaagtatacacctagcctgaaatcccgcgtgaccatcagccttgatacagctgaaaatcagttctctctgagactccggtccgtgaccgccgcggacacagctgtctactattgtgcccgccacgttgggggacatacctacggcattgattattggggccaggggacgctggtgaccgtgagctct

SEQ ID NO: 43120 - RNA, 357 nt, synthetic construct
  misc_feature 1..357: note = derived and/or modified sequence opt5 from anti-influenza_Chain
  source 1..357: mol_type = other RNA
caggtgcaactgcaggagagcggccccagactcgtcaagccttccgaatctctgagccttacctgcacagtttccgggggatctatcagcaactccttctggggctggattcggcagccgcccggggagggactggaatggatcggctacgtgtataattctgggaacacgaagtacaatcctagcctcaagtcccgcgtgaccattagcagagacacatctaaatcccagctgtatatgaaacttcggagcgtcaccgccgctgatacagccgtgtactattgtgcgcgccacgacgatgcttctcatggatactccatcagctggggccacggcaccctggttacagtgtcttcc

SEQ ID NO: 43121 - RNA, 357 nt, synthetic construct
  misc_feature 1..357: note = derived and/or modified sequence opt5 from anti-influenza_Chain
  source 1..357: mol_type = other RNA
gaggtgcacctccagcaaagcggccccgaactggtcaagcctggggcctccgttaaaatgtcttgcgaggctagcggatacaccttcacagactattacgtggcctgggtgaagcagtccccgggcgaatcttttgagtggatcgggagagtcaacccctatagcggaggcacgtcctacaatcagaaattcaaggggaaagcgaccctgattgtggataagtctagctccacagcttatatggaacttagctctctgacctccgaggacagcgccgtttactattgtgcccggtgggattacggagtgtacgagggctatatcgactactggggccaggggtctgctctcacagtc

SEQ ID NO: 43122 - RNA, 360 nt, synthetic construct
  misc_feature 1..360: note = derived and/or modified sequence opt5 from anti-influenza_Chain
  source 1..360: mol_type = other RNA
caggtgcaactggtccagcccggcgccgaggttaagaaacctgggagctccgtgaaggtgtcttgcaaagctagcggaggcatcttctccccgtacgccatttcttgggtcagacaggcgcccgggcagggactcgaatggatgggcgggatcattgctatctttggaaccacaaactatgcccaaaagttccagggccgggtgacgattaccgccgacaaaagcacaaccacagcttacctggagcttaattccctgcgctttgaagataccgccgtttattactgtgctagaggcgggcggtattacgtggactatttcgattactggggacagggcacactcgtctctgtgagctcc

SEQ ID NO: 43123 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgacctcgtcaagcctggggcctccgttaaaatgtcttgcaaggctagcggatactccttcacctattaccacatgcattgggtgaaacagacacacggcaagtctctggaatggatcgggcggattccgtataacggaggcacgaattacagccagagatttaaagggaaggccgtgttcaccgtcgatatgtcctctagcacagcgtatatggagcttcgctccctgaccagcgaagactctgctgtgtactattgtgccagagatgccaactacgagggagactggtactttgatgtttggggccaaggcacaaccgtgacagtctccagc

SEQ ID NO: 43124 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgaggttaaggaacccgggtccgctatgaaagtgtcttgcaaggccagcggaggcaccttctcctctgacgcgttttgttgggtgagacaggctcctgggcggggactcgagtggatgggcgggatcattccggtcttccagacagccaactacggacccaattttcaaggccgcgtgacgatcagcgccgatgtttataccacaaccctgtaccttgaactgtccggcctcacatctgaggacaccgctgtgtatttctgcgccagaagcggggatggatacaactattactttcctctgtggggccaggggacacttgtcaccgtgtccagc

SEQ ID NO: 43125 - RNA, 360 nt, synthetic construct
  misc_feature 1..360: note = derived and/or modified sequence opt5 from anti-influenza_Chain
  source 1..360: mol_type = other RNA
cagatcaccctgagagagagcggccccacactcgtgaagcctacgcaaaccctgacacttacctgcacattctccgggttttctctgagcaccaacggagtcaatgttggctggattcggcagccgcccgggaaagccctcgaatggctggctcttatctactgggacgatgacaagcgctattccccttctctgaaaagacggctcacaattaccaaggatacgagcaaaaaccaggtggtgctgaccctgacaaatatggaccccgtcgataccgccacatactattgtgcgcaccgccctgacttctacggagattttgagtattggggccccgggaccctcgtgacggtttcctct

SEQ ID NO: 43126 - RNA, 360 nt, synthetic construct
  misc_feature 1..360: note = derived and/or modified sequence opt5 from anti-influenza_Chain
  source 1..360: mol_type = other RNA
caggtgcaactggtccagagcggctccgaggttaagaaacccgggacctctgtgaaggtgagctgcacagcctccggatctgtcttcacgaactacggcatcagctgggtgagacaggctcctgggcagggactcgaatggatgggcgggattatcccgctgtttggagccgcgaaatatgctcaaaagttccagggccgggttaccattacagccgacgagtccaccaaaacagtgtacatggaactttctcgcctgaccagcaaggatacagccatctatttttgtgctaaggcccccagagtctacgagtattacttcgaccagtggggccaggggacccctgtgacggtttccagc

SEQ ID NO: 43127 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgacctcaagaaacccggggcttccgttaaggtgtcttgcaaagccagcggatacaccttcacagattattacatccactgggtgagacaggcgcctggccaggggctggagtggatgggatggattaacccggaatccggcgacacgaagtatgctcaaaaatttcaggggcgggtcaccatgacacgcgatacctctatcacaaccgcctacatggagcttggaagactgcggagcgacgatacagccgtgtattactgtgctcgcgacgtttccaccacgtggtcttggttcgccccctggggccagggcaccctcgtgacagtcagctcc

SEQ ID NO: 43128 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgggctcgtcaagccttccgaaaccctgtctcttacatgcagcgtttccggaggctctatcaactactattactggagctggattagacagccgcccgggaaaggactggagtgtatcggctatatttccgacacggggcggacctactataatccttctctccgcagcagagtgacaatctccgtggataccagcaagaaccagttctctctgaatcttacatccatgaccgccgctgacacagccgtctactattgcgcgcgggatcccaccggaagccgccagaaaaacgcttttgacatgtggggccaaggcacgatggtgaccgtttct

SEQ ID NO: 43129 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccagagtcgttcggccttccgaaaccctctctctgacatgcacggtgagcgggggatccatctctagctacaactggatttggatccgccagccgcccggcaaggggcttgagtggattggacacatctatgactacggcagaaccttctataattcctctctgcagagccggcctacaatttccgtggatgccagcaaaaaccaactctctctgcgccttacctccgtcacagctagcgacaccgccgtgtactattgtgcgagacccctggggatcctccattactatgctatggatctgtggggacagggcacaaccgttacggtgtcttcc

SEQ ID NO: 43130 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgggctcgtcaagccttccgaaaccctgtctcttacatgcagcgtttccggaggctctatcagctccgacttctggtcttggattagacagccgcccgggaaaggactggagtggatcggctacgtgtataaccgggggagcacgaagtactcccctagcctcaaatctcgcgtgaccatttccgccgatatgagcaagaatcagttttctctgaacatgtccagcgtcacagctgccgacaccgcggtgtattactgtgctaaaaatggaagatcttccacaagctggggcatcgatgtttggggcaaggggaccacagtgaccgtctcctct

SEQ ID NO: 43131 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgggctcgtcaagccttccgaaaccctgtctcttacatgcacggttagcggaggctccatctctgcctaccactggagctggattagacagccgcccgggaaaggactggagtggatcggccatattttcgactccgggtctacctattacaaccctagcctcaagtcccgggtgacaatcagcctggatgcttctaaaaatcagctttccctgcgcctcaccagcgtgacagcctctgacaccgcgatttattactgtgctagacccctgggatcccggtattactatggcatggatgtctggggccaagggacaaccgtgacggttagctct

SEQ ID NO: 43132 - RNA, 360 nt, synthetic construct
  misc_feature 1..360: note = derived and/or modified sequence opt5 from anti-influenza_Chain
  source 1..360: mol_type = other RNA
gaggtgcagctggtcgaaagcggcgggggactcgttcaacccggcgggtccctgagaatctcttgcgccgctagcggattcaccgtgtcctctaactacatgagctgggtgcggcaggcccctggcaaggggcttgagtgggtctccgtgatttattctggaggcagcacatactatgcggactccgttaaaggccgctttagcttctctagagataattccaagaacacggtgtttctgcagatgaatagcctccgggctgaagacaccgccgtctactattgtgcccgctgcctgtctagaatgcgggggtacggacttgatgtgtggggccaggggacaaccgttacagtgtccagc

SEQ ID NO: 43133 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgggctcgtcaagccttccgaaaccctgtctcttacatgcacggttagcggatcctctatcagcaactactattggtcctggattagacagtctccgggcaaagggctggagtggatcggattcatttactatggcgggaataccaagtacaaccccagcctcaaatcccgggtgacaatcagccaggacacctctaagtcccaagtgagcctgacaatgtcttccgtcaccgccgctgaaagcgccgtgtatttttgtgcgcgcgcttcttgctccggaggctactgtattcttgattattggggccaggggacactggttaccgtgagctcc

SEQ ID NO: 43134 - RNA, 360 nt, synthetic construct
  misc_feature 1..360: note = derived and/or modified sequence opt5 from anti-influenza_Chain
  source 1..360: mol_type = other RNA
caggtgcaactgcagcagagcggcgccgaggtcaagaaacccgggtcctctgttaaggtgagctgcaaagtgtccggagtcatcttctctggcagcgctatttcctgggtgagacaggcccctgggcaaggactcgaatggatgggcgggatctctccgctgtttggaaccacaaactacgcgcagaagttccagggccgggttacgattaccgctgaccagagcacaaataccacatatatggaggtgaactcccttcgctacgaagataccgccgtctatttttgtgccagaggccccaaatactatagcgagtacatggacgtgtgggggaagggaacaaccgttacggtgtcttcc

SEQ ID NO: 43135 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgaggttaagaaacccgggtcctctgtgaaggtgagctgcaaggcttccggaggcaccttctctagctacgccatctcctgggtcagacaggcgcctgggcagggactcgaatggatgggcgggattatgggaatgtttggcacaacgaactatgctcaaaaattccagggccgggtgaccatcacagccgacgagtttacctctgccgcttacatggaactgcgcagccttagatccgaggatacagccgtttattactgtgctcggagctctgggtattacccggaatatttccaggactggggacagggcaccctggtgacagtctccagc

SEQ ID NO: 43136 - RNA, 360 nt, synthetic construct
  misc_feature 1..360: note = derived and/or modified sequence opt5 from anti-influenza_Chain
  source 1..360: mol_type = other RNA
cagatgcaactggtgcagagcggcgccgaggtcaagaaacccgggtcctctgttaaggtgagctgcaaagcctccggaggcaccttctctagctacgctatcacatgggtgagacaggcgcctgggcagggactcgaatggatgggcgggattatcggaatgtttggctccacgaactatgctcaaaatttccagggccgggtcaccattacagccgacgagtctaccagcacagcctacatggaactgtccagccttcgctctgaggataccgctgtgtattactgtgccagatccacagggtattacccggcttatctgcaccattggggacagggcaccctcgttacggtgagctct

SEQ ID NO: 43137 - RNA, 360 nt, synthetic construct
  misc_feature 1..360: note = derived and/or modified sequence opt5 from anti-influenza_Chain
  source 1..360: mol_type = other RNA
gaggtgcagctggtcgaaagcggcgccgaggttaagaaacccgggtcctctgtgaaggtgagctgcaaagcctccggaggcaccttctctagctacgggatctcctgggtcagacaagctcctggacagggcctcgaatggatgggggacattatcggaatgtttggctctacaaactatgcgcagaatttccagggccggctgacgattaccgctgatgagagcacatccaccgcctacatggaacttagctctctgcgctccgaggacacagccgtgtattactgtgctagaagctctgggtattacccggcctatctcccccactggggacaaggcaccctggttacagtgtccagc

SEQ ID NO: 43138 - RNA, 360 nt, synthetic construct
  misc_feature 1..360: note = derived and/or modified sequence opt5 from anti-influenza_Chain
  source 1..360: mol_type = other RNA
gaggtgcagctggtcgaaagcggcgccgaggttaagaaacccgggtcctctgtgaaggtgagctgcaaggcttccggaggcaccttctctagctacgccatctcctgggtcagacaagcgcctgggcagggactcgaatggatgggcgggattatcggaatgtttggcacagctaactatgcccagaaattccagggccgggtgacgattaccgccgacgagtttacatctaccgcttacatggaactgagctcccttcgcagcgaggatacagccgtttattactgtgctagagggaattattactatgagtcttccctggactactggggacaaggcaccctcgtgacagtcagctct

SEQ ID NO: 43139 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgaggttaagaaacccgggtcctctgtgaaggtgagctgcaaggcttccggaggccctttcagaaactttgccatcaattgggtccggcaggcgccggggcagggactcgaatggatgggcgggattatcgctgtgttcggaaccacaaaatacgcccacaaatttcaaggccgcgttacgattaccgccgacgattctacaaacaccgcttatatggagctgggcagccttaagtccgaagacacagccgtgtactattgtgctagagggccccattactattctagctacatggatgtctggggagagggcaccacagtgaccgtttccagc

SEQ ID NO: 43140 - RNA, 360 nt, synthetic construct
  misc_feature 1..360: note = derived and/or modified sequence opt5 from anti-influenza_Chain
  source 1..360: mol_type = other RNA
gaggtggccctggtcgaaaccggcgctgaggttaagaaacccgggagctccgtgaaggtgccttgcaaatctagcggatccccgttcagatctaacgccgtcagctgggtgcggcaggcgcccggccaagggctcgaatgggttggaggcatcctgggggtgtttggatccccttcttacgctcagaagttccagggccgcgtcacaattacggccgacgagagcaccaatacagtgcacatggaacttagaggcctgcggtccgaggataccgccgtttattactgtgctcgcgggcccacatattactatagctacatggacgtgtggggaaaaggcaccacagtcaccgtgtcttcc

SEQ ID NO: 43141 - RNA, 360 nt, synthetic construct
  misc_feature 1..360: note = derived and/or modified sequence opt5 from anti-influenza_Chain
  source 1..360: mol_type = other RNA
cagatgcaactggtgcagagcggcgccgaggtcaagaaacccgggtcctctgttaaggtgagctgcaaggcttccggaggcaccttctctagctacgccatctcctgggtgcgccaggcgcctgggcagggactcgaatggatgggcgggatttttggaatgttcggcacagctaactatgcccaaaaatttcagggccgggtcacgatcaccgccgacgagttcacatctgctgcctacatggaactgagctcccttgggagcgaggataccgctatgtattactgtgccagatcttccggatattacccgcagtattttcaggactggggccaagggacactggtgaccgttagctct

SEQ ID NO: 43142 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgaggttaagaaacccgggtcctctgtgaaggtgagctgcaaggcttccggagtcaccttctcttactatgccatgagctgggtgagacaggcgcctggccaggggctcgaatggatgggaggcatctccccgatgtttgggacaacgacctacgctcaaaaattccagggacgggttacaattaccgccgacgattctacaagcaccgcctatatggaggtgcgctccctgagaagcgaagacacagctgtctactattgtgcccggtcttccaactactatgatagcgtgtacgactactggggccagggcacccttgttacggtgtcttcc

SEQ ID NO: 43143 - RNA, 360 nt, synthetic construct
  misc_feature 1..360: note = derived and/or modified sequence opt5 from anti-influenza_Chain
  source 1..360: mol_type = other RNA
gaggtgcagctggtcgaaaccggcgccgaggttaagaaacccgggagctccgtgaaggtgccttgcaaatctagcggatccccgttcagatctaacgctgtcagctgggtgcggcaagcccccggccaggggctcgaatgggttggaggcatcctgggggtgtttggatccccttcttacgcgcagaagttccagggccgcgtcacaattacggctgacgagagcaccaatacagtgcacatggaacttagaggcctgcggtccgaggataccgccgtttattactgtgcccgcgggcccacatattactatagctacatggacgtgtggggaaaaggcaccacagtcaccgtgtcttcc

SEQ ID NO: 43144 - RNA, 360 nt, synthetic construct
  misc_feature 1..360: note = derived and/or modified sequence opt5 from anti-influenza_Chain
  source 1..360: mol_type = other RNA
caggtgcacctggtccaaagcggcgccgaggttagaaagcccggggcttccgtgaaagtgtcttgcaaggtcagcggatacaccctcaacgaactgtccatccattggcttcggcaggcccctggccgcgggctggagtggatgggatctttcgacccggaagatggcgagacaatttatgcgcagaaatttcaggggagagtgacgatgaccggagacacaagcaccgatacagcttacctcgaactgacctcccttcggtctgaggacacagccctgtattactgtgcccgcggctggggcgctgttaccagccccttcgatttttgggggcaaggaacgctcgtgaccgtctccagc

SEQ ID NO: 43145 - RNA, 360 nt, synthetic construct
  misc_feature 1..360: note = derived and/or modified sequence opt5 from anti-influenza_Chain
  source 1..360: mol_type = other RNA
gaggtgcagctggtccaaagcggcgccgaagttaagaaacccgggtcctctatgaaggtgagctgcaaggcttccggatctatcttcagcaactacggcatttcctgggtgagacaggcccctgggcagggactcgagtggatgggcgggatcattccgatctttggagcggctaattatgcccagaaattccaaggccgggtcaccattacagccgacgaatctacgagcaccgtgtacatggaggttcgctccctgagaagcgaagatacagctgtgtattactgtgcccggcgccagcagctttataaaggctactatcaccattgggggcagggaaccctggtcacagtgtcttcc

SEQ ID NO: 43146 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccggggttaagaaacccggatcctctatgaaggtgagctgcaaggcttccggctctatcttcagcaactacgggatttcctgggtgagacaggcccctggacagggcctcgagtggatgggagggatcattccgatctttggcgcggctaattatgcccaaaaattccagggccgggtcaccattacagccgacgaatctacgagcaccgtgtacatggaggttcgctccctgagaagcgaagatacagctgtgtattactgtgcccggcgccagcagctttataaagggtactatcaccattggggacaaggcaccctggtcacagtgtcttcc

SEQ ID NO: 43147 - RNA, 360 nt, synthetic construct
  misc_feature 1..360: note = derived and/or modified sequence opt5 from anti-influenza_Chain
  source 1..360: mol_type = other RNA
caggtgcaactgcaggagagcggccccgggctcgtcaagccttccgaaaccctgtctcttacatgcacggttagcggaggcctgatcgggaccggatcctactattggggctggattagacagacaccggggaaaggaatggagtggatcggctctattagctactccggctctacctattaccaccccagcctcaagtcccgggtgacaatcagcgacgatacctctaaaaaccagctgttccttaagctgcgctccgtgacagccgctgacaccgcccaatattactgtgcgagatataattgggggattcggtactttgatttctggggacgcggcacgctcgtcaccgtgagctct

SEQ ID NO: 43148 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgccgaggttagaaagcccgggtcctctgtgaaagtgagctgcaaggtctccggaggcatcattcggaaatacgctatcaactgggtgcgccaggcccctgggcagggactcgaatggatgggcgggattatcgcgattttcaataccgctaactatgcccaaaagtttcagggaagagttacaatcacggccgacgagtctaccagcacagtgtacatggaactgtcctctcttcggagcgaggataccgctctgtattactgtgcccgcggcatgaattattactccgactatttcgattactggggccaggggagcctcgtcacagtgtctccg

SEQ ID NO: 43149 - RNA, 360 nt, synthetic construct
  misc_feature 1..360: note = derived and/or modified sequence opt5 from anti-influenza_Chain
  source 1..360: mol_type = other RNA
caggtgcaactggtccagagcggcgggggagttgtgcagcccggcagatccctccggctgtcttgcgccgctagcgggttcacctttcgctcccacgccatgcattgggtgagacaggcgcctggaaagggcccggagtgggtcgctcttatctcttacgacgaagtgaacaaattctatgccgatagcgttaaggggcggtttacaatttcccgcgacgtgtctaaaaatacggtcttcctgcaaatgaacagcctctccgccgatgacaccgctgtgtactattgtgccagaggacacagcggctcttaccggctgtttgatttctggggccaggggacacttgttaccgtgtccagc

SEQ ID NO: 43150 - RNA, 360 nt, synthetic construct
  misc_feature 1..360: note = derived and/or modified sequence opt5 from anti-influenza_Chain
  source 1..360: mol_type = other RNA
caggtgcaactggtcgagagcggcgggggactcgttcagcccggcgggtccctgagactttcttgcgccgctagcggattcatctttggcgacttcgccattcactgggtgcggcaggcgtccgggaagggactggaatgggtggctcgcatcagatctggcctcaaccggtttgagaccgcctacgccgctagcgtcgaaggccgcctgacaatttccagagatgactctaaaagcatggcctatcttcagatgaataacgtgaaggctgaggatacggccgtttacctgtgtacctatctcgtgggggcggtcggattccaacattggggccaggggacactggtgaccgtttccagc

SEQ ID NO: 43151 - RNA, 360 nt, synthetic construct
  misc_feature 1..360: note = derived and/or modified sequence opt5 from anti-influenza_Chain
  source 1..360: mol_type = other RNA
caggtgcaactggtcgagagcggcgggggagttgtgcagcccggcagatccctccggctgtcttgcgccgctagcgggttcaccttttcctcttacggaatctattgggtgcgccaggcccctggcaaggggcttgaatgggtcgcgttcattagctacgacgagatcaataaattttatgctgattccgtgaagggaagattcacaatttctcgggacaatagcaaaaacacggtttttctgcagatgaactccctccgcgatgaagacaccgccgtgtactattgtgccaagccgctgagaggcagctaccggtatttcgatctttggggccgcgggacagtcgtgaccgtttcttcc

SEQ ID NO: 43152 - RNA, 363 nt, synthetic construct
  misc_feature 1..363: note = derived and/or modified sequence opt5 from anti-influenza_Chain
  source 1..363: mol_type = other RNA
caggtgcaactgcaggagagcggccccgacctcgtcaagcctggggcctccgttatgatctcttgcaaagctagcggatactccttcacctattactatatgcactgggtgaagcagtctcatggcaaaacactggaatggattgggagaatctacccgtataacggagatacgaattacaaccggcgctttaaggacaaagccattcttaccgtggatgagagctcctctacagcgtatatggaactgagaagcctcacctccgaggacagcgctgtctacttctgtgcccgggatgccaattacgaaggcgactggtattttgatgtgtgggggcagggaacaaccgttacagtgtcttcc

SEQ ID NO: 43153 - RNA, 363 nt, synthetic construct
  misc_feature 1..363: note = derived and/or modified sequence opt5 from anti-influenza_Chain
  source 1..363: mol_type = other RNA
caggtgcaactggtccagagcggagggggagttgtgcagcccggcagatccctccggctgtcttgcgccgctagcgggttcaccttttcctcttacgccatgcactgggtgcgccaggcgcctggaaagggccttgagtgggtcgctatcattagctatgacgggaacgatcaatactatacagactccgtgaaaggaagattcacgatctctcgggatagctccaaggtttacctgcagatgcatcgcctcagaccggaagacaccgccgtgtattactgtgccaaagagtttgaaacaagcggctatttccacggctcttttgattactgggggcagggcattctggtcaccgtgtccagc

SEQ ID NO: 43154 - RNA, 363 nt, synthetic construct
  misc_feature 1..363: note = derived and/or modified sequence opt5 from anti-influenza_Chain
  source 1..363: mol_type = other RNA
caggtgcaagtcgttcagagcggcgccgaggtgaagaaacccgggtcctctgtgagagtcagctgccaggcttccggaggcaccttcatgaactacgccatcatttgggtgcggcgcgcgcctgggcagggactggaatggatgggcgggatcattccggtttttcccacacctaattatgctcaaatgttccagggaagagtgacgatctctaccgacgagagccggtccacatcttttctcgaactgaccaaccttcgctacgaggatacagccgtctattactgtgccagacggatttatcacggcggcaatagcgggttcgacttttggggacagggcaccctggtgacagtttccagc

SEQ ID NO: 43155 - RNA, 363 nt, synthetic construct
  misc_feature 1..363: note = derived and/or modified sequence opt5 from anti-influenza_Chain
  source 1..363: mol_type = other RNA
caggtgcaactgcaggagagcggccccgggctcctgaagccttccgacacccttgccctgacatgcacggtctctggaggcagcatcacctccgattactggtcttggattagacagccgcccgggcggggactcgactggatcggcttcttttataacgggggaagcacaaaatacaatccttccctgaagtctcgcgttaccattagcgctgatacatccaaaaaccagcttagcctgaagctcacctctgtgacagccgcggacaccggcgtgtattactgtgctagacacgatgccaaattctccggcagctattacgtcgcctcttgggggcaaggaacgcgggtgaccgtttccagc

SEQ ID NO: 43156 - RNA, 363 nt, synthetic construct
  misc_feature 1..363: note = derived and/or modified sequence opt5 from anti-influenza_Chain
  source 1..363: mol_type = other RNA
caggtgcaactgcaggagagcggccccgggctcctgaagccttccgacacccttgccctgacatgcacggtctctggaggcagcatcacctccgattactggtcttggattagacagccgcccgggcggggactcgactggatcggcttcttttataacgggggaagcacaaaatacaatccttccctgaagtctcgcgttaccattagcgctgatacatccaaaaaccagcttagcctgaagctcacctctgtgacagccgcggacaccggcgtgtattactgtgctagacacgatgtcaaattctccggcagctattacgtggcctcttgggggcaaggaacgcgggttaccgtgtccagc

SEQ ID NO: 43157 - RNA, 363 nt, synthetic construct
  misc_feature 1..363: note = derived and/or modified sequence opt5 from anti-influenza_Chain
  source 1..363: mol_type = other RNA
caggtgcaactgcaggagagcggccccgggctcgtcaagccttccgaaaccctgtctgttacatgcaaagtgagcggagactccatctctagctactcctggtcttggattagacagccgcccggcaaggggcttgagtgggtgggatatctgtactatagcggctccacgaaatacaaccctagcctcaagtctcggaccacaatctccgtcgataccagcacaaatcagctgtctcttaaactgtccttcgtgaccgccgctgacacagccgtttatttttgtgcgcgcaccgggagcgaatctacgaccggatacggcatggatgtgtggggccaagggacaaccgtcacagtgtccagc

SEQ ID NO: 43158 - RNA, 363 nt, synthetic construct
  misc_feature 1..363: note = derived and/or modified sequence opt5 from anti-influenza_Chain
  source 1..363: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagc

SEQ ID NO: 43159 - RNA, 363 nt, synthetic construct
  misc_feature 1..363: note = derived and/or modified sequence opt5 from anti-influenza_Chain
  source 1..363: mol_type = other RNA
caggtgcaactggtccagagcggcgccgaggttaagaaacccgggtcctctgtgaaggtgagctgcaaggcttccggaggccctttcagatcttacgccatcagctgggtccggcaggcgccggggcagggacccgaatggatgggcgggattatccctatttttggaaccacaaaatatgctcccaaattccaaggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagc

SEQ ID NO: 43160 - RNA, 363 nt, synthetic construct
  misc_feature 1..363: note = derived and/or modified sequence opt5 from anti-influenza_Chain
  source 1..363: mol_type = other RNA
gaggtgcagctggtcgaaaccggcgccgaggttaagaaacccggggctagcgtgaaggtgtcctgcaaagcctctggatacacattcacgagctattacatgcactgggtcagacaagcgcctggccaggggctcgaatggatgggatggatcaaccccaattccggcgggaccaactatgctcagaagtttcagggacgggtgacaatgacccgcgacacatctattagcaccgcctacatggagctgtccagacttcggtctgatgacacagccgtttattactgtgctcgcgaaggcaaatggggcccgcaagccgctttcgatatctgggggcagggaaccatggtgacggtcagctcc

SEQ ID NO: 43161 - RNA, 363 nt, synthetic construct
  misc_feature 1..363: note = derived and/or modified sequence opt5 from anti-influenza_Chain
  source 1..363: mol_type = other RNA
gaggtgcagctggtcgaaagcggcgccgaggttaagaaacccgggtcctctgtgaaggtgagctgcaaggcttccggaggcaccttctctttttacagcatgtcctgggtcagacaagcccctgggcagggactcgaatggatgggcgggatcattccgatgttcggaacaacgaactatgcgcagaaatttcagggccgggtgaccatcacagctgttgagtctaccagcacagcctacatggaagtgtccagcctgcgctctgaggacaccgccgtctattactgtgctagaggcgataaagggatttattactattacatggacgtgtggggaaagggcacaaccgttacggtgtccagc

SEQ ID NO: 43162 - RNA, 363 nt, synthetic construct
  misc_feature 1..363: note = derived and/or modified sequence opt5 from anti-influenza_Chain
  source 1..363: mol_type = other RNA
gaggtgcagctggtcgaaaccggcgccgaggttaagaaacccgggagctccgtgaaggtgtcttgcaaagctagcggaggcacattcagaacgcacgccatctcctgggtccggcaagcgcctgggcagggactcgaatggatgggcgggattatcgctatttttggaaccgccaactacgcccagaagttccagggccgcatcacaattaccgctgacgagtctacaagcaccgcctatatggaactgtcctctcttagaagcgaggatacagctgtgtacttttgtgcccggggctccgggtatcatatcagcaccccgttcgacaattggggacaaggcacgctggttaccgtgtcttcc

SEQ ID NO: 43163 - RNA, 363 nt, synthetic construct
  misc_feature 1..363: note = derived and/or modified sequence opt5 from anti-influenza_Chain
  source 1..363: mol_type = other RNA
gaggtgcagctggtccaaagcggcgccgaagttaagaaacccgggtcctctgtgaaggtgagctgcaaggcttccggaggcatcttcagatctaacagcatttcctgggtccggcaggcccctgggcagggactcgagtggatgggcgggatctttgcgctgttcggaaccacagactacgctcagaaatttcaaggccgcgtgacgattaccgccgatgaatctagcacaaccgtttatcttgagctgtccagcctcacatctgaagacaccgccgtgtactattgtgctagaggctccgggtacacaacccggaattatttcgattactggggacagggcacgctggtcaccgtgagctct

SEQ ID NO: 43164 - RNA, 363 nt, synthetic construct
  misc_feature 1..363: note = derived and/or modified sequence opt5 from anti-influenza_Chain
  source 1..363: mol_type = other RNA
gaggtgcagctggtcgaaagcggcgccgaggttaagaaacccgggtcctctgtgaaggtgagctgcaaggcttccggaggcatcttcaactcttacgccattagctgggtcagacaagcgcctgggcagggactcgaatggatgggcgggatcattgctatctttcacaccccgaaatatgcccagaaattccagggacgggtgacaattacggccgacgagtccaccaatacagcttacatggaactgcgctctcttaagagcgaggataccgccctgtattactgtgctagaggctccacatatgactttagctctggcctcgattactgggggcaaggaaccctggttacagtgtccagc

SEQ ID NO: 43165 - RNA, 363 nt, synthetic construct
  misc_feature 1..363: note = derived and/or modified sequence opt5 from anti-influenza_Chain
  source 1..363: mol_type = other RNA
caggtgcaactggtccagagcggcgccgaggttaagaaacccgggtcctctgtgaaggtgagctgcaaatcctctggaggcaacttcaataactacgctgtcagctgggtgagacaggcccctgggcagggactcgaatggatgggcgggatctccccgatttttggatctaccaatcacgcgcaaaagttccagggccgggttacaatcagcgctgacatttttacgaacaccgcctatatggagctgtccagccttcgctctgatgacacagccatctactattgtgctagaggccgggggtactatttctaccatgccatggatgtgtggggacagggctccaccgtcacagtgagctct

SEQ ID NO: 43166 - RNA, 363 nt, synthetic construct
  misc_feature 1..363: note = derived and/or modified sequence opt5 from anti-influenza_Chain
  source 1..363: mol_type = other RNA
caggtgcaactggtccagagcggcgccgaggttaagaaacccgggtcctctgtgaaggtgagctgcaaggcttccggaggcaccttcaacaattacgccatcaactgggtcagacaggcgcctgggcagggactcgaatggatgggcgggatttctccgatctttggaagcgtgaattatgctcaaaaactgcagggccgggttacaattacggccgacgtgttcacctccacagcctacatggagctttctagcctgcgctccgaagataccgctgtctattactgtgccaaaggcagcgggtattactattactacggactcgacgtgtggggcctggggacaaccgttacagtgtcttcc

SEQ ID NO: 43167 - RNA, 363 nt, synthetic construct
  misc_feature 1..363: note = derived and/or modified sequence opt5 from anti-influenza_Chain
  source 1..363: mol_type = other RNA
caggtgcaactggtcgagagcggcgggggagttgtgcagcccggcagatccctccggctgtcttgcgccgctagcgggttcacctttacaaattacgccatgcactgggtgcgccaggcgcctggaaagggccttgaatgggtcgctgtgatctccttcgacgaggataataaatcttatgccgactacgttaaggggagatttacgattagccgggataactccaataaccgcctgtatctccagatgaactctctgagagccgaagacaccgctgtgtactattgtgcccggggaccggagggcgtctggggccgcagcatcgattcctgggggcaaggaacacttgtgaccgttagctct

SEQ ID NO: 43168 - RNA, 363 nt, synthetic construct
  misc_feature 1..363: note = derived and/or modified sequence opt5 from anti-influenza_Chain
  source 1..363: mol_type = other RNA
caggtgcaactggtccagagcggcggggacctcgttcagcccggaggctccctgagactttcttgcgccgctagcgggttcaccttttcccggtactctatgaactgggtgcgccaggcccctggaatgggcctggagtgggtggcgtatatcagcgatacatccagaacgatttactatgctgactctgtcaaggggcggttcaccatcagccgcgataatgccaagaactccctctacctgcaaatgaaaagccttagagacgaagatacagccgtgtattactgtgctcgggacccggataccccctttgttcgcgccttcgactcttggggacagggcacactggtgaccgtctccagc

SEQ ID NO: 43169 - RNA, 363 nt, synthetic construct
  misc_feature 1..363: note = derived and/or modified sequence opt5 from anti-influenza_Chain
  source 1..363: mol_type = other RNA
caggtgcaactggtcgagagcggcgggggactcgttcagcccggcgggtccctgagactttcttgcgtggccagcggattcaccttttcccggttctctatgaactgggtgcgccaggctcctggcatggggctggaatgggtcagctacatctccgacacaggaagaacgatttattacgccgattctgtgaagggccggtttaccatcagccgcgacaatgataaaaacacactctatctgcagatgaagtcccttagagacgaggatagcgcgttctactattgtgctcgggacccggataccccctttgttcgcgccttcgactcttggggccaaggggtgctggtcacagtgtccagc

SEQ ID NO: 43170 - RNA, 363 nt, synthetic construct
  misc_feature 1..363: note = derived and/or modified sequence opt5 from anti-influenza_Chain
  source 1..363: mol_type = other RNA
caggtgcaactgcaggagagcggccccgacctcgtcaagcctggggcctccgttaaaatgtcttgcaaggctagcggatactccttcacctattaccacatgcattgggtgaaacagacacacggcaagtctctggaatggatcgggagaatttatccgtacaacggaggcacgaattatagccagcggtttaaagggaaggccgtgttcaccgtcgatatgtcctctagcacagcgtacatggagcttcgctccctgaccagcgaagactctgctgtgtattactgtgccagagatgccaactacgagggagactggtattttgatgtttggggccaaggcacaaccgtgacagtctccagc

SEQ ID NO: 43171 - RNA, 366 nt, synthetic construct
  misc_feature 1..366: note = derived and/or modified sequence opt5 from anti-influenza_Chain
  source 1..366: mol_type = other RNA
cagggccaactggtgcagagcggggccgaggtcaagaaatccggatctagcgttaaggtgtcctgcaaaacctctggcgggacattcaacagccacgctatctcctgggtgagacaggcccccggacagggcctcgaatggattgggggaatcattcctatgtttggcacgaccaattacgcgcaaaagctgaaaggccggatcgctattacagccgaccagcttccgaccacagcctatctggagctctctagcctgcgctccgaagataccgctgtctactattgtgccagagggcagcggtactattacgaccgcgatggaatggacgtgtggggccaggggacaatggttaccgtgagctct

SEQ ID NO: 43172 - RNA, 366 nt, synthetic construct
  misc_feature 1..366: note = derived and/or modified sequence opt5 from anti-influenza_Chain
  source 1..366: mol_type = other RNA
caggtgcacctggtccaaagcggcgccgaggttaagaaacccgggtcctctgtgagactcagctgctccgcttctggaggccctttcagcgggtttgccatctcctggctgcggcaggcgccgggacagggccttgaatggctcgggggaatttctgctgtgttcggcaccgccacatacgcccagaagtttcaaggccgcgtcacgatcaccgctgaccagttcacaagcacctcccatatggatctgagcagactgacatatgacgataccgccgtgtactattgtgctcggtctgggggataccttccccagaacaattggattgacccttggggccaggggacactggttatcgtgtccagc

SEQ ID NO: 43173 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgccgaggttaagaaagctgggtcctctgtgaaggtgagctgccagtcctctggagtcaccttcagcatgtacgccgtgtcctgggttagacaggcgcccggccaagggctcgaatggatgggaggcatcattcctctgtttgggacaacgacctatgctcagaaattcgagggacggcttacaatcaccgccgacacatctaccaacatggcctacctggaactccgcagcctgagatccgaggatacagctgtgtatttttgtgcccgggctggcaccacggtcacccgcttcaattggtttgacccgtggggccaggggacacttgtgaccgttagctct

SEQ ID NO: 43174 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgccgaggttaagaaacccgggtcctctctcaaggtgagctgcaaggcttccggagtgaccttctctatgtacacaatcagctgggtcagacaggcccctggccaggggctggaatggatgggaggcattatcccgctttttgggacggcgaactatgagcaaaaattccagggacgggtgaccattacagctgacacctccacaaataccgcctacatggaactgtctagcctccgctccgaggatacagccgtttattactgtgctagagccggcaccacgctgacccggtttaactggttcgacccctggggccaggggacacttgtgaccgtcagctct

SEQ ID NO: 43175 - RNA, 366 nt, synthetic construct
  misc_feature 1..366: note = derived and/or modified sequence opt5 from anti-influenza_Chain
  source 1..366: mol_type = other RNA
atggccgacaacatgaccacaacgcagatcgagtggagaatgaagaaaatggctattggcagctccacccactctagctccgtgctgatgaaggatatccaatctcagttcgaacagctcaaactgcggtgggagagctaccccaatcttgtcaagtccacagactatcatcagaaacgcgaaaccattagactggccacagaggaactctacctgctttctaagcggatcgatgacagcattctgtttcacaagaccgttatcgcgaactccagcatcattgctgatatgatcgtgtctctctccctgctggagacactctatgagatgaaagacgtggtcgaagtgtacagccgccaatgcctg

SEQ ID NO: 43176 - RNA, 366 nt, synthetic construct
  misc_feature 1..366: note = derived and/or modified sequence opt5 from anti-influenza_Chain
  source 1..366: mol_type = other RNA
gaggtgcagctggtccaaagcggcgggggactcgttcagcccggcgggtccctgagacttgcctgcgtggtgtctggattcaccgtcacaagcaattacatcacgtgggtgcggcaggctcctggcaaggggctggaatgggtttccgtgatttattctcacggacgcgcctactatagcgcgtccgtcaatggcagatttaccatctctcggcatacaagcaaaaacaccgtgtacctcgagatgaactccctgcgcccggaagacacagctgtttattactgtgccggcgggggacttgtgggcgggtatgatgagtacttctttgactactggggacagggcaccctggccacagtcagctct

SEQ ID NO: 43177 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagggactcgaatggatgggctggatcaaccccaattccggggacacgaactatgctcaaaagtttcagggacgggtgaccatgacacgcgatacctctattacaaccgcctacatggagctgagctcccttagatctgacgatacagccgtttattactgtgctcgggacagcccgtattccagctcttggtccttctttgattactggggccagggccctctggtgaccgtcagctct

SEQ ID NO: 43178 - RNA, 366 nt, synthetic construct
  misc_feature 1..366: note = derived and/or modified sequence opt5 from anti-influenza_Chain
  source 1..366: mol_type = other RNA
gaggtgcagctggtcgaaagcggcgggggactcgttcaacccggcgggtccctgagactttcttgcgccgctagcggattcatctttcggaattactggatgtcctgggtgcgccaggcccctggcaaggggctggagtgggtggcgaatattaaacaggacggaagagaaaagtattacgtcgattctctccggggccgcgtgaacatcagcagagacaatgctgagaactccctgtatcttcacatgaactctctgcgggttgaagataccgccgtgtacttctgtgcccgcgctagaatggtcgtggttacaggcgacgggtttgatgtgtggggacatggcacgatggtcaccgtgagctcc

SEQ ID NO: 43179 - RNA, 366 nt, synthetic construct
  misc_feature 1..366: note = derived and/or modified sequence opt5 from anti-influenza_Chain
  source 1..366: mol_type = other RNA
gaggtgcagctgctcgaaagcggcgggggactggtccaacccggcgggtcccttagactgtcttgcgccgctagcggattcgccttttcctcttacggcatgagctgggttcggcaggcgcctgggaagggactcgagtgggtgtccgctttctctggcagcggcacctccacatattacgccgacagcgtgaaagggcgctttacgatctctagagataagtccaaaaacaccctgtatcttcagatgaatagcctgcgggccgaagacacagctatttactattgtgccaagccgcccggaccttacatcgtcgtggctggcctcttcgagaactgggggcgcggaaccctggttacagtgtct

SEQ ID NO: 43180 - RNA, 366 nt, synthetic construct
  misc_feature 1..366: note = derived and/or modified sequence opt5 from anti-influenza_Chain
  source 1..366: mol_type = other RNA
gaggtgcagctggtcgaaagcggcgggggagttgtgcaacccggcagatccctccggctgtcttgcgccgctagcgggttctccttttctaactacgccatgcactgggtgcgccaggcgcctggaaagggccttgagtgggtcgctctgatcagcttcgacgggtccgataaatattacgccgactctgtgaagggaagatttaccatgagccgggataattccaaaaacacactctatctgcagatgaatagccttcgcgccgaagacacggctgtttactattgtgccagagatgagccgtactgcggcggcgactgtttcgcttttgatgtgtgggggcagggaaccatggtcacagtgtct

SEQ ID NO: 43181 - RNA, 366 nt, synthetic construct
  misc_feature 1..366: note = derived and/or modified sequence opt5 from anti-influenza_Chain
  source 1..366: mol_type = other RNA
caggtgcaactgcagcagagcggccccgggctcgtcaagccttcccagaccctgtctcttacatgcacggttagcggaggcccggtgtccgggggaggctactcttggaactggatcagacaacggcccgggcagggactggagtgggtgggcttcatgtttcacagcggctcccctcgctataatcccaccctcaaatctagaattacaatcagcgtcgacacctccaagaacctggtgagccttaaactgtcttccgttacagccgctgataccgccgtgtacttctgtgcgcgggtcgggcagatggacaagtattacgctatggatgtgtggggacagggcacaaccgttacggtgagctct

SEQ ID NO: 43182 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgggggactcgttaagcccggcgggtccctgagactttcttgcgccgctagcggattcaccttttcctcttacagcatgaactgggtgcggcaggcccctggcaaagggctggagtgggtgtcctctatcagctcctctagctcctatatttactatgtcgacagcgtgaagggacgcttcacaatctctagagataatgcgaaaaactccctctacctgcagatgaatagccttcgggctgaagacacggccgtttattactgtgcccgcggcggcgggtcttatggagcttacgagggctttgattactgggggcaaggaaccctggtgacagtctccagc

SEQ ID NO: 43183 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgggggagttgtgcagcccggcagatccctccggctgtcttgcgccgctagcgggttcaatttttcctcttacggaatgcactgggtgcgccaggcccctggcaaggggcttgagtggctgagcgtcatctggtccggaggctctaataaatattacgcggacagcgtgaagggcagattcaccatttcccgggatgacagcaaaaacacagtttatctccaaatgaactctctgcgcgatgaagacacggctgtgtactattgtgccagagcccataccgctcttacacggtttcgctggctggatccgtgggggcagggaatcctcgtcaccgtgtccagc

SEQ ID NO: 43184 - RNA, 366 nt, synthetic construct
  misc_feature 1..366: note = derived and/or modified sequence opt5 from anti-influenza_Chain
  source 1..366: mol_type = other RNA
caggtgcaactggtccagagcggcgggggagttgtgcagagaggccggtccctccgcctgtcttgcgccgctagcgggttcacctttagaacatacggaatgcactgggtgcggcaggcccccggcaaggggcttgagtgtgtcgcgctgatctcctatgacggaacgaacaaatactatgctgattctgtgaagggccgcttcaccattagcagagacaattccaaagatacactctacctgcaaatgaactctcttcgggccgaagacaccggcgtttattactgcgccagcctggattatgacttttcctactactatcatcgcgatgtgtgggggcctggaacaaccgtcacagtgagctct

SEQ ID NO: 43185 - RNA, 366 nt, synthetic construct
  misc_feature 1..366: note = derived and/or modified sequence opt5 from anti-influenza_Chain
  source 1..366: mol_type = other RNA
caggtgcaactggtcgagagcggcgggggactcgttcagcccggcgggtccctgagactttcttgcgccgctagcggattcaccttttccgactactggatggtgtgggtgcggcaggcccctggcaaggggctggtctgggtgtctcgcatcagctccgatggatctacaacgagctatgcggactccgttaaaggcccgttcaccattagcagagataacgctaagaatacactctacctgcagatgaactctcttcgggccgaagacaccgccgtgtattactgtgctcgcgtcgccacaccctattactatgagtccggctttgattactgggggcaaggagctctggtgaccgttagctct

SEQ ID NO: 43186 - RNA, 369 nt, synthetic construct
  misc_feature 1..369: note = derived and/or modified sequence opt5 from anti-influenza_Chain
  source 1..369: mol_type = other RNA
cagttccaactggtgcagagcggccccgaggtcaagaaacctgggacctccgttaaggtgtcttgcaaagccagcggatacacatccacgacctatggcatctcttgggtgagacaggtcccggggcagggactcgaatggatgggctggattaacccctacaatgggaaccctcactatggacaaaagtttcagggccgggtgacactgacccgcgacacaagcaccaatacagcttaccttgagatcctgtccctcagatctgatgacaccgccgtttattactgtgcgcgggatggctgggggcagcagctggtgccctattacttcgactactggggacaaggcacgcttgtcaccgtgagctcc

SEQ ID NO: 43187 - RNA, 369 nt, synthetic construct
  misc_feature 1..369: note = derived and/or modified sequence opt5 from anti-influenza_Chain
  source 1..369: mol_type = other RNA
caggtgcaactggcccagagcggcgctgaggtcaagagacccgggtcctctgttaaagtgagctgcaccgcctccggaggcatcttccggaagaacgcgatttcttgggtgcgccaggctcctgggcagggactcgaatggatgggcgggatcattgccgtctttaatacagccaactacgctcaaaaattccagggaagagtgaagatcacggccgacgagagcggcaataccgcttatatggaactgtcctctcttcggagcgatgacacagccgtttactattgtgcgtcccacccgaaatacttttatggcagcgggtcttaccccgatttctggggacagggcaccctggtgacagtctccagc

SEQ ID NO: 43188 - RNA, 369 nt, synthetic construct
  misc_feature 1..369: note = derived and/or modified sequence opt5 from anti-influenza_Chain
  source 1..369: mol_type = other RNA
caggtgcaactgcaggagagcggccccgggctcgtcaagccttccgaaaccctgtctcttacatgcacggttagcagaggatccatcggccactacttctggtcttggattcggcagccgcccgggaaaggactggagtggatcggctatattagctactccgggtctaccaagtataaccctagcctccgctccagagtgacaatcagcgtggacacctctaaaaatcagttttccctgaaccttaatagcgtcacagccaccgatacagctctgtactattgtgcccgggaagactacgatattctcaccggagcgggccccggcatggaggtgtgggggcaaggaacgaccgttacagtgtcttcc

SEQ ID NO: 43189 - RNA, 369 nt, synthetic construct
  misc_feature 1..369: note = derived and/or modified sequence opt5 from anti-influenza_Chain
  source 1..369: mol_type = other RNA
caggtgcaactgcaggagagcggccccgggctcgtcaagccttccgaaaccctgtctcttacatgcacggttagcggagcctccatcaactctcactactggagctggattagacagccgcccggcaaagggctggagtggatcggatatgtgtactattccggctctaccacatacaatcctagcctcaagtcccgggtgaccctgagcgtcgacacatctaaaaaccagttctcccttaatctgagctctgtgaccgctgccgatacagcgttttattactgtgctcgccatccctatgacgttctcaccgggtccggagattggttcgacccttggggccaaggcacgctggtgaccgtcagctct

SEQ ID NO: 43190 - RNA, 369 nt, synthetic construct
  misc_feature 1..369: note = derived and/or modified sequence opt5 from anti-influenza_Chain
  source 1..369: mol_type = other RNA
caggtgcaactggtccagagcggcgccgaggttaagagacccgggtcctctgtgaaagtgagctgcaccgcttccggaggcatcttccggaagaacgccatttcttgggtccgccaggcgcctgggcagggactcgaatggatgggcgggatcattgctgtgtttaatacagccaactacgcccaaaaattccagaatagagttaagatcacggctgacgagagcggaaacaccgcctatatggaactgtcctctcttacaagcgatgacaccgctgtgtactattgtgcctcccacccgaaatacttttatggcagcggctcttaccccgatttctgggggcagggaacactggtcaccgtgtccagc

SEQ ID NO: 43191 - RNA, 369 nt, synthetic construct
  misc_feature 1..369: note = derived and/or modified sequence opt5 from anti-influenza_Chain
  source 1..369: mol_type = other RNA
gaggtgcagctggtcgaaagcggcgccgaggttaagaaacccgggtcctctgtgaaggtgagctgcaaggcttccggaggcaccttcagatcttacgccgtcagctgggtgcggcaagcgcctgggcagggactcgaatggatgggcgggatcattgctatctttggaacaacgaactatgcccagaaattccaggaccgcgttaccattacagccgatgacctgccgtccaccgcttacatggagcttacatctctgagaagcgaagataccgccgtgtatttttgtgtccggggccgcggctactatctcgggggagactacggctccctggatagctgggggcaaggaacacttgtgaccgtttct

SEQ ID NO: 43192 - RNA, 369 nt, synthetic construct
  misc_feature 1..369: note = derived and/or modified sequence opt5 from anti-influenza_Chain
  source 1..369: mol_type = other RNA
gaggtgcagctggtcgaaagcggcgggggactcgttcaacccggcagatccctgcggctttcttgcgtggggagcggattcaactttgacggctacgccatgcagtgggtgcgccaggtccctgggaagggactggagtgggtgtccggcatctcttggcacagcgattccaccggctatgctgactctgttagagggcggttcacaattagccgcgataatgccaaaaactccctctacctgcagatggacagccttagaccggaagatacggcgttttattactgtggaaagtctatcggccatgtcgggggatcctatcggcaccccattgactactggggccaagggaccctggtgacagtgagc

SEQ ID NO: 43193 - RNA, 369 nt, synthetic construct
  misc_feature 1..369: note = derived and/or modified sequence opt5 from anti-influenza_Chain
  source 1..369: mol_type = other RNA
caggtgcaactgcaggccagcggccccgggctcgtcaagccttccgagaccctgtctcttacatgcacggttagcggagactccatcacctctggcgcttactattggacatggattagacagcacccggggaaaggactggaatggatcggctacatttattacagcgggaacacctattacaatccctccctcaagtctcgggtgacaatcagcctggatacctccaaaaaccagttcagccttaaggtcaattctgtgacagccgcggacaccgctgtgtattactgtgcccgcgccgcttccacgagcgttctgggatacggcatggatgtgtggggccaagggaccacagtcaccgtgtcttcc

SEQ ID NO: 43194 - RNA, 369 nt, synthetic construct
  misc_feature 1..369: note = derived and/or modified sequence opt5 from anti-influenza_Chain
  source 1..369: mol_type = other RNA
caggtgcaactggtccagagcggcgccgaggttaagaaacccgggtcctctgtgagagtgagctgcaaggcttccggatctatcttccggaactacgccatgagctgggtccgccaggcgcctggccaggggctcgaatggatgggaggcattatcgctatttttgggaccccgaaatatgcccaaaagttccagggaagagtgacaatcacggccgacgagtccacctctacagtttacatggaactgagcggccttcggtccgaggataccgctatgtattactgtgcccgcattccccactataattttggcagcgggtcttacttcgactattggggacagggcacactggtgaccgtctccagc

SEQ ID NO: 43195 - RNA, 369 nt, synthetic construct
  misc_feature 1..369: note = derived and/or modified sequence opt5 from anti-influenza_Chain
  source 1..369: mol_type = other RNA
cagctgcaactccaggagagcggccccagactggtgaagccttccgaaaccctttctctgacatgcagcgtctccggggtttctatcagctcctctaactactattggggatggattcggcagccgcccggcaaagggctcgagtggatcggaacgatttaccacagcggctccacctattacaatcctagcctgaagtctcgccttatcatttccgtggacacaagcaaaaaccagttctatctgcaactcacctctctgacagccgctgattccgccgtgtactattgtgcgaccgggggaggctttggctggagccagacatacttcgggtactggggacagggcaccctggtcacggcttcttcc

SEQ ID NO: 43196 - RNA, 369 nt, synthetic construct
  misc_feature 1..369: note = derived and/or modified sequence opt5 from anti-influenza_Chain
  source 1..369: mol_type = other RNA
gaggtgcagctgcaacagagcggccccgaactcgtcaagcctggggcctccgttaaaatgtcttgcaaggctagcggatacaccttcacatcctttatcatgtattgggtgaaacagaagccgggccaggggctggagtggcttggatacattgacccctataacgatggcacgaaatacaatgaaaagttcgaggggaaggccaccctgacatctgacaaaagctcctctaccgcgtatatggaactcagctccctgacaagcgaggattctgctgtgtactattgtgccaagagaggaaactacggcaatggctttgcctactgggggcaaggaacccttgtcacagtgtccgctgccaaaaccagc

SEQ ID NO: 43197 - RNA, 369 nt, synthetic construct
  misc_feature 1..369: note = derived and/or modified sequence opt5 from anti-influenza_Chain
  source 1..369: mol_type = other RNA
caggtgcaactgctcgagagcggcggggacgtcgttcagcccggaacctccctgagactttcttgcgccgctagcggcttctccctgtggacatctgggatgcactgggtgcggcaggcccctggaaagggcctcgaatgggtggcggtcatgagctacgatgagacgaaaaagtattacgctgactccgtgcgcgggagattttctatcagccgggataactcccgcaataccctgtatcttcagatgaacagcctgagagttgaagacacagccgtgtacttctgtgccaaaccgcggctcgattatctggactactttcatgctgccgattcttggggacaaggcaccctggtctccgtgagctct

SEQ ID NO: 43198 - RNA, 369 nt, synthetic construct
  misc_feature 1..369: note = derived and/or modified sequence opt5 from anti-influenza_Chain
  source 1..369: mol_type = other RNA
caggtgcaactggtcgagagcggcgccgaagttagaaaacccggggagtccctccggatctcttgcaaagctcacggagacagcttcacctcctactggattggctgggtgcgccagctgcctgggaagggacttgaatggatggccgtgatctatccgagagattctgagacaaaatttagccccgcgttccacggccaggtctccatttctgtggacaagagcacgtccaccgttcatctgcagtggaacagcctcaaggcttctgatacagccgtgtactattgtgcccggtcccctgggtacagcggatatctgtacggctggtttgacccctggggccaagggacccctgtcacagtgtcttcc

SEQ ID NO: 43199 - RNA, 369 nt, synthetic construct
  misc_feature 1..369: note = derived and/or modified sequence opt5 from anti-influenza_Chain
  source 1..369: mol_type = other RNA
caggtgcaactggtcgagagcggccccgggctcgttaagccttccgaaaccctgtctcttacatgcacggtgagcggagactccgtgatcaactctgcctactattgggattggattcggcagccgcccggcaaagggctggagtgggtcggaagcgtgtactattccggcatcacctactataatccttctctcaagagccgggttacaatttccgtggacaccagcaaaaaccagttctctctgcgcctttcctacgtcacagctgccgataccgcgctgtattactgtgctagaagagggggaggctggcagtactattacggcatggacgtgtgggggcaaggaacaaccgttacggtgagctct

SEQ ID NO: 43200 - RNA, 369 nt, synthetic construct
  misc_feature 1..369: note = derived and/or modified sequence opt5 from anti-influenza_Chain
  source 1..369: mol_type = other RNA
caggtgcaactggtccagagcggcgccgaggttaagaaacccggggcttccgtgaaggtgtcttgcaaagccagcggatacatcttcaccggctattacattcactgggtcagacaggcgcctgggcagggactcgaatggatgggccggatcgacccgaacgggtccggaacaacgtatgctcaaaagtttcagggccgcgtgaccctgacaatggatacctctattacaaccgcctacatggagcttagcagactgcggttcgacgatacagccatctattactgtgctcgctgggactggaattttgatctctatctgggctggttcgacccctgggggcagggaacccctgttacggtggcctcc

SEQ ID NO: 43201 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggcttccgtgaaggtgtcttgcaaagccagcggatacatcttcaccggctattacattcactgggtcagacaggcgcctgggcagggactcgagtggatgggccggatcgacccgaacggggctggaacaacgtatgcccagaagtttcaaggccgcgtgaccctgacaatggatacctccattacaaccgcctacatggaactttctagactgcggttcgacgatacagctatctattactgtgcccgctgggactggaattttgatctctatctgggctggttcgacccctgggggcagggaacccctgttacggtggctagc

SEQ ID NO: 43202 - RNA, 369 nt, synthetic construct
  misc_feature 1..369: note = derived and/or modified sequence opt5 from anti-influenza_Chain
  source 1..369: mol_type = other RNA
caggtgcaactggtccagagcggcgccgaggttaagaaacccggggcttccgtgaaggtgtcttgcaaagccagcggatacaccttcaacgcgcaccatatgcactgggtcagacaggctcctggccaggggctcggatggatgggctggatcgacccgaataacgatgggacaatttatgcccaaaagtttcagggacgggtgacgctgaccatggacacatccatccataccgcctacatggaactttctggcctgcgctatgatgacacagctatttactattgtgttagatgggcctggaatttcgactttttcctcggctggtttgatccctgggggcagggaaccctggtgacagtcgctagc

SEQ ID NO: 43203 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacagcgatacaatttactccccctcttttcagggacaagtcacgatcagcgctgacaactccattagcaccgcctatcttcagtggtcttccctgaaagcgagcgatacagctatctactattgtgcctctggccctggctactccgggtatcactacggatggttcgacacctggggccaggggacactcgtgaccgttagctct

SEQ ID NO: 43204 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacgctgatgccatttacagcccctcctttcagggacaagtcacaatctctgcggacaacagcatttccacggcttatcttcagtggagctctctgaaagcctccgataccgccatctactattgtgctagcggccctggctactctgggtatcactacggatggttcgacacatggggccaggggaccctcgtgacagtttccagc

SEQ ID NO: 43205 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggagagcgaaacaatttactccccctcttttcagggacaagtcacgatcagcgctgacaactccattagcaccgcctatcttcagtggtcttccctgaaagcgagcgatacagctatctactattgtgcctctggccctggctactccgggtatcactacggatggttcgacacctggggccaggggacactcgtgaccgttagctct

SEQ ID NO: 43206 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacgctgatacaatttacagcccctcctttcagggacaagtcacgatctctgccgacaacagcatttccaccgcgtatcttcagtggagctctctgaaagcctccgatacagctatctactattgtgccagcggccctggctactctgggtatcactacggatggttcgacacctggggccaggggacactcgtgaccgtttccagc

SEQ ID NO: 43207 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccggggagctccgacacaatttactctcccagctttcagggacaagtcacgatctccgctgataacagcatttctaccgcctatcttcagtggtccagcctgaaagcgtctgacacagctatctactattgtgcctccggccctggctacagcgggtatcactacggatggttcgatacctggggccaggggacactcgtgaccgtttcttcc

SEQ ID NO: 43208 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacagcgatgctatttactccccctcttttcagggacaagtcacaatcagcgccgacaactccattagcacggcgtatcttcagtggtcttccctgaaagctagcgataccgccatctactattgtgcctctggccctggctactccgggtatcactacggatggttcgacacatggggccaggggaccctcgtgacagttagctct

SEQ ID NO: 43209 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacacagatacgatttacagcccctcctttcagggacaagtcaccatctctgctgacaacagcatttccacagcctatcttcagtggagctctctgaaagcgtccgataccgctatctactattgtgccagcggccctggctactctgggtatcactacggatggttcgacacatggggccaggggaccctcgtgacagtttccagc

SEQ ID NO: 43210 - RNA, 369 nt, synthetic construct
  misc_feature 1..369: note = derived and/or modified sequence opt5 from anti-influenza_Chain
  source 1..369: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggagagcgacacaatttactccccctcttttcagggacaagtcacgatcagcgctgataactccattagcaccgcctatcttcagtggtcttccctgaaagcgagcgacacagctatctactattgtgcctctggccctggctactccgggtatcactacggatggttcgatacctggggccaggggacactcgtgaccgttagctct

SEQ ID NO: 43211 - RNA, 372 nt, synthetic construct
  misc_feature 1..372: note = derived and/or modified sequence opt5 from anti-influenza_Chain
  source 1..372: mol_type = other RNA
caggtgcaactggtccagagcggcgccgaggttaagaaacccgggtcctctgtgaaggtgagctgcaaggcttccggaggcatcttcatttctcaggccatcagctgggtcagacaggcgcctgggcaaggactcgaatggatgggcgggattatcccgatgtttggagctaccaactacgcccagaaattccagggccgggtgacaattacggccgacaaatccaccaatacagtttatatggagctgtctagccttacctccgaagatacagctgtgtactattgtgcccgcctgggcagcgggtcttaccacaacggacccaattggtttgacccttggggccaggggaccctcgtcacagtgtccagc

SEQ ID NO: 43212 - RNA, 372 nt, synthetic construct
  misc_feature 1..372: note = derived and/or modified sequence opt5 from anti-influenza_Chain
  source 1..372: mol_type = other RNA
caggtgcaactgcaggagagcggccccgggctcgtcaagccttccgaaaccctgtctcttaactgcgccgttagcggaggctccatctctaattactattggagctggattagacagccgcccgggaaaggactggagtggatcggctacatttcctataacgggcggcctaagtacaatccctctctcacaagccgcgtgacgatctccgtggacaccagcaaagatcagttctctctggaacttagatccgtcacagctgccgacaccgcgctgtattactgtgctcgggagacacgctttggagaactcctgagcccttatgatgccttcgagatttggggccaaggcaccatggtgacagtttcttcc

SEQ ID NO: 43213 - RNA, 372 nt, synthetic construct
  misc_feature 1..372: note = derived and/or modified sequence opt5 from anti-influenza_Chain
  source 1..372: mol_type = other RNA
caggtgcaactgcaggagagcggccccgggctcgtcaagccttccgaaaccctgtctcttacatgcacggttagcggaggctccgtgtctagcgagacctactattggtcctggatcagacagccgcccgggaaaggactggaatggattggctacatctattacattgggaacacagactatcggccttctctcaagagccgcgtgaccatctccctggatacaagcaaaaatcagttctctcttaagctgtccagcgtcaccgccgctgacacagccgtgtactattgtgcgagaggagcttactacgattcttccggctatcccgccttttacatttggggccaagggaccatggttacggtgagctct

SEQ ID NO: 43214 - RNA, 372 nt, synthetic construct
  misc_feature 1..372: note = derived and/or modified sequence opt5 from anti-influenza_Chain
  source 1..372: mol_type = other RNA
caggtgcaactgcaggagagcggccccgggctcgtcaagccttccgaaaccctgtctcttacatgcgccgttagcggagtgtccatctctaacattgacttctactggggctggatcagacagccgcccgggaaaggactggagtggattggcaatatctattacacggggattaccttttataaccctagcctctcctctcgggtggctatcagcatcgatacatccaagaatcagttcagcctgacccttacatctgtcaccgccgcggacacagctatgtactattgtgcccgccactacggagattccgaagccattaacgacgcttttgatatctggggccaaggcaccatgctgacggtgagctct

SEQ ID NO: 43215 - RNA, 372 nt, synthetic construct
  misc_feature 1..372: note = derived and/or modified sequence opt5 from anti-influenza_Chain
  source 1..372: mol_type = other RNA
caggtgcaactggtcgagagcggcgccgaagttaagaaattcggggcttccgtgaaggtgtcttgcaaagccagcggatacaccctcatcgactattacatgcactgggtcagagtggcgcccggccaggggctggagtggatgggatggattaaccctatcaatggcgggacaaactatgctcagaagtttcagggacgggttacgatgacccgcgatacatccattaataccgcctacatggacctttctagcctgagatccgatgacacagccatgtattactgtacccggggccgcccgatcggcagaaactgggaaccccgggataaagactattgggggcaaggaacacctgtgaccgtctctagc

SEQ ID NO: 43216 - RNA, 372 nt, synthetic construct
  misc_feature 1..372: note = derived and/or modified sequence opt5 from anti-influenza_Chain
  source 1..372: mol_type = other RNA
caggtgcaactggtccagagcggcgccgaggttaagaaacccgggtcctctgtgaccgtgagctgcaagacatccggacacacgttcatctcttacgctattagctggctcagacaggcccctggccaggggctggaatggatgggaggcatcgtcccgatttttgggaccgtgaactatacacaaaaattccagggacggcttaccatcacagcggacgagtccacctctacagcttacatggatctgagccgcctcacctttgaagacacggccatttatttctgtgccagagaggctggctaccattccagcttttctggcgtttatttcgattactgggggcagggaaccctgcttacagtgtccagc

SEQ ID NO: 43217 - RNA, 372 nt, synthetic construct
  misc_feature 1..372: note = derived and/or modified sequence opt5 from anti-influenza_Chain
  source 1..372: mol_type = other RNA
gaggtgcagctgcaacagagcggccccgaactcgtcaagcctggggcctccgttaaaatctcttgcaaggctagcggatacaccttcacagactataacatgcactgggtgaaacagtccctgggcaagtctcttgagtggattgggtacatctatccgaataacggaggcacggggtacaatcagaaatttgaaagcaaggccaccctgacagtggataactcctctagcaccgcgtatatggagctcagaacactgacctccgaagacagcgctgtctactattgtgtgcggtctggagcctactacttcaattatcttgttccctactttgattattggggccaaggcacaaccctgacggtgtccagc

SEQ ID NO: 43218 - RNA, 372 nt, synthetic construct
  misc_feature 1..372: note = derived and/or modified sequence opt5 from anti-influenza_Chain
  source 1..372: mol_type = other RNA
gaggtgcagctgcaacagagcggccccgaactcgtcaagcctggggcctccgttaaaatctcttgcaaggctagcggatacaccttcacaggctataacatgcactgggtgaaacagtcccatgggaagtctctggagtggattggaaaaatctacccgaataacggcgtgacggggtataatcaggaatttagaagcaaggccacccttacagtcgacaactcctctagcaccgcgtacatggagctgcggtccctcacaagcgaagattctgctatttatttctgtgtgcgctccggagcctactatgttaattacctggtgccctactttgactattggggccaaggcaccacacttaccgtcagctct

SEQ ID NO: 43219 - RNA, 375 nt, synthetic construct
  misc_feature 1..375: note = derived and/or modified sequence opt5 from anti-influenza_Chain
  source 1..375: mol_type = other RNA
caggtgcaactggtccagagcggcgccgaggttaagaaacccgggtcctctgtgaaggtgagctgcaaggcttccggagtcacctctagcaactaccctatcacatgggtgagacaggccccgggccaggggctcgaatggatgggaggcgttctgccccttttcggggtgacgaattatgcgcaaaaatttcagggacgggtcaccatttccgctgacaaatctacaaacaccgcctacatggagctgagctccctccgcagcgaagatacagccgtgtattactgtgctagaggcaagcggcctggctattgctctgggggagtttgttccagcgactactggggccaggggaccctggtgacagtctcttcc

SEQ ID NO: 43220 - RNA, 375 nt, synthetic construct
  misc_feature 1..375: note = derived and/or modified sequence opt5 from anti-influenza_Chain
  source 1..375: mol_type = other RNA
caggtgcaactgcaggagagcggccccgggctcgtcaagccttcccagaccctgtctcttacatgcacggttagcggaggctccatctctagcgggacctactattggtcctggattagacaccatccgggaaaaggcctggaatggatcgggtacatttatcactctggaagcgcctactataacccctccctcgagagccgggtgacaatgtctgtggacacctccaagaatcagttcagcctgaaactttcttccgtcacagctgccgataccgcgatctactattgtgctcgcgccgaaaacctgctcagcccttacctggccgagggctttgacccctggggccaagggacactggtgaccgtttcttcc

SEQ ID NO: 43221 - RNA, 375 nt, synthetic construct
  misc_feature 1..375: note = derived and/or modified sequence opt5 from anti-influenza_Chain
  source 1..375: mol_type = other RNA
gaggtgcagctggtccaaagcggcgccgaagttaagaaacccggggagtccctcaagatctcttgccaggctagcggatactccttcacctctagatggattggctgggtgcggcagatgcctgggaaaggactggaatgggtgggctttatctatccgagcgactccgatgtccgctactctcccagcttcagaggacaggtgacaatttccgccgacaagagcatctctacggcgtatcttcaatggtccagcctgaaggcttctgataccgccatgtacttttgtgcccggctcgggggcaacaaagactatggcgattacctgtggtatttcgacctttgggggcgcggagctctggttacagtgtccagc

SEQ ID NO: 43222 - RNA, 375 nt, synthetic construct
  misc_feature 1..375: note = derived and/or modified sequence opt5 from anti-influenza_Chain
  source 1..375: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatctggtatgacggagataacaaatactatggcgacagcgttaagggcagattcacaatttcccgggataattctaaaaacacgctgtttctccagatgaatagcctgcgcgctgaggacaccgccgtgtactattgtgccaaggatacagctgaccatggggattacgtcgaccttggattctttgatgcctggggccaagggaccctggtgacagtttccagc

SEQ ID NO: 43223 - RNA, 375 nt, synthetic construct
  misc_feature 1..375: note = derived and/or modified sequence opt5 from anti-influenza_Chain
  source 1..375: mol_type = other RNA
gaggtgcagctggtccaaagcggcgccgaactcaagatgcccggggagtccctgaaaatctcttgcaaggctagcggatacaccttcacaaactattggattggctgggttagacagacgcctgggaaaggacttgaatggatgggcatcatttttccgcccgactcccagacctcttacagcccttccttccaggggcaagtgacattttctgtggataatagcatctccgtcgcctatattcagtggagctctctgaaggcgtccgacaccgctatctactattgtgcccggagcggaatcttcgattggtctgctcccctcgtggaggcctttgacatttggggccagggcacagttgtgaccgtctccagc

SEQ ID NO: 43224 - RNA, 375 nt, synthetic construct
  misc_feature 1..375: note = derived and/or modified sequence opt5 from anti-influenza_Chain
  source 1..375: mol_type = other RNA
gaggtgcagctggtccaaagcggcgccgaagttaagaaacccggggagtccctcaagatctcttgcaaaggaagcggctactccttctctgactattggattgggtgggtgagacagatgcctggagaaggcctggagtggatggggatcatttacccggctagctccgaaatccggtattctcccagctttcagggacttgtgaccatttccgccgataagagcatcaacacagcgtctctgcagtggtccagcctcaaagcctctgacacggctatctactattgtgcccgccacgcttcctgcagcgccagatcttgttactggggccctgtcgattattggggccaagggaccctggtgacagtttccagc

SEQ ID NO: 43225 - RNA, 375 nt, synthetic construct
  misc_feature 1..375: note = derived and/or modified sequence opt5 from anti-influenza_Chain
  source 1..375: mol_type = other RNA
caggtgcaactggtcgagagcggcgggggagttgtgcagcccggcagatccctccggctgtcttgcgccgctagcgaaatcaccttcattacatacgccatgcactgggtgcgccaggcgcctgggaagggacttgagtgggtcgctctgatctccgacgatggctctaacaaattttatgccgacagcgtgaaggggagattcacgatttcccgggataattctaaaaacaccctctacctgcagatgaatagccttcgcgccgaagacacagctgcctattactgtgctagagagggagtttattttgattccggcacctaccggggctatttcgactactgggggcaagaaacactggtgaccgtcagctct

SEQ ID NO: 43226 - RNA, 375 nt, synthetic construct
  misc_feature 1..375: note = derived and/or modified sequence opt5 from anti-influenza_Chain
  source 1..375: mol_type = other RNA
caggtgcaactgcaggagagcggccccgggctcgtcaagccttcccagaccctgtctcttacatgcacggttagcggaggctccatctctagcgggaactactattggaattgggtgagacagcacccgggaaaaggcctggaatggattgggtacatctattaccggggatccaccttctataacccctctctcaagagccgcgtgacaatttccatcgacaccagcaaaaatcaattttctctgagactttccagcgtcacagccgctgataccgccgtgtactattgtgcgaaggacacacggtcttccctggataactaccagtacggcatggacgtttggggccaggggaccacggtgaccgtcagctct

SEQ ID NO: 43227 - RNA, 375 nt, synthetic construct
  misc_feature 1..375: note = derived and/or modified sequence opt5 from anti-influenza_Chain
  source 1..375: mol_type = other RNA
gaggtgcagctgctcgaaagcggcgggggactggtccaacccggcgggtcccttagactgtcttgcgccgctagcggattctccttttctacctacgccatgagctgggttcggcaggcgcctggcaaggggctcgagtgggtgtccggaatctctggcagcggcgaatccacatattacgctgacagcgtgaaagggcgcttcacggtctctagagataactccaagaataccctgtatcttcagatgaacagcctgcgggccgaggacacagccgtgtactattgtgctaaacagggagatcacattgcctggctcctgcgcggcatcaattttgactactgggggcaaggagttctggtgaccgtctcttcc

SEQ ID NO: 43228 - RNA, 375 nt, synthetic construct
  misc_feature 1..375: note = derived and/or modified sequence opt5 from anti-influenza_Chain
  source 1..375: mol_type = other RNA
caggtgcaactggtcgagagcggcgggggagttgtgcagcccggcagatccctccggctgtcttgcgccgctagcgggttcgcctttcacaatcgcgcgatgcattgggtgagacaggctcctggaaagggccttgaatgggtcgccctgatctacttcgacgggtccaaacagtattacgccgattctgtgaagggacggtttaccattagccgcgacaattccaaaaacacagttttcctccaaatgaactctctgagaccggaggatacggctgtgtattactgtgccgtccccggccctatctttggcatttttcccccttggagctatttcgaccactgggggcagggaatccttgtgaccgtttccagc

SEQ ID NO: 43229 - RNA, 375 nt, synthetic construct
  misc_feature 1..375: note = derived and/or modified sequence opt5 from anti-influenza_Chain
  source 1..375: mol_type = other RNA
gaggtgcagctggtcgaaagcggcgggggagttgtgcaacccggcagatccctccggctgtcttgcgccgctagcgggttcgcctttcacaatcgcgcgatgcattgggtgagacaggctcctggaaagggccttgagtgggtcgccctgatctacttcgacgggtccaaacagtattacgccgattctgtgaagggacggtttaccattagccgcgacaattccaaaaacacagttttcctccagatgaactctctgagaccggaagatacggctgtgtattactgtgccgtccccggccctatctttggcatttttcccccttggagctatttcgaccactgggggcaaggaatccttgtgaccgtttccagc

SEQ ID NO: 43230 - RNA, 375 nt, synthetic construct
  misc_feature 1..375: note = derived and/or modified sequence opt5 from anti-influenza_Chain
  source 1..375: mol_type = other RNA
gaggtgcagctggtccaaagcggagggggagttgtgcagcccggcaagtccctcagactgtcttgcgccgctagcgggcttaccttctcctcttacgccgtgcactgggtccggcaggcgcctggaaaaggcctggaatgggtgacactcatcagctatgacggggctaaccagtactatgccgattccgttaagggacgctttacgatttctagagacaatagcaaaaacaccgtgtacctgcaaatgaactcccttcggccggaggatacagccgtctattactgtgctgtgcccggccctgttttcggcatctttcccccttggagctatttcgacaattgggggcagggcattctggtgaccgtctcttcc

SEQ ID NO: 43231 - RNA, 375 nt, synthetic construct
  misc_feature 1..375: note = derived and/or modified sequence opt5 from anti-influenza_Chain
  source 1..375: mol_type = other RNA
caggtgcaactggtcgagagcggagggggagttgtgcagcccggcaagtccctcagactgtcttgcgccgctagcgggcttaccttctcctcttacgccgtgcactgggtccggcaggcgcctggaaaaggcctggaatgggtgacactcatcagctatgacggggctaaccagtactatgccgattccgttaagggacgctttacgatttctagagacaatagcaaaaacaccgtgtacctgcaaatgaactcccttcggccggaggatacagccgtctattactgtgctgtgcccggccctgttttcggcatctttcccccttggagctatttcgacaattgggggcagggcattctggtgaccgtctcttcc

SEQ ID NO: 43232 - RNA, 375 nt, synthetic construct
  misc_feature 1..375: note = derived and/or modified sequence opt5 from anti-influenza_Chain
  source 1..375: mol_type = other RNA
caggtgcaactggtcgagagcggagggggagttgtgcagcccggcaagtcccctagactctcttgcgccgctagcgggccgaccttctcctcttacgccgtgcactgggtccggcaggcgcccggaaaaggcctggaatgggtgacacttatcagctatgacggggctaaccagtactatgccgattccgttaagggacgctttacgatttctagagacaatagcaaaaacaccgtgtacctgcaaatgaactccctccggcctgaggatacagccgtctattactgtgctgtgcccggccctgttttcggcatctttcccccttggagctatttcgacaattgggggcagggcattctggtgaccgtctcttcc

SEQ ID NO: 43233 - RNA, 375 nt, synthetic construct
  misc_feature 1..375: note = derived and/or modified sequence opt5 from anti-influenza_Chain
  source 1..375: mol_type = other RNA
gaggtgcagctggtcgaaagcggagggggagttgtgcaacccggcaagtccctcagactgtcttgcgccgctagcgggcttaccttctcctcttacgccgtgcactgggtccggcaggcgcctggaaaaggcctggagtgggtgacactcatcagctatgacggggctaaccagtactatgccgattccgttaagggacgctttacgatttctagagacaatagcaaaaacaccgtgtacctgcagatgaactcccttcggccggaagatacagccgtctattactgtgctgtgcccggccctgttttcggcatctttcccccttggagctatttcgacaattgggggcaaggcattctggtgaccgtctcttcc

SEQ ID NO: 43234 - RNA, 375 nt, synthetic construct
  misc_feature 1..375: note = derived and/or modified sequence opt5 from anti-influenza_Chain
  source 1..375: mol_type = other RNA
caggtgcaactggtccagagcggcgccgagctcaagagacccggggcttccgttaaagtgtcttgcaagaccagcggatactccttcaacaattatggcatcaactgggtgcggcaggcccctgggcagggactggaatggatgggctggatttctgcgtacacagggaatacgcactatgctaaaaactttgagggacgcgtcacccttacaaccgacacaagcacctccacagcctacatggaagtgagatctctgcggagcgatgactccgccgtttatttctgtgctcgcgccatgatccaaggcgtggtcaccctctacctgagaccgggcgattattgggggcagggaacgcttgtgaccgttagctct

SEQ ID NO: 43235 - RNA, 375 nt, synthetic construct
  misc_feature 1..375: note = derived and/or modified sequence opt5 from anti-influenza_Chain
  source 1..375: mol_type = other RNA
caggtgcaactggtccagagcggcgccgaggttaagcagcccggggcttccgtgaaagtgtcttgcaaggccagcggatacaccttcaacgcgtattacatccactgggtcagacaggctcctggccaagggctcgaatggatgggatggattaatccgaactttggcgggacacattatgcccggaaattccagggacgcgtgacgatgaccagagacgcctccatcaatacagcttacatggagctggatcggcttatttctgacgataccgccgtttattactgtgtgcgctggagagctgccgcggtcatcatggaccagttttataagatggatgtgtggggccagggcacactggttaccgtgagctcc

SEQ ID NO: 43236 - RNA, 375 nt, synthetic construct
  misc_feature 1..375: note = derived and/or modified sequence opt5 from anti-influenza_Chain
  source 1..375: mol_type = other RNA
caggtgcaactggtccagagcggccccgagctcaagaaacctgggtcctctgttaagctgagctgcatggccaccggaggcacattcatcaactacgctttttcctgggtgagacaggccccggggcagggacttgaatggctgggcgggattatccccgtgtatggaacgtctaatcacgtcgagaaactccaaggccgggtgaccattacagcggacgctagcaccaacacagcctacatggaactgtccggccttcgcttcgatgacaccgccgtttatttttgtgctgcctctacagctaccagcgggacgtactatgccatgagacctttcgatttttggggacagggcaccctggtgtccgtcagctct

SEQ ID NO: 43237 - RNA, 378 nt, synthetic construct
  misc_feature 1..378: note = derived and/or modified sequence opt5 from anti-influenza_Chain
  source 1..378: mol_type = other RNA
gaggtgcagctggtcgaaagcggcgggggagttgtgcaacccggcgggtccctcagactgtcttgcatcgccagcgctttcaaccttggaatttttggcatgcactgggtgcggcaggcccctgggaagggactggagtgggtcgcgttcatccgctacgacggcggcaaaaccttttatgctgattccgtgaaggggagattcacaatttctcgggacaatagcaaaaacacgctctacctgcagatgaactcccttcgcaccgaagatacagccctgtattactgtgccagagacgctaccgccgattattacggaccgggctcttatcccaattggctcgacccttgggggcagggaacactggttaccgtgagc

SEQ ID NO: 43238 - RNA, 378 nt, synthetic construct
  misc_feature 1..378: note = derived and/or modified sequence opt5 from anti-influenza_Chain
  source 1..378: mol_type = other RNA
gaggtgcagctggtcgaaagcggccccgccctcgttaagcctacccaaacactgacgcttacctgctccttctctgggtttagcctgtccacatctggaatgagcgtgtcctggatcagacagccgcccggcaaagctctcgagtggctggcccttattgactgggatgacgatacctactatatcacatactctagctccctgaagacccggctcacaattagcaaagacacctctaagtcccaggtggtcctgacgatgaccaacatggatcctgtggacacagcgacctattactgtgctcgcacactgagagttagcggggattatgtgcgggacttcgatctctggggacgcggcaccctggtcacggtgtct

SEQ ID NO: 43239 - RNA, 378 nt, synthetic construct
  misc_feature 1..378: note = derived and/or modified sequence opt5 from anti-influenza_Chain
  source 1..378: mol_type = other RNA
caggtgcaactgcaggagagcggccccgggctcgtcaagccttccgaaaccctgtctcttacatgcacggttagcggaggctccatcaactcttactattggaattggattagacagccgcccgggaaaggactggagtggatcggctacatttatcacagcgggtccaccaactacaatccttctctcaagagccgggtgacaatctccgtggacaccagcaaaaaccagttctctctgcaactttccagcgtcacagccgctgataccgccgtgtattactgtgcgcgcctgagaacagactatggagatcccgactctgtttactactatggcatggatgtgtggggccaggggaccacggtcaccgtgtccagc

SEQ ID NO: 43240 - RNA, 378 nt, synthetic construct
  misc_feature 1..378: note = derived and/or modified sequence opt5 from anti-influenza_Chain
  source 1..378: mol_type = other RNA
caggtgcacctggtccaaagcggcgccgaggttagaaagcccggggactccgtgaaagtgtcttgcaagaccagcggatacacattctccacgtatcctgtcgcttgggtgcggcaggttccgggccaggggctcgaatggatgggatggatctctacctacaacggcaatacaaactttgcccagaatttccaagggcgcgtgaccctgacaaccgatacaaccacgaacaccgcgtatatggaggtcagaagccttaaatttgacgatacagctgtgtactattgtgcccgggttgaaggatcctaccgcgacttctggaataaccagaatagatttgatccctggggccagggcaccctggtgacagtctctagc

SEQ ID NO: 43241 - RNA, 378 nt, synthetic construct
  misc_feature 1..378: note = derived and/or modified sequence opt5 from anti-influenza_Chain
  source 1..378: mol_type = other RNA
gaggtgcagctggtcgaaagcggcgccgaggttaagaaacccggggcttccgtgaaggtgtcttgcaaagccagcggatacaccttcacatcctttgacatcaactgggtcagacaagcgcctggccaggggctcgaatggatgggatggatgacgccgacctctggcaagacagggtatgctcagaaattccagggacggattaccatgacacgcaataccagcatcaacacagcctacatggagctgtcctctcttagaagcgaagataccgccgtgtatttttgtgctcggggccccgagcgcagaacgaccattttcgacgttatcctggattggtttgacccttggggccaagggacactcgtgaccgtctcc

SEQ ID NO: 43242 - RNA, 378 nt, synthetic construct
  misc_feature 1..378: note = derived and/or modified sequence opt5 from anti-influenza_Chain
  source 1..378: mol_type = other RNA
caggtgcaactggtccagagcggcgccgaggttaagaaacccgggtcctctgtgaaggtgagctgcaaagcctccggaggcttcttttctagctacgctatctcctgggtcagacaggcgcctgggcagggactcgaatggatgggcggggtgattccgatcttccggaccgctaactatgcccaaaattttcagggacgcgttacaattacggccgacgagttcacctcttacatggaactgagctcccttagaagcgatgacacagctgtgtattactgtgcccggctgaactatcacgattctggcacctactataatgctccccgcggctggtttgacccttgggggcagggaacactcgtcaccgtgtccagc

SEQ ID NO: 43243 - RNA, 378 nt, synthetic construct
  misc_feature 1..378: note = derived and/or modified sequence opt5 from anti-influenza_Chain
  source 1..378: mol_type = other RNA
caggtgcaactggtccagagcggcgccgaggttaagaaacccgggtcctctgtgaaggtgagctgcaaggcttccggaggcgccttctctaactacgcgatcagctgggtcagacaggctcctgggcagggactcgaatggatgggcgggattatcccgatttttggaaccacaaattatgcccaaaaattccagggccgggtgacgatcaccgccgacaaatttacaaccattgcttacatggagctgcgctcccttagatctgaagatacagccgtttattactgtgctcggcacggcggggtgtattactatggaagcgcctccagcggctggttcgacccctgggggcagggaaccctggtcacagtgtcttcc

SEQ ID NO: 43244 - RNA, 378 nt, synthetic construct
  misc_feature 1..378: note = derived and/or modified sequence opt5 from anti-influenza_Chain
  source 1..378: mol_type = other RNA
caggtgcaactgctcgagagcggcgggggagtcgttagacccggccggtccctgcgccttgcctgcgctgggtctggattcacctttagcgcctacgcgatgcactgggtgagacaggctcctggcaaggggctggaatgggtggcccatacatcctatgacggacgggattcttactatgtcgacagcgtgaaaggccgcttcacgatctccagagatgactctaagaacaccctctacctgcagatgaatagccttcggccggaggatacagccgtttattactgtgctaaagtgggcccctataccgggtacgacgattacaactattacggaatggacgtctggggccacgggacaaccgtgacagtttccagc

SEQ ID NO: 43245 - RNA, 378 nt, synthetic construct
  misc_feature 1..378: note = derived and/or modified sequence opt5 from anti-influenza_Chain
  source 1..378: mol_type = other RNA
caggtgcaactggtcgagagcggcgggggagttgtgcagcccggcgggtccctcagactgtcttgcgccgctagcggattcaactttgacgaatacgtgatgtattgggtccggcagtcccctggcaaggggcttgagtgggtgtctctgatcggagccgatggccgcggcacctacaatagcgactccgttaaagggagattcacaatttctcgggataaccgcaagaatagcctctatctgcagatgaactcccttagaagcgacgatacggcgctgtactattgtgctaaagtggaacggtctttttacgacggatccggctatggggatgccctcgagatctggggacaaggcaccatggtcacagtgagctct

SEQ ID NO: 43246 - RNA, 381 nt, synthetic construct
  misc_feature 1..381: note = derived and/or modified sequence opt5 from anti-influenza_Chain
  source 1..381: mol_type = other RNA
gaggtgcagctgctcgaaagcggcgggggactggtccaccccggcgggtcccttagactgtcttgcgccgctagcggattcaccttttccaactacgccatgtcttgggttcggcaagcgcctggcaaggggctcgagtgggtgagctccatcaattctggaggcggcgctacatattacgccgacagcgtgaaagggcgcttcacgatttccagagataacagcaagaataccctgtctcttcagatgaactccctgcgggccgaagacacagctgtctattactgtgccaaagagggaggcaataccatctttgggctcgtgacaatggcttattacttcgatagctggggacagggcaccctggttacagtgtcttcc

SEQ ID NO: 43247 - RNA, 381 nt, synthetic construct
  misc_feature 1..381: note = derived and/or modified sequence opt5 from anti-influenza_Chain
  source 1..381: mol_type = other RNA
cagccccaactgcaggagagcggccctgggctcgtgagaccgtccgaaaccctgtctcttacatgcacggtcagcggagactccgttacccggggcgggttctactggggatggatccgccagccccctggcaaggggctggagtggattggatctatctattacaactataatatttaccacagcccctccctcaaatctagagtgagcctgtccgtggatacaagcaagaaccaggtctctcttaaactggcctccgtgaccgctgccgacacagcggtttattactgtgctcggcattatccttactacgatctccccaccggcttttatagccaattcgacttttggggccaggggacacctgtgaccgtctcttcc

SEQ ID NO: 43248 - RNA, 381 nt, synthetic construct
  misc_feature 1..381: note = derived and/or modified sequence opt5 from anti-influenza_Chain
  source 1..381: mol_type = other RNA
tggtggcagctggtgcaaagcggcgccgaggtcaagaaacccgggtcctctgttaaggtgagctgcaaggcttccggaggcaccttctctagctacgacatctcctgggtgagacaggcccctgggcagggactcgaatggatgggcgggattatcccgatttatggaacagcgaactacgctcagaaatttcaaggccgggtcacgatcaccgccgatgagtctacaagcaccgcctatatggaactgtccagccttcgctctgaggacacagctgtgtactattgtgccagagctggcggggattccagcggatactatggcgccctggggcggttctttcagcactggggacagggcaccctcgttacagtgtcttcc

SEQ ID NO: 43249 - RNA, 381 nt, synthetic construct
  misc_feature 1..381: note = derived and/or modified sequence opt5 from anti-influenza_Chain
  source 1..381: mol_type = other RNA
gaggtgcagctggtccaaagcggcggggccgttgtgcagcccggaagatccctccggctgtcttgcgctgccagcggcttcaccttttccatctacgcgatgcactgggtgcgccagacacctgggaagggacttgaatgggtcgctctgatttcttatgacggcaacaataaatactatgccgatagcgtgaaggggagattcacgatctcccgggacaactacaaaaataccctctatctgcagatgaagggacttcgcgccgaggatacagctctgtactattgtgccagacggattaccgaaaaaggctactacaacgactctggccgcccgaattggtttgatccctgggggcaaggaacactcgttaccgtgagc

SEQ ID NO: 43250 - RNA, 381 nt, synthetic construct
  misc_feature 1..381: note = derived and/or modified sequence opt5 from anti-influenza_Chain
  source 1..381: mol_type = other RNA
caggtgcaactgcagcagagcggccccagactcgtcaagccttcccagaccctgtctcttacatgcgccatcagcggggactccgtttctggagatagcggcacgtggaactggattcggcaatccccgtctcgcgggctggagtggctcggaagaacctactatcggagcaaatggtacaatgactatgctgaatccgtcaagagccgcatcgtgattaaagccgatacatctaagaacgagttctccctgcagcttaatagcgtgacccccgaagacacagcgatctactattgtgctagagccggcgtgaaaatttttgggctgatcgttggagccctcgataactggggccggggcaccctggtgacagtctcttcc

SEQ ID NO: 43251 - RNA, 381 nt, synthetic construct
  misc_feature 1..381: note = derived and/or modified sequence opt5 from anti-influenza_Chain
  source 1..381: mol_type = other RNA
caggtgcaactgcagcagtggggcgccgggctcctgaagcccagcgagaccctttccctgacatgcacggtctctggaggcagcctcaccgactactcctggaactggatcagacagcctccggggaaaggactggaatggattggcgatacacttcacaatgggtataccaactacaatccctctctgcggggacgcgttagcatctccattgacacatctaagaaccaagtgagcctcagactgacctccgtgacagctgccgataccgcgctgtattactgtgctcggggcagcggcgggtatggaggcttcgactactttgggaaactccgcacgtgggatttctggggacagggcaccctggtcacagtgtcttcc

SEQ ID NO: 43252 - RNA, 381 nt, synthetic construct
  misc_feature 1..381: note = derived and/or modified sequence opt5 from anti-influenza_Chain
  source 1..381: mol_type = other RNA
caggtgcaactggtccagagcggcgccgaggttagaaagcccggggaatccctccggatctcttgccgcggaagcggctacaacttccctaaatattggattgggtgggtgagacagatgccgggaaagggcctggagtggatggggatgatctaccccggagactccgatgtgcggtataatccttcttttcagggccaagtcaccattagcgctgacgaatccatcaacacagcctaccttcagtggtctagcctgcgcacgtccgataccgcgagatattactgtgctcggcacctcggccagcagctggtgagcaatacatattactactatgggatggacgtttggggacaaggcaccacagtgaccgtctcttcc

SEQ ID NO: 43253 - RNA, 384 nt, synthetic construct
  misc_feature 1..384: note = derived and/or modified sequence opt5 from anti-influenza_Chain
  source 1..384: mol_type = other RNA
cagatccaactgcaggagagcggccccgggctcgtgaagccttcccagaccctgtctcttacatgcgccattagcggagactccgtctctagcaacaatgctgtttggaactggatcagacagtccccgtctcggggcctggaatggctcgggcgcacgtactatagaagcaaatggtacaatgattatgccgagtccgtcaagagccggattaccgtgaaccccgacacatctaaaaatcaattctccctgcaccttaagagcgtgacccctgaagatacagcggtgttttactgtgttcgctctggacatatcaccgtgttcggcgtcaacgtggacgcttttgatatgtgggggcagggaacaatggttaccgtgtccagc

SEQ ID NO: 43254 - RNA, 384 nt, synthetic construct
  misc_feature 1..384: note = derived and/or modified sequence opt5 from anti-influenza_Chain
  source 1..384: mol_type = other RNA
caggtgcaactgcaggagagcggccccgggctcgtcaagccttcccagaccctgtctcttacatgcgccatcagcggagactccgtttctagcaacaatgctgtgtggaactggattagacagtccccgtctcggggcctggaatggctcgggcgcacgtactatagaagcaaatggtacaatgattatgccgagtccgttaagagccggatcaccgtcaaccccgacacatctaaaaatcaattctccctgcaccttaagagcgtgacccctgaagatacagcggtgttttactgtgtgcgctctggacatattaccgtcttcggcgtgaacgttgacgcttttgatatgtgggggcagggaacaatggtgaccgtctccagc

SEQ ID NO: 43255 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagacagagtttcctctaacagcgctgtgtggaattggattcggcaatccccgtctcgcggcctggagtggctcgggagaacgtactatcggagcaaatggtactatgattacgccgaatccgtcaagagccgcatcgtgattgaccccgatacctctaaaaaccaggtgtccctgcagcttaatagcgttacacctgaggactctgcgatctattactgtgctagaggaggccacattaccgtgttcgggctgaacatcgatgcctatgacatctggggacagggcgccaaggtcacagtgtccagc

SEQ ID NO: 43256 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagacagagtttcctctaacagcgctgtgtggaattggattcggcaatccccgtctcgcggcctggagtggctcgggagaacgtactatcggagcaaatggtactatgattacgccgaatccgtcaagagccgcatcgtgattgaccccgatacctctaaaaaccaggtgtccctgcagcttaatagcgttacacctgaggactctgcgatctattactgtgctagaggaggccacattaccgtgttcgggctgaacatcgatgcctatgacatctggggacagggcgccatggtcacagtgtccagc

SEQ ID NO: 43257 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagacagagtttcctctaacagcgctgtgtggaattggattcggcaatccccgtctcgcggcctggaatggctcgggagaacgtactatcggagcaaatggtactatgattacgccgaatccgtcaagagccgcatcgtgattgaccccgatacctctaaaaaccaggtgtccctgcagcttaatagcgttacacctgaggactctgcgatctattactgtgctagaggaggccacattaccgagttcgggctgaacatcgatgcctatgacatctggggacagggcgccatggtgacagtctccagc

SEQ ID NO: 43258 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgttatcagcggagacacggtgtcctctaacagagccacctggaattggatgcggcaaagcccgctgcgcggcctcgagtggctggggagaacatactatcggtccaaatggtacaacgattatgctgtgtctgtcaagagccgcgtggttattaatcccgacacctccaaaaaccaggtgagccttcagctgaatacagtcacccctgatgactctggagtgtacttctgtgccagaggcgggcacatcacagtttttggagtgaacattgatgcgttcgacatctggggcctcggcaccaaggtcacggtgtccagc

SEQ ID NO: 43259 - RNA, 384 nt, synthetic construct
  misc_feature 1..384: note = derived and/or modified sequence opt5 from anti-influenza_Chain
  source 1..384: mol_type = other RNA
caggtggagctgcaacagagcggccccgggctcgtcaagccttcccagaccctgtctcttacatgcgccatcagcggagactccgtttctagcaactccgctacgtggaattggattagacagtctccgagccggggcctggaatggctcgggcgcacctactatagatccaaatggtacaacgattatgccgacttcctgaagcggcgcatcacaattaatcccgataccagcaacaatgaggtgtctcttagactgacatccgtgacccctgacgatacagcgctctactattgtgctcggggaggccacatcaccgtctttggggtgaacattgacgccttcgatgtttggggacaaggcacgatggccaccgtgagctct

SEQ ID NO: 43260 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagactccgtttctagcaactccgctacgtggaattggattagacaatctccgagccggggcctggagtggctcgggcgcacctactatagatccaaatggtacaacgattatgccgacttcctgaagcggcgcatcacaattaatcccgataccagcaacaatgaagtgtctcttagactgacatccgtgacccctgacgatacagcgctctactattgtgctcggggaggccacatcaccgtctttggggtgaacattgacgccttcgatgtttggggacagggcacgatggtgaccgtcagctct

SEQ ID NO: 43261 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagactccgtttctagctacaacgctgtgtggaattggattagacaatccccgtctcggggcctggagtggctcgggcgcacgtattacagaagcggatggtataacgattacgccgaatccgtgaaaagccggatcaccattaatcccgacacatctaagaaccagttctccctgcagcttaatagcgtcacccctgaggatacagcggtgtattactgtgctcgctctggccacatcaccgtttttggggtgaacgtcgacgccttcgatatgtggggacagggcacaatggtgaccgtttccagc

SEQ ID NO: 43262 - RNA, 384 nt, synthetic construct
  misc_feature 1..384: note = derived and/or modified sequence opt5 from anti-influenza_Chain
  source 1..384: mol_type = other RNA
caggtgcaactgcagcagagcggccccgggctcgtcaagccttcccagaccctgtctcttacatgcgccatcagcggagactccgtttctagcaacaatgctgtgtggaactggattagacaatccccgtctcggggcctggagtggctcgggcgcacgtactatagaagcaaatggtacaatgattatgccgaatccgtcaagagccggatcaccattaaccccgacacatctaaaaatcagttctccctgcagcttaacagcgtgacccctgaggatacagcggtgtactattgtgctcgctctggacacatcaccgtttttggcgtgaatgtcgacgccttcgatatgtgggggcagggaacaaccgtgacggtttccagc

SEQ ID NO: 43263 - RNA, 384 nt, synthetic construct
  misc_feature 1..384: note = derived and/or modified sequence opt5 from anti-influenza_Chain
  source 1..384: mol_type = other RNA
agaggccagctggtgcaaagcgggggaggcgtcgttcagcccgggcggtccctccgcctgtcttgcgccgctagcggattcgtgtttaacgtgttcggcatccactgggtcagacaggcccctgggaagggacttgagtggctggcgaccatttcctacgacggcctcaataaatattacgctgattctgtgaagggccggatcacaattagccgcgacaactccaaaaatacgctgtatcttcagatgaactctctgagagccgaagataccgccgtttactattgtgtgcgggacagcgaggaatccacatactatggggattacatgtgggtctacaattggtttgacctctggggacaaggcaccctggtgacagttagc

SEQ ID NO: 43264 - RNA, 384 nt, synthetic construct
  misc_feature 1..384: note = derived and/or modified sequence opt5 from anti-influenza_Chain
  source 1..384: mol_type = other RNA
caggtgcaactgcagcagtggggcagcgggctcctgaagccctccgagaccctttctctgacatgcgccgtctacggaggcagcttcagagacgattattggacgtggatccggcagcctccggggaaaggactcgaatggattggcgagatcaaccactccgggcgcaccaattacaacccctctcttaagagcagagttacaatttccgtggacacctctctgaaacaatttagcctgaaggtgatctccgtcacagctgccgataccgcggtgtattactgtgctcggggaacaagccatgtttctcgctatttcgactggctccctcccaccaattggtttgatccttggggccagggcacccaggtgacggtctccagc

SEQ ID NO: 43265 - RNA, 384 nt, synthetic construct
  misc_feature 1..384: note = derived and/or modified sequence opt5 from anti-influenza_Chain
  source 1..384: mol_type = other RNA
caggtgcaactgcagcagtggggcgccgggctcctgaagcccagcgagaccctttccctgtcttgcgctgtcttcggaggcagcttttccgactactattggacatggatcagacagcctccggggaaaggactcgaatggattggcgagatcaagcactctgggcggacgaactacaatcccagcctggaatcccgcgttaccatttctgtggatacaagcaaaaaccaattctcccttaagctgagctctgtgaccgccgcggacacagctatctattactgtgccagaggaaccgatcctgacacagagggctattgccggtccggcagctgttctgcctttgatttctgggggcagggaaccctcgtcacggtgtccagc

SEQ ID NO: 43266 - RNA, 384 nt, synthetic construct
  misc_feature 1..384: note = derived and/or modified sequence opt5 from anti-influenza_Chain
  source 1..384: mol_type = other RNA
caggtgcaactgcagcagtggggcgccgggctcctgaagcccagcgagaccctttccctgacatgcggagtctacggcgggtctctcagcgactattactggtcctggatcagacagcctccgggaaaaggcctggaatggattggggagatcaaccactctggaggcacgaattataaccccagccttaagcggcgcgttaccatttccgtggatacatctaaaaagcaattcagcctgaaaatgaactccgtgaccgctgccgacacagcggtctactattgtgctagaggcaccgatcctgacacagaagtgtactgccgggccgggaattgtgccgcttttgatttctggggacagggcaccctcgttacggtgagctct

SEQ ID NO: 43267 - RNA, 384 nt, synthetic construct
  misc_feature 1..384: note = derived and/or modified sequence opt5 from anti-influenza_Chain
  source 1..384: mol_type = other RNA
caggtgcaactgcaggagagcggccccgggctcgtcaagccttcccagaccctgtctcttacatgcacggttagcggagactccatctctagcgtggatcactactggtcctggattagacagcatccggtgaaaggcctggaatggatcgggttcatgtattactctgccagcacctattacaacccctccctcaagagccgggtcacaatttctaccgacacatccaaaaatcaatttagcctgcgcctttcttccgtgaccgctgccgatacagcggtttattactgtgctagaggaacctgcgccggcgactgtagcctgcactattactactatgggctcgatgtgtggggacagggccggacggtcaccgtgtcttcc

SEQ ID NO: 43268 - RNA, 384 nt, synthetic construct
  misc_feature 1..384: note = derived and/or modified sequence opt5 from anti-influenza_Chain
  source 1..384: mol_type = other RNA
gaggtggccctggtcgaaagcggcgctgaggttaagaaacccgggtcctctgtgaaggtgagctgcaaagcctccggacacatcttctctggctacgcgattagctgggtcagacaggctcctgggcaaggactcgaatggatgggcgggatcattccgatctttggaaccacaaactatgcccagaagttccagggccgggtgacgattaccgccgaccagtccacatctaccgcttacatggatctgagcaatcttcgctccgaggacacagccgtttattactgtgctagagtgaaagatggctattgcaccctgacaagctgtcccgtcgggtggtactttgacctctggggacggggcaccctggtgacggtttcttcc

SEQ ID NO: 43269 - RNA, 384 nt, synthetic construct
  misc_feature 1..384: note = derived and/or modified sequence opt5 from anti-influenza_Chain
  source 1..384: mol_type = other RNA
gaggtgcagctggtcgaaagcggcgccgaggttaagaaacccgggtcctctgtgaaggtgagctgcaaggcttccggacacatcttctctggctacgccattagctgggtcagacaagcgcctgggcagggactcgaatggatgggcgggatcattccgatctttggaaccacaaactatgctcagaaattccagggccgggtgacgattaccgccgaccaatccacatctaccgcctacatggatctgagcaatcttcgctccgaggacacagctgtttattactgtgccagagtgaaagatggctattgcaccctgacaagctgtcccgtcgggtggtactttgacctctggggacggggcaccctggtgacggtttcttcc

SEQ ID NO: 43270 - RNA, 384 nt, synthetic construct
  misc_feature 1..384: note = derived and/or modified sequence opt5 from anti-influenza_Chain
  source 1..384: mol_type = other RNA
caggtgcaactggtccagagcggcgccgaggttagaaagcccggggcttccgtgaaagtgtcttgcaaggccagcggatacaccttcacacggcacggcatctcctgggtccgccaggcgcctgggcagggactcgaatggatgggctggatttctgcttatacgggggacaccgattacgcccaaaaatttcagggaagagtgacaatgaccacagacaccagcacaaacaccgcctatatggagctgcggtcccttcgctctgatgacgctgccgtttactattgtgctagactgcggctccagggcgaagtggtcgtgccgcccagccagtccaattggttcgatccttggggccaagggacgctggttaccgtgagctct

SEQ ID NO: 43271 - RNA, 384 nt, synthetic construct
  misc_feature 1..384: note = derived and/or modified sequence opt5 from anti-influenza_Chain
  source 1..384: mol_type = other RNA
caggtgcaactggtcgagagcggccccgggctcatgaagccttccgaaaccctgtctcttacatgcacggttagcggaggctccgtgtctaactactattggagctggatcagacagccgcccgggaaaggactggagtggattggctacgtgttctattccgggtctagcaattacaacccttccctcaataaccccagcctgaagtctcgggtcaccatctccattgacacaagcaataaccagttttctcttaaactgtccagcgtgaccgccgctgatacagccgtttattactgtgcgcgcggaagagtcaattctggctatgactggggccctaacttcgattcctgggggcagggagctctcgtgaccgtgagctcc

SEQ ID NO: 43272 - RNA, 384 nt, synthetic construct
  misc_feature 1..384: note = derived and/or modified sequence opt5 from anti-influenza_Chain
  source 1..384: mol_type = other RNA
caggtgcaactggtccagagcggcgccgaggttaagaaacccgggtcctctgtgaaggtgagctgcaaggcttccggaggcaccttctcttactatgccatcagctgggtcagacaggcgcctgggcagggactcgaatggatgggcgggattatcccgattgtgggaacagctcactacacgcaaaaatttcagggccgggttaccatcacagccgacgagtccacctctacagcctatatggaactgagctcccttcgcagcgaggataccgctgtgtacttctgtgccagagctgccgacgaatctgtcgagtccctgacaattaaagcgtttcggaccaactatcattggggccaggggacgctcgtgaccgttagctct

SEQ ID NO: 43273 - RNA, 387 nt, synthetic construct
  misc_feature 1..387: note = derived and/or modified sequence opt5 from anti-influenza_Chain
  source 1..387: mol_type = other RNA
gaggtgcagctggtcgaaagcggcgggggagccgttcaacccggcgagtccctcaagctgccttgcgctgcctctgggttcacctttagcaactacggaatgcactgggtgagacaggcgccgggcaaagggcttgaatgggtggctgtcatctcctatgacggatctaataagtactatgccgatagcgtgaaaggccggttcacaatttcccgcgacaactctaaggatacgctgtacctccagatgaatagcctgagagccgaggacaccgctctgttttattgtgccaaagaacggccccttcgcctcctgagatacttcgattggctgtccggcggggctaacgactattggggacagggcacactcgttaccgtgagctct

SEQ ID NO: 43274 - RNA, 387 nt, synthetic construct
  misc_feature 1..387: note = derived and/or modified sequence opt5 from anti-influenza_Chain
  source 1..387: mol_type = other RNA
gaggtgcagctggtcgaaagcggcgggggagccgttcaacccggcgagtccctcaagctgtcttgcgctgccagcgggttcaccttttccaactacggaatgcactgggtgagacaggcgcctggcaaagggcttgaatgggtggctgtcatctcttatgacggaagcaataagtactatgccgattccgtgaaaggccggttcacaatttctcgcgacaacagcaaggatacgctgtacctccagatgaactccctgagagccgaggacaccgctctgttttattgtgccaaagaacggccgcttcgcctcctgagatacttcgattggctgagcggcggggctaatgactattggggacagggcacactcgttaccgtgtcttcc

SEQ ID NO: 43275 - RNA, 387 nt, synthetic construct
  misc_feature 1..387: note = derived and/or modified sequence opt5 from anti-influenza_Chain
  source 1..387: mol_type = other RNA
caggtgcaactggtcgagagcggcgggggagttgtgcagcccggcagatccctccggctgtcttgcgccgtgagcgggttcaccttttcctcttacgctatgcactgggtccgccaggcccctggaaagggccttgaatgggtggcggttatcagctatgacgggtccaaccagtactatgctgattctgtgaaaggaagattcacaattagccgggacaattccaagaacacgctgtacctccaaatgaatagcctgcgcgccgaggataccgccctttattactgtgctaaagacccgagactgcggcatctcctgtattttcccttcacatctatgatctactttgattactggggccagggcaccctggtcacagtgtccagc

SEQ ID NO: 43276 - RNA, 387 nt, synthetic construct
  misc_feature 1..387: note = derived and/or modified sequence opt5 from anti-influenza_Chain
  source 1..387: mol_type = other RNA
caggtgcaactggtccagagcggcgggggagttgtgcagcccggcagatccctccggctgtcttgcgtggccagcgggttcaccttttccacatacgctatgcactgggtccgccaggcccctggaagaggccttgagtgggtggcggttatctcttatgacgctaactacaagtattacgccgatagcgtgaaagggcggttctccatttctcgcgacaatagccaaaacacgctgcatctcgaaatgaataccctgagaacagaggataccgccctttattactgtgctaaggactcccagctgcggagcctcctgtattttgaatggctgtctcagggatacttcgagccgtggggccagggcacactcgtcaccgtgacatcc

SEQ ID NO: 43277 - RNA, 387 nt, synthetic construct
  misc_feature 1..387: note = derived and/or modified sequence opt5 from anti-influenza_Chain
  source 1..387: mol_type = other RNA
caggtgcaactggtccagagcggcgggggagttgtgcagcccggcagatccctccggctgtcttgcgtggccagcgggttcaccttttccacatacgctatgcactgggtccgccaggcccctggaagaggccttgagtgggtggcggttatctcttatgacgggaactacaagtattacgctgatagcgtgaaaggacggttctccatttctcgcgacaatagcaactccacgctgcatctcgaaatgaataccctgagaacagaggataccgccctttattactgtgccaaggacagccaactgcggtctctcctgtattttgaatggctgtcccagggctacttcgatccgtggggccaggggacactcgtcaccgtgacaagc

SEQ ID NO: 43278 - RNA, 387 nt, synthetic construct
  misc_feature 1..387: note = derived and/or modified sequence opt5 from anti-influenza_Chain
  source 1..387: mol_type = other RNA
caggtgcaactggtccagagcggcgccgaggttaagaaacccgggtcctctgtgaccgtgagctgcaaggcttccggaggcacattctctaactacgggatcagctgggtcagacaggcccctggacagggcctcgactggatgggagggattatcccgctgtttggcacggcgaattatgctcaaaaattccagggccgggtgaccattacagccgatgaatccacctctagctccaacatggagcttagctctctgcgctccgaagacacagccgtttactattgtgctagagatgtgcacaattacgactttctcaccgggtatcccctgcatctttacggaatggatgtctggggccaggggacaaccgtgacggttagctct

SEQ ID NO: 43279 - RNA, 387 nt, synthetic construct
  misc_feature 1..387: note = derived and/or modified sequence opt5 from anti-influenza_Chain
  source 1..387: mol_type = other RNA
caggtgcaactgcaggagagcggccccgggctcgtcaagccttccgaaaccctgtctcttatctgcgccgttagcggagcttccatttctagctcctactggtcttggatcagacagccgcccggcaaagggctggagtggattggatatatctactatagcggcgtgacaaagtacaacccttccctcaaaagccgggtgacgctgtctgtcgacacctccaagaatcacttcagccttaaactgtcttatgtgacagccgcggataccgctgtttactattgtgcccgcaacctccccgacattgccgtggtcacagctgtgcaggatgccacccctgtttggtttgacccctgggggcctggaacactggtgtccgtcagctct

SEQ ID NO: 43280 - RNA, 387 nt, synthetic construct
  misc_feature 1..387: note = derived and/or modified sequence opt5 from anti-influenza_Chain
  source 1..387: mol_type = other RNA
gaggtgcagctggtcgaaagcggcgggggactcgttcaacccggcagatccctgcggctttcttgcgccgctagcgggttcaccttttccgacttctggatgtcttgggtgcgccaggcccctggaaagggcctggagtgggtggcgaacatcgatcaggacgggaatgaaagattttacgctgatagcgtcaaaggacggttcacaatttcccgcgacaacgccaagaatagcctctatctgcagatgacgagccttagagccgatgacaccgctgtgtactattgtgcccgggatggccgcgagggctacttttatgggtccggatctttctacaacctgaaaggcctcaattgggggcaaggaacactgctgaccgtttcttcc

SEQ ID NO: 43281 - RNA, 387 nt, synthetic construct
  misc_feature 1..387: note = derived and/or modified sequence opt5 from anti-influenza_Chain
  source 1..387: mol_type = other RNA
gaggtgctgatggtcgaaagcggcgggggactcgttcagcccggcgggtccgtgagactgtcttgcgtggccagcggattctccttttctagccactggatgacctgggtccggcaagctcctggcaaggggcttgagtgggtggccaatatcgaagacgatggaggcgacaaatactatgttgattccgtgaagggccgcttcattatctctagagacaatgcgaaaaacagcgtctacctgcagatgaactccctccgggctgaggatacagccgtgtatttttgtgcccgcgggagcggatcttccgacagaagcgattacgacccgcattattactattacctggatgtttggggcaagggggctacggtgaccgtctcttcc

SEQ ID NO: 43282 - RNA, 387 nt, synthetic construct
  misc_feature 1..387: note = derived and/or modified sequence opt5 from anti-influenza_Chain
  source 1..387: mol_type = other RNA
gaggtgcagctggtcgaaagcggcggggacctcgttcaacccggaagatccctgaaactttcttgcaccggcagcgggttcacatttggagattacggcgtgacgtgggtgcggcaggcccctgggaagggactggagtgggtcggcttcatccgcaccagaccgtggggcgggacagctgacaccgccgcgtccgtgaagggacggtttacaatttctcgcgatgacagcaaatccctcgcttatctgcagatgaactctcttaagaccgaagatacagccgtttactattgttgcagagacgctccccctaatgtggaggtcgccagcatgaccaactggtacttcgatctgtggggccgggggacgctcgtgaccgtttccagc

SEQ ID NO: 43283 - RNA, 387 nt, synthetic construct
  misc_feature 1..387: note = derived and/or modified sequence opt5 from anti-influenza_Chain
  source 1..387: mol_type = other RNA
gaggtgcagctggtccaaagcggctccgaagttaagaaacccggggagtctctcaagatcagctgcaaaggatccggctactctttcagcaactattggattgggtgggtgagacacatgcctggaaagggcctggaatggatggggatcatttacccgggagactccgatacccggtattctcccagctttcagggccaggtgacaatgtccgccgacaaatctagctccacggtctaccttcagtggagctctctgaaggcttccgataccgccatctattactgtgcgcgcagaggcgggcatagcttcggatatggctctgggggagacacacactccgagtttgatagctggggccaagggaccctcgtgacagtttcctct

SEQ ID NO: 43284 - RNA, 387 nt, synthetic construct
  misc_feature 1..387: note = derived and/or modified sequence opt5 from anti-influenza_Chain
  source 1..387: mol_type = other RNA
caggtgcaactgctcgagaccggcgggggactggtcaagcccggccagagccttaaactgtcctgcgccgcttctgggttcacatttacgagctacgccatgcactgggttagacagcctccgggaaagggcctcgaatgggtggcggtggtctcctatgacgggaactacaaatattacgctgattctgtgcagggacggttcaccatcagccgcgacaattccaagaacacactgtatcttcaaatgaactctctgagagccgaggataccgccgtttactattgtgctaaagacagccggctccgctccctgctgtactttgaatggctcagccagggctacttcaatccctggggccaggggacaaccctgacagtgtcttcc

SEQ ID NO: 43285 - RNA, 387 nt, synthetic construct
  misc_feature 1..387: note = derived and/or modified sequence opt5 from anti-influenza_Chain
  source 1..387: mol_type = other RNA
caggtgcaactggtcgagagcggcgccgaagttaagaaacccggggcttccgtgaagctctcttgcaccgccagcggatacaacttcgcggcttattacatccactgggtgagacaggcccctggccaggggctggagtggatgggatggtccaatccgaacacaggcggggccaattatgctcaggactttcaaggacgggtcacgatgaccgccgtgacatctaccagcacagcttacatggaactttcccgcctgacctctgatgacacagccctctatttctgtgcgagagttccccgggatcgcctgcttaccctgtactatgagagctccacgtacggctttgactactggggccaggggaccctcgtgacagtcagctct

SEQ ID NO: 43286 - RNA, 387 nt, synthetic construct
  misc_feature 1..387: note = derived and/or modified sequence opt5 from anti-influenza_Chain
  source 1..387: mol_type = other RNA
caggtgcaactggtcgagagcggcgggggactcgttcagcccggcgggtccctgagactttcttgcaccgtgagcggattcacatttaactcctacgccatgaattgggtgcggcaggctcctggcaaggggctggaatgggtctctggaatccgcggcagcggcgagaacacgtattacgccgaaaccgtgaaagggagattcacaatttcccgggacaattctaagaacaccctctatctggagatgaatagccttcgcgcggaagatacagctgtttactattgtgccagaaaatggggacggatgaccgtgtttggcgtcgccacagaccagctgtactatttcgattactgggggcaaggaaccctcgtgacggtttccagc

SEQ ID NO: 43287 - RNA, 387 nt, synthetic construct
  misc_feature 1..387: note = derived and/or modified sequence opt5 from anti-influenza_Chain
  source 1..387: mol_type = other RNA
caggtgcaactggtcgagagcggccccgggctcgttaagccttcccagaccctgtctcttacatgcacggtgagcggaggctccatctctaacgggggataccactggagctggattagacagcatccgggcaaggggctggaatggatcggaaatatttattaccggggctccaccttctatgacccctctctcaagagccgcgtgacaatctccgtcgataccagcaaatctcagttttccctgaaacttacaagcgtgaccgccgctgacacagccgtttactattgtgcgagaatgcctctggctaactacgatctcctgaccggcctgtatattggggccttcgacctctggggacaaggcacgatggtgaccgtctcttcc

SEQ ID NO: 43288 - RNA, 387 nt, synthetic construct
  misc_feature 1..387: note = derived and/or modified sequence opt5 from anti-influenza_Chain
  source 1..387: mol_type = other RNA
caggtgcaactggtcgagagcggcgccgaagttaagaaaccgggggcttccgtgagagtgtcttgcaagggaagcggctacaccttcacagcctatcacatgcattgggtccggcaggcgcctgggcagggatttgagtgggtgggctggatcaaccccaattccggggctacgtactatacctctacattcgaaggacgcgttaccatgacaagagacaccagcattacaaccgcctacatggagctctcctctctgcggagcgatgacacggccgtgtattactgtgctaccgatatcgtcgtggaacgcgacgcctcccttggcggctttaacagctatgggatggatgtttggggacagggcacaaccgtgacagtctcttcc

SEQ ID NO: 43289 - RNA, 390 nt, synthetic construct
  misc_feature 1..390: note = derived and/or modified sequence opt5 from anti-influenza_Chain
  source 1..390: mol_type = other RNA
caggtgcaactgcagcagtggggcgccgggctcctgaagcccagcgagaccctttccctgacatgcgctgtctacggaggctctttcagcgtttccgggtattactggtcttggatcagacagcctccgggacggggcctcgaatggattggggagatcagccacggaggctccacgaactataatccctctctgaaaagccgcgtgaccatttccgtggacacaaccaagaaccaatttagccttagactgtcttccgtcacagccgcggataccgctgtgtactattgtgcccggggcacagaccctgataccgaagtttactgccgcgtggggaattgtgccgctttcgactattggggacagggcagcctcgtcacggtgtcttcc

SEQ ID NO: 43290 - RNA, 390 nt, synthetic construct
  misc_feature 1..390: note = derived and/or modified sequence opt5 from anti-influenza_Chain
  source 1..390: mol_type = other RNA
caggtgcaactgctcgagagcggccccgggctggtcaagccttcccagacccttctgctcacatgcacggtttctggagccagcatctccaccggcgggaactactggtcttggattagacagcacccgggaaaagacctggaatggatcggctatattttctacagcgggacaaccaagtataatccctccgtggataacccttctcttaaaagccgggtgacaatgtccgtcgacaccagcgagaatcagttttctctgaagctctccagcgtgacagctgccgataccgcggtttacttctgtgctcgcggatctcccaactccggctatgactggggccctcattttgattactgggggcaaggaacgctggtgaccgtcagctct

SEQ ID NO: 43291 - RNA, 390 nt, synthetic construct
  misc_feature 1..390: note = derived and/or modified sequence opt5 from anti-influenza_Chain
  source 1..390: mol_type = other RNA
gaggtgcagctggtcgaaagcggcgggcacctcgttcaacccggaagatccctgcggctttcttgcgccgctagcggcttcacctttgaggactacgccatgaactgggtgcgccaggcgcctgggaagggactggaatgggtgtccgtcatctcttgggatagcggcagaattgggtatgctgactccgtgaaaggacggttcacaatctctcgcgataatgccaagaacagctcctacctccagatgaatagcctgagaccggaggacacggccctttattactgtgttcgggatatgctggcttattactctgacaactccggcaaaaagtataatgtgtacggcatggatgtctgggggcagggaaccacagtgaccgttagctct

SEQ ID NO: 43292 - RNA, 390 nt, synthetic construct
  misc_feature 1..390: note = derived and/or modified sequence opt5 from anti-influenza_Chain
  source 1..390: mol_type = other RNA
gaggtgcagctggtcgaaagcggcgggggactcgttcaacccggcagatccctgcggctttcttgcgccgtgagcgggttcatctttgaggactacgctattaactgggtgcgccaggcccctggaaagggcctggaatgggtctccatcatttcttgggatagcgggagaatcggatatgcggactccgtgcggggccgcttcaccatttctagagataatgctaaaaacagctcctttctccagatgaatagcctgcggccggaggacacagccgtttactattgtgtgaaggatatgcttgcctactattacgacggctctgggatccgctataacctgtacggaatggatgtctggggccaggggacgaccgtgacagtttccagc

SEQ ID NO: 43293 - RNA, 390 nt, synthetic construct
  misc_feature 1..390: note = derived and/or modified sequence opt5 from anti-influenza_Chain
  source 1..390: mol_type = other RNA
gaggtgcagctggtcgaaagcggcgggggactcgttcaacccggcagatccctgcggctttcttgcgccgtgagcgggttcatctttgaggactacgctattaactgggtgcgccaggcccctggaaagtgtctggaatgggtctccatcatttcttgggatagcggcagaatcgggtatgcggactccgtgcggggacgcttcaccatttctagagataatgctaaaaacagctcctttctccagatgaatagcctgcggccggaggacacagccgtttactattgcgtgaaggatatgcttgcctactattacgacggctctggcatccgctataacctgtacgggatggatgtctggggacagggcacgaccgtgacagtttccagc

SEQ ID NO: 43294 - RNA, 396 nt, synthetic construct
  misc_feature 1..396: note = derived and/or modified sequence opt5 from anti-influenza_Chain
  source 1..396: mol_type = other RNA
cagatcaccctgaaggagagcggccccacactcgtgaaacctacgcaaaccctgacacttacctgcgtcttctccgggttttctctgagcattacaggagttagagtgggctggatccggcagccgcccgggaaggccctcgaatggctggctcttatttcctgggacgatgagaaacactactctcctagcctgcagtcccgcctcaccatcacaaaggacacctctaaaaaccaggtggtcctgacgatgaccaatctggatcccgtggacacagccacctattactgtgcgagaagcacagatcggggacatgttctccgctatttcggctggatgctgcctggggacgcttttgatgtgtggggacaaggcaccatggtcacggtgtccagc

SEQ ID NO: 43295 - RNA, 396 nt, synthetic construct
  misc_feature 1..396: note = derived and/or modified sequence opt5 from anti-influenza_Chain
  source 1..396: mol_type = other RNA
caggtgcaactgcaggagagcggccccgggctcgtcaagccttccgaaaccctgtctcttacatgcacggttagctccggaccgatgtctgactactattggagctggatcagacagccccctggcaaagggctggagtggattggacacgtgtccgtgtctcatggcgggcggaccaagagcaacccctccgtcatgagccgcgtgacaatctctgttgaaacctccaaaaatcagttcagcctcaagctgacatctgtgaccgccgctgatacagccgtctactattgtgcgagacttaactactatgaccggtccggataccacagccctgatggcccctctaataactggtttgacccttggggccaagggaccctggtgacggtttccagc

SEQ ID NO: 43296 - RNA, 396 nt, synthetic construct
  misc_feature 1..396: note = derived and/or modified sequence opt5 from anti-influenza_Chain
  source 1..396: mol_type = other RNA
caggtgcaactggtccagagcggcgccgaggttaagaaacccggggcttccgtgaaggtgtcttgcaaaaccagcggatacacattcacggcctataccatccactgggtcagacaggcgcctggccagcggctcgaatggatggggtggattaacgctggaaatggccatacaaagtactcccaacgctttaaagggagagtgaccatcacacgggacacctctgcccgcacaacctatatggagctgagaagccttacgtccgaagataccgccctgtacttctgtgctcggggaccggagacatattactatgacaagaccaactggctcaattctcaccccgatgaatactttcagcattggggccacggcacacaggttaccgtgagctcc

SEQ ID NO: 43297 - RNA, 399 nt, synthetic construct
  misc_feature 1..399: note = derived and/or modified sequence opt5 from anti-influenza_Chain
  source 1..399: mol_type = other RNA
caggtgcaactggtccagagcggctccgaggttaagaaacccggggcctctgtgaaggtgagctgcaaagcctccggatacaccttcacaaactatgacatcaattggattagacaggctcctggccaggggctcgaatggatgggatggatcaaccccaattctggcacgaccgggagcgcgcaacggtttcagggacgcgtcacaattaccgtggatacatccatcaccacagtttacatggagctgtctagccttagatccgacgataccgctatttattactgtgcccggggccgcgaactgctcagactgcagcacttccttacggacagccagtctgagcggcgcgattgctttgacccgtggggccaagggaccctggtgacagtctccagc

SEQ ID NO: 43298 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggactgtccttcctcaacgcctggatgtcttgggtgcggcaagcgcctggcaaagggctggagtgggtgggacgcatcaagagcaataccgacggcggcacaacggattacgctgccccggtcaaagggagatttaccatttcccgggacgattctaagaacacactttatctgcagatgagctccctcaaaaccgaagacacagccgtgtactattgtaccacagatggaccctacagcgacgatttccgctctggctatgctgccagataccggtattttgggatggacgtttggggacagggcaccacggtgaccgtctccagc

SEQ ID NO: 43299 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattctcctttctgaacgcctggatgtcttgggtgcggcaagcgcctggcaaagggctcgagtgggtgggacgcatcaagagcaataccgacggcggcacaacggattacgctgccccggtcaaagggagattcaccatttcccgggacgattctaagaacacactgtatcttcagatgagctccctgaaaaccgaagacacagccgtgtactattgtaccacagatggaccctacagcgacgattttcgctctggctatgctgccagataccggtatttcgggatggacgtttggggacagggcaccacggtgaccgtctccagc

SEQ ID NO: 43300 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggactgaccttcctcaacgcctggatgtcctgggtgcggcaagcgcctggcaaagggctggagtgggtgggacgcatcaagtctaatacagacggcggcacgaccgattacgctgccccggtcaaagggagatttacaattagccgggacgattccaagaacaccctttatctgcagatgtctagcctcaaaacagaagacaccgccgtgtactattgtacaaccgatggaccctactccgacgatttccgcagcggctatgctgccagataccggtattttgggatggacgtttggggacagggcacgaccgtgacagtctcttcc

SEQ ID NO: 43301 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattctccttttctaacgcctggatgagctgggtgcggcaagcgcctggcaaagggctggagtgggtgggacgcatcaagtccaataccgacggcggcacaacggattacgctgccccggtcaaagggagattcaccatttctcgggacgatagcaagaacacactctatctgcagatgtccagccttaaaaccgaagacacagccgtgtactattgtaccacagatggaccctactctgacgattttcgctccggctatgctgccagataccggtatttcgggatggacgtttggggacagggcaccacggtgaccgtcagctct

SEQ ID NO: 43302 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggactgaccttctccaacgcctggatgtcttgggtgcggcaagcgcctggcaaagggctcgagtgggtgggacgcatcaagagcaatacagacggcggcacgaccgattacgctgccccggtcaaagggagatttacaatttcccgggacgattctaagaacaccctgtatcttcagatgagctccctgaaaacagaagacaccgccgtgtactattgtacaaccgatggaccctacagcgacgatttccgctctggctatgctgccagataccggtattttgggatggacgtttggggacagggcacgaccgtgacagtctccagc

SEQ ID NO: 43303 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattcaccttttccaacgcctggatgtcttgggtgcggcaagcgcctggcaaagggctggagtgggtgggacgcatcaagagcaatacagacggcggcacgaccgattacgctgccccggtcaaagggagattcacaatttcccgggacgattctaagaacaccctctatctgcagatgagctcccttaaaacagaagacaccgccgtgtactattgtacaaccgatggaccctacagcgacgattttcgctctggctatgctgccagataccggtatttcgggatggacgtttggggacagggcacgaccgtgacagtctccagc

SEQ ID NO: 43304 - RNA, 402 nt, synthetic construct
  misc_feature 1..402: note = derived and/or modified sequence opt5 from anti-influenza_Chain
  source 1..402: mol_type = other RNA
gaggtgcagctggtcgttagcggcgggggactcgtgaagcccggcgggtccctgagactttcttgcgccgctagcggactgtccttcctcaacgcctggatgtcttgggtgcggcaagcgcctggcaaagggctggaatgggtcggacgcatcaagagcaataccgacggcggcacaacggattacgctgccccggtgaaagggagattttccatttctcgggacgatagcaagaacatgcttttcctgcacatgtccagcctccgcaccgaggacacagccgtttattactgtgctaccgatggaccctattctgacgattttagatccggctacgccgctcggtatcgctacttcgggatggacgtgtggggacagggcacaaccgtcacagtgagctct

SEQ ID NO: 43305 - RNA, 402 nt, synthetic construct
  misc_feature 1..402: note = derived and/or modified sequence opt5 from anti-influenza_Chain
  source 1..402: mol_type = other RNA
gaggtgcagctggtcgttagcggcgggggactcgtgaagcccggcgggtccctgagactttcttgcgccgctagcggactgtccttcctcaacgcctggatgtcttgggtgcggcaagcgcctggcaaatgtctggaatgggtcgggcgcatcaagagcaataccgacggaggcacaacggattacgctgccccggtgaaaggcagattttccatttctcgggacgatagcaagaacatgcttttcctgcacatgtccagcctccgcaccgaggacacagccgtttattactgcgctaccgatgggccctattctgacgattttagatccggatacgccgctcggtatcgctacttcggcatggacgtgtgggggcagggaacaaccgtcacagtgagctct

SEQ ID NO: 43306 - RNA, 402 nt, synthetic construct
  misc_feature 1..402: note = derived and/or modified sequence opt5 from anti-influenza_Chain
  source 1..402: mol_type = other RNA
gaggtgcagctggtcgttagcggcgggggactcgtgaagcccggcgggtccctgagactttcttgcgccgctagcggactgtccttcctcaacgcctggatgtcttgggtgcggcaagcgcctggcaaagggctggaatgggtcggacgcatcaagagcaataccgacggcggcacaacggattacgctgccccggtgaaagggagattttccatttctcgggacgatagcaagaacatgcttttcctgcacatgtccagcctccgcaccgaggacacagccgtttattactgtgctaccgatggaccctattctgacgattttagatccggctacgccgctcggtatcgctacttcgggatggacgtgtggggatgcggcacaaccgtcacagtgagctct

SEQ ID NO: 43307 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattcacctttctgaacgcctggatgtcctgggtgcggcaagcgcctggcaaagggctcgagtgggtgggacgcatcaagtctaatacagacggcggcacgaccgattacgctgccccggtcaaagggagattcacaattagccgggacgattccaagaacaccctgtatcttcagatgtctagcctgaaaacagaagacaccgccgtgtactattgtacaaccgatggaccctactccgacgattttcgcagcggctatgctgccagataccggtatttcgggatggacgtttggggacagggcacgaccgtgacagtctcttcc

SEQ ID NO: 43308 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattcacctttctgaacgcctggatgtcctgggtgcggcaagcgcctggcaaatgtctcgagtgggtggggcgcatcaagtctaatacagacggaggcacgaccgattacgctgccccggtcaaaggcagattcacaattagccgggacgattccaagaacaccctgtatcttcagatgtctagcctgaaaacagaagacaccgccgtgtactattgcacaaccgatgggccctactccgacgattttcgcagcggatatgctgccagataccggtatttcggcatggacgtttgggggcagggaacgaccgtgacagtctcttcc

SEQ ID NO: 43309 - RNA, 402 nt, synthetic construct
  misc_feature 1..402: note = derived and/or modified sequence opt5 from anti-influenza_Chain
  source 1..402: mol_type = other RNA
gaggtgcagctggtcgaaagcggcgggggactcgttaagcccggcgggtccctgagactttcttgcgccgctagcggattcacctttctgaacgcctggatgtcctgggtgcggcaagcgcctggcaaagggctcgagtgggtgggacgcatcaagtctaatacagacggcggcacgaccgattacgctgccccggtcaaagggagattcacaattagccgggacgattccaagaacaccctgtatcttcagatgtctagcctgaaaacagaagacaccgccgtgtactattgtacaaccgatggaccctactccgacgattttcgcagcggctatgctgccagataccggtatttcgggatggacgtttggggatgcggcacgaccgtgacagtctcttcc

SEQ ID NO: 43310 - RNA, 414 nt, synthetic construct
  misc_feature 1..414: note = derived and/or modified sequence opt5 from anti-influenza_Chain
  source 1..414: mol_type = other RNA
caggtgcagctgcaggagagcggcgggggactcgtccagcccggcgaatccctgagactttcttgcgttgggagcggatcctctttcggcgagagcaccctgtcctactatgccgtgtcttgggtgcggcaggctcctgggaagggactcgaatggctgagcatcattaacgccggcggcggggacatcgattacgcggactccgtcgagggacgctttacaattagcagagataattctaaagaaacgctttatctgcaaatgaccaacctccgggtggaggacacaggcgtttactattgtgctaagcacatgtccatgcaacaggtggtcagcgccgggtgggagcgcgccgatctggtgggagacgctttcgatgtttggggccaggggaccatggtgacagtctcttcc

SEQ ID NO: 43311 - RNA, 465 nt, synthetic construct
  misc_feature 1..465: note = derived and/or modified sequence opt5 from anti-influenza_Chain
  source 1..465: mol_type = other RNA
ctgagcagaatcaaccacttcgagaagattcagatcattcccaaatcctcttggagcgaccatgaagcctcctctggcgtgagctccgcttgcccttaccaagggaccccgagctttttccggaatgtcgtttggctcatcaagaaaaacaatacatatcccacgattaagcgctcttacaacaataccaaccaggaggatctgcttatcctgtggggaatccaccattccaatgacgccgcggaacagacaaaactctatcagaaccctaccacatacattagcgtgggcacctctacactgaatcaaagacttgtgcccaagatcgctacccggtccaaggtcaacgggcagaatggacgcatggactttttctggacgattctgaaacctaacgatgccatcaattttgagagcaacggcaatttcattgcccccgaatatgcttacaagatcgtgaaaaag

SEQ ID NO: 43312 - RNA, 564 nt, synthetic construct
  misc_feature 1..564: note = derived and/or modified sequence opt5 from anti-influenza_Chain
  source 1..564: mol_type = other RNA
aacgtgcccgagtggagctacatcgtcgaaaaggccaatcctgctaacgacctgtgctatccgggcaatttcaacgattacgaggaactcaaacatctgctttccagaattaatcactttgagaagatccagattatccccaaatctagctggtccgaccacgaagcctctagcggggtttcctctgcgtgtccttatcaaggaacccccagcttctttcggaacgtggtgtggctgattaagaaaaataacacataccctacgatcaagcgctcctataataacaccaatcaggaggatctcctgatcctttggggcattcatcacagcaacgacgctgccgagcagacaaagctgtaccagaatcccaccacatatatctctgtcgggacctccacactcaaccaaagactggtgcctaaaattgccacccggagcaaggttaatggacagaacggccgcatggatttcttttggacgatcctgaaaccgaacgacgctattaatttcgaatctaacgggaattttatcgcccccgagtacgcttacaagattgtgaaaaag

SEQ ID NO: 43313 - RNA, 609 nt, synthetic construct
  misc_feature 1..609: note = derived and/or modified sequence opt5 from anti-influenza_Chain
  source 1..609: mol_type = other RNA
atgctgagaagcctcgtgctgaacgagaaacttcgggcccgcgtcctggaaagagctgaggagttcctcctgaataacaaggccgacgaagaagtttggtttcgggagcttgtgctgtgcatcctcacctccaattctagcttcatttccgcgtacaagtctatgaactatatcctggataaaattctgtacatggacgagaaggaaatcagcattctcctgcaggagtccggctatcgcttttacaatcttaaagctaagtatctgtacagagccaagaacctctatgggaaagtgaagaaaacaatcaaggaaatcgccgataaagaccaaatgcaggctcgggagttcattgccacgcacatctacggaattggctacaaggaggcttctcattttctgcgcaatgtcgggtatcttgatctggccatcattgacagacacatcctccggttcattaacaatctgggaatccccatcaagctgaaaagcaagcgcgaatacctcctggcggagtcccttctgagaagcattgccaacaatctcaacgtgcaggttggcctgcttgatctgtttatcttctttaaacagaccaatacaattgtgaag

SEQ ID NO: 43314 - RNA, 615 nt, synthetic construct
  misc_feature 1..615: note = derived and/or modified sequence opt5 from anti-influenza_Chain
  source 1..615: mol_type = other RNA
ggcctgttcggggccatcgctggatttattgagggcgggtggaccggaatggtggacggctggtacgggtatcaccatcagaacgaacaaggaagcggctacgccgcggatctcaagtccacacagaatgctatcgacgagattacgaacaaagtcaattctgttatcgaaaagatgaacacccagttcacagccgtgggcaaagagtttaatcacctggaaaagagaattgagaaccttaataaaaagatcgatgacgggttcctggatatctggacctataacgccgagctcctggtgcttctggaaaatgagcggacactcgactaccatgatagcaacgtcaagaatctgtatgaaaaagtgcgctcccagctgaagaacaatgctaaagagattggaaacggctgctttgagttctaccacaagtgtgacaatacctgcatggaatctgttaaaaacgggacatatgattaccccaagtacagcgaggaagccaagctcaacagagaggaaatcgacggagtgaaactggagtccacccggatttatcaaatccttgctatttactctacggtcgccagctccctggtgctcgttgtgagcctgggcgcg

SEQ ID NO: 43315 - RNA, 639 nt, synthetic construct
  misc_feature 1..639: note = derived and/or modified sequence opt5 from anti-influenza_Chain
  source 1..639: mol_type = other RNA
gagatcgtgctgacccagagccccggcacactcagcctgtctcctggggaaagagccacgcttagctgccgggcttcccaacgcgtctctagctacctggcctggtatcagcagaagccgggacaggcgcccagactcctgatttacggcgcttccacccgggccgccgggatccctgaccgcttctctggaagcggctccgggacagattttacccttacaattagcagactggagcccgaagactctgctgtttattactgtcaacagtatggacggacccctctcacattcggcggcgggaccaaagtggagatcaagcgcgccgctgccccctccgtgtttattttccctccgagcgatgaacagctgaaatctggaacggcgtccgtcgtgtgcctgctcaacaatttttaccccagagaggccaaggttcagtggaaagtggacaacgctctgcaaagcggcaattctcaggagtccgtcaccgaacaggatagcaaggactccacatattctcttagctccaccctgacactcagcaaggccgattacgagaaacacaaggtgtacgcttgtgaagttacccatcaggggctgtcttcccctgtgacgaaatccttcaaccggggagagtgc

SEQ ID NO: 43316 - RNA, 639 nt, synthetic construct
  misc_feature 1..639: note = derived and/or modified sequence opt5 from anti-influenza_Chain
  source 1..639: mol_type = other RNA
gacatccagatgacccaaagcccctcctctctgagcgcctccctcggcgggaacgtgacaattacgtgcaaggcttctcaggatatcaataaatacattgcctggtatcagcacaagcctggaaaaggcccgagactggtcatccattacaccagcacacttcagcccgggattccttcccggttctctggaagcggctccgggaccgactatagcttttctatctccaacctggagcccgaagatatcgcgacatactattgtctccaatacgacattctgtataccttcggaggcggcacaaaacttgagatcaagcgcgctgatgccgcccctaccgttagcatttttcccccttcttccgaacagctgacgagcgggggagcttctgtggtgtgcttcctcaataacttttacccgaaggacatcaatgtcaagtggaaaattgatggctccgagagacagaacggggtgctgaatagctggaccgaccaggattccaaggactctacatacagcatgtccagcaccctgacactcaccaaagatgaatatgagcggcacaactcttacacgtgtgaggccacacataagacctccacaagccccatcgttaaatctttcaatcgcaacgaatgc

SEQ ID NO: 43317 - RNA, 642 nt, synthetic construct
  misc_feature 1..642: note = derived and/or modified sequence opt5 from anti-influenza_Chain
  source 1..642: mol_type = other RNA
gacatccagatgacccaaagcccctcctctctgagcgcctccgtgggcgatagagtcacaattacgtgccgggcttctcaggggatcagctcctacctcgcctggtatcagcagaagcctggaaaagttccgaccctgcttatttacgacgcgtctacactgcgcagcggcgtgccctccagattcagcgggtctggatccgctaccgattttacactcaccatcagctctctgcaacctgaggacgtggccacatattactgtcagcggtataactccgctccccctattaccttcggccaggggacgcgccttgaaatcaagagagccgccgctcccagcgtctttatcttccctccgtctgatgagcagctgaaatccggaaccgccagcgtggtttgcctcctgaataacttttacccccgggaagcgaaggtgcaatggaaagtcgacaatgccctgcagtccggcaactctcaggagagcgtgacagaacaggattccaaggacagcacctattctctctccagcacactgaccctttctaaggctgattacgagaaacacaaggtttacgcctgtgaggtgacgcatcaaggcctgagctcccctgtcacaaaatctttcaatcgcggggaatgc

SEQ ID NO: 43318 - RNA, 642 nt, synthetic construct
  misc_feature 1..642: note = derived and/or modified sequence opt5 from anti-influenza_Chain
  source 1..642: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctagaacctttggcggcgggacaaaagtggagatcaagcgggctgccgctcccagcgtgttcatttttcctccgtctgatgaacagctcaaatccggaaccgccagcgtcgtgtgcctgctgaacaatttctacccccgcgaggcgaaggttcagtggaaagtggacaacgccctccaatccggcaattctcaggagagcgtcacggaacaggattccaaggacagcacctattctctgtccagcacacttaccctgtctaaggctgattacgagaaacacaaggtgtacgcctgtgaagttacacatcaggggctcagctcccctgtgaccaaatcttttaacagaggagagtgc

SEQ ID NO: 43319 - RNA, 642 nt, synthetic construct
  misc_feature 1..642: note = derived and/or modified sequence opt5 from anti-influenza_Chain
  source 1..642: mol_type = other RNA
agctacgtgctgacccagcccccttccgtctctgttgccccgggcgagacagctacggtgacctgcgggggaaacaatatcggcagcaagtccgtgcactggtatcaacagaaacccgggcaggcccctgtcgtggttatttactatgacggagatagaccctctggcatccctgaacggttcagcgggtccaactctggagacacagcgaccctcacaattagccgcgtggaggctggcgatgaagccgactactattgtctggtctgggattacacctccgtgcattatgtttttggcacagggaccaaggtgacggtccttggacagcccaaagccaatcctaccgtgacactgttcccgcccagctctgaggaactccaagctaacaaggccaccctggtgtgccttatctccgacttttaccctggcgctgtcacagttgcctggaaagcggatgggagccccgtgaaggccggagtggagaccacgaagccttctaaacagtccaataacaagtacgctgccagctcttatctgtccctcacacccgagcagtggaaaagccacagatcctactcttgtcaggtcacccatgaaggcagcacagtggagaagaccgttgctccgaccgaatgctcc

SEQ ID NO: 43320 - RNA, 642 nt, synthetic construct
  misc_feature 1..642: note = derived and/or modified sequence opt5 from anti-influenza_Chain
  source 1..642: mol_type = other RNA
gacatccagatgacccaaacaagctcctctctgagcgcctccctcggcgatagagtgacgatttcttgccgggctagccaggacatccgcaactacctgaattggtatcagcagaagcccgatgggaccgtcaaacttctgatttactatacatccagactccactctggagttcctagccggttctccgacagcggctctgggaccgattactccctgacaatcagcaaccttgagcaagaagacctggccacctatttttgtcagcagacatacaccctcccgtggacgttcggaggcgggaccaagctggagattaaacgcgcggatgctgcccccacagtgtctatctttcctccctccagcgaacagctgacctctggaggcgcctccgtggtctgcttcctcaataacttttatcctaaggacatcaatgtgaaatggaagattgatggcagcgagagacaaaacggggttctgaatagctggacagaccaggattctaaggacagcacctactccatgagctctacgcttacactgaccaaagatgaatacgagcggcataactcctatacatgtgaggctacccacaagaccagcacatctcccatcgtgaaatccttcaatcgcaacgaatgc

SEQ ID NO: 43321 - RNA, 645 nt, synthetic construct
  misc_feature 1..645: note = derived and/or modified sequence opt5 from anti-influenza_Chain
  source 1..645: mol_type = other RNA
gacggcgtgaagcccctgatcctcagagattgcagcgtcgccgggtggctgcttggaaaccctatgtgtgacgagttcattaatgttccggaatggtcctacatcgtggagaaagctaaccccgccaatgatctgtgctatcctggcaactttaatgactacgaagaactcaagcatctgctttctcggattaaccacttcgagaaaatccagattatccccaagagctcctggtctgatcacgaggcgagctccggggtgtctagcgcttgtccttatcaaggaaccccctcctttttccgcaatgtcgtgtggctgatcaaaaagaacaatacataccctacgattaagagaagctataacaataccaaccaggaggacctcctgatcctgtggggcattcatcactctaatgatgccgccgaacagacaaaactctaccagaacccgaccacatatatctccgttgggaccagcacactgaatcaacggcttgtgcccaagattgctacccgctctaaagtcaacggacagaacggcagaatggactttttctggacgatcctgaagcctaatgatgccattaactttgagtccaatggcaacttcatcgctcccgaatacgcctacaaaatcgtgaagaag

SEQ ID NO: 43322 - RNA, 645 nt, synthetic construct
  misc_feature 1..645: note = derived and/or modified sequence opt5 from anti-influenza_Chain
  source 1..645: mol_type = other RNA
gacatccagatgacccaaagcccctccacactgtctgccagcgtgggcgatagagtcacgattacctgccgggcttcccagacaatcaacaattacctcgcctggtatcagcagaagcctgggaaagcgccgaagctgcttatttacaaggcttctagcctggagtccggagttccctctcgcttcagcggctccgggagcggaaccgaatttacactcaccatctcttccctgcaacctgacgatttcgccacatattactgtcaggagtataacaatgacagcccccttacctttggcgggggaacgaaggtggaaattaaaagaaccgtggccgctccttctgtcttcatctttcccccttccgatgagcagctgaaaagcggcacagcctctgtggtttgcctcctgaacaatttctacccgcgggaagctaaggtgcagtggaaagtcgacaacgccctgcaatccggcaatagccaggagtccgtgaccgagcaggattctaaggacagcacatattccctcagctctaccctgacgctttccaaagcggattacgaaaagcacaaagtttacgcctgtgaggtgacacatcaggggctgagctctcccgtcaccaagagctttaaccgcggagaatgc

SEQ ID NO: 43323 - RNA, 645 nt, synthetic construct
  misc_feature 1..645: note = derived and/or modified sequence opt5 from anti-influenza_Chain
  source 1..645: mol_type = other RNA
agcgtgctgacccagcccccttccgcctctggcagcagagggcaatccatcacaatttcttgcacgggaagcacctccgacatcggctcttacaactatgtcagctggtaccagcagcacccggggacagctcccaaggttattctctatgaggtgtcccagcggcctagcggagtgcccgatcgcttctctggctccaaaagcgggaataccgcctttctgacagtctctggacttcaagcggaagacgaggctgattactattgtgcctcctacgccggcaacaatatctatgtgttcggcagcgggaccaaggttacagtgctgggacagcctaaagctaaccccaccgtcacgctctttcctccgtcttccgaggaactgcaggccaataaggctacccttgtgtgcctgattagcgacttctaccccggcgccgttacagtggcgtggaaagccgattcctctcctgtcaaggctggggtggaaaccacaacccccagcaagcagtccaacaataaatacgccgctagctcttatctctccctgacgcctgagcaatggaaaagccataagtcttacagctgtcaggtgacacacgagggatccaccgtcgaaaagacagttgcccccaccgagtgctct

SEQ ID NO: 43324 - RNA, 645 nt, synthetic construct
  misc_feature 1..645: note = derived and/or modified sequence opt5 from anti-influenza_Chain
  source 1..645: mol_type = other RNA
agcgccctgacccagcccccttccgcttctggcagcagagggcaatccatcacaatttcttgcacgggaagcacctccgacatcggctcttacaactatgtgagctggtaccagcagcacccggggacagcccccaaggtcattctctatgaggtttcccagcggcctagcggagtgcccgatcgcttctctggctccaaaagcgggaataccgcgtttctgacagtgtctggacttcaagctgaagacgaggccgattactattgtgcctcctacgctggcaacaatatctatgtcttcggcagcgggaccaaggtgacagttctgggacagcctaaagccaaccccaccgtgacgctctttcctccgtcttccgaggaactgcaggctaataaggccacccttgtctgcctgattagcgacttctaccccggcgcggtgacagttgcctggaaagctgattcctctcctgtgaaggccggggtcgaaaccacaacccccagcaagcagtccaacaataaatacgctgccagctcttatctctccctgacgcctgagcaatggaaaagccataagtcttacagctgtcaggtgacacacgagggatccaccgtggaaaagacagtcgcgcccaccgagtgctct

SEQ ID NO: 43325 - RNA, 648 nt, synthetic construct
  misc_feature 1..648: note = derived and/or modified sequence opt5 from anti-influenza_Chain
  source 1..648: mol_type = other RNA
cagagcgtgctgacccaacccccttccgagtctgtcagcccgggccagacagcctccgttacgtgctctgggcacaagctcggagacaaatacgtgagctggtatcagcagaagcccggccaatcccctgtgctgcttatctaccaggataacagacggccctctgggattcctgaacgcttcatcggaagcaattccggcaacaccgctacactgaccattagcgggacacaggccctcgacgaggcggattattactgtcaggcttgggactcttccaccgccgtctttggaggcggcacaaaactgaccgtgcttggggccgctgccggacaacccaaggctgcccctagcgttacgctgttcccgccctcttccgaggaactccaggcgaataaagccaccctggtgtgcctgatcagcgatttttatcctggcgctgtcacagtggcctggaaggctgactcttcccccgttaaggccggggtggaaaccacaacccctagcaaacagtccaacaataagtacgcggcctctagctatctctccctgacgcccgagcagtggaaaagccatagatcttactcctgtcaagtcacacacgagggaagcaccgtggaaaagacagtggctccgaccgagtgctct

SEQ ID NO: 43326 - RNA, 648 nt, synthetic construct
  misc_feature 1..648: note = derived and/or modified sequence opt5 from anti-influenza_Chain
  source 1..648: mol_type = other RNA
cagagcgccctgacccaacccgcttccgtgtctggcagccctgggcagtccatcacaatttcttgcacgggaaccagctccgacgtcggctcttacaacctcgttagctggtatcagcagcacccggggaaggcccccaaactgatgatctacgaggtgtccaagagacctagcggagtgtctaatcggttctccggcagcaaatctgggaacacagcgtcccttaccattagcggactgcaagctgaagatgaggccgactattactgtcatctctatgtcgggtcttccaattgggtgtttggcggcggaacaaagctggccgttcttggccagcccaaagctgcccctagcgtgaccctgtttcccccttcctctaaggaactccaggctaacaaggccacactggtctgcccgatcagcgatttctaccccggggcggtgaccgttgcctggaaagctgactccagccctgtgaaggccggagtcgagacgaccacaccctctaaacagtccaataacaagtatgctgccagctcttacctgagcctcacccctgaacaatggaaatcccacaagtcttacagctgtcaggtgacacatgagggctccaccgtggagaagacggtcgcgcccacagaatgcagc

SEQ ID NO: 43327 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattggccccctcgcctgacatttggcgggggatctaaagtcgagattaagagaaccgtggccgcgccctccgttttcatctttcctccgagcgacgaacagctcaaatctggcacggcctccgtggtctgcctgctgaacaatttctatccccgggaggctaaggtgcagtggaaagttgataacgccctccaaagcggcaattcccaggagtctgtgaccgaacaggacagcaaggattccacatacagcctgtcttccacccttacactgagcaaggctgactatgagaaacataaggtctacgcctgtgaagtgacccaccaggggctctctagccctgtgacgaaatcctttaaccgcggagagtgc

SEQ ID NO: 43328 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattatccccctcgcctgacatttggcgggggatctaaagtcgagattaagagaaccgtggccgcgccctccgttttcatctttcctccgagcgatgaacagctcaaatctggcacggcctccgtggtctgcctgctgaacaatttctacccccgggaggctaaggtgcagtggaaagttgacaacgccctccaaagcggcaattcccaggagtctgtgaccgaacaggatagcaaggactccacatatagcctgtcttccacccttacactgagcaaggctgattacgagaaacacaaggtctacgcctgtgaagtgacccatcaggggctctctagccctgtgacgaaatcctttaaccgcggagagtgc

SEQ ID NO: 43329 - RNA, 648 nt, synthetic construct
  misc_feature 1..648: note = derived and/or modified sequence opt5 from anti-influenza_Chain
  source 1..648: mol_type = other RNA
gagatcgtgatgacccagagccccgccacactgtccgtctctcctggcgaaagagctacgctcagctgccgggcctcccaatctgttgacagcaacctggcgtggtaccagcagaagccggggcaggctccccgccttctggtgtattccgcctctaccagagccacaggcattcctgctcggttcagcggatccgggagcggaaccgagtttacactcgccatctcttccctgcaaagcgaagatttcgctgtgtactattgtcagcactacaccaattggccccctcgccttacatttggcgggggatctaaagtcgagattaagagaaccgtggccgcgccctccgttttcatctttcctccgagcgacgaacagctgaaatctggcacggcctccgtggtctgcctcctgaacaatttctatccccgggaggctaaggtgcagtggaaagttgataacgccctgcaaagcggcaattcccaggagtctgtgaccgaacaggacagcaaggattccacatacagcctctcttccaccctgacacttagcaaggctgactatgagaaacataaggtctacgcctgtgaagtgacccaccaggggctgtctagccctgtgacgaaatcctttaaccgcggagagtgc

SEQ ID NO: 43330 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttagctccaaccttgcgtggtaccagcagaagccggggcaggctccccgcctgctcgtgtattctgccagcaccagagccacaggcattcctgctcggttctccggaagcgggtctggaaccgagtttacactggccatctccagccttcaatctgaagacttcgctgtgtactattgtcagcactacaccaattggccccctcgcctgacatttggcgggggatccaaagtcgagattaagagaaccgtggccgcgcccagcgttttcatctttcctccgtctgatgaacagctcaaatccggcacggccagcgtggtctgcctgctgaacaatttctatccccgggaggctaaggtgcagtggaaagttgacaacgccctccaatccggcaattctcaggagagcgtgaccgaacaggattccaaggacagcacatactctctgtccagcacccttacactgtctaaggctgattatgagaaacataaggtctacgcctgtgaagtgacccaccaggggctcagctcccctgtgacgaaatcttttaaccgcggagagtgc

SEQ ID NO: 43331 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactcagcgtctctcctggcgaaagagctacgctgagctgccgggcctcccaatctgttgaccacaaccttgcgtggtaccagcagaagccggggcaggctccccgcctgctcgtgtatagcgcctccaccagagccacaggcattcctgctcggttctctggaagcgggtccggaaccgagtttacactggccatcagctctcttcaatccgaagatttcgctgtgtactattgtcagcattacaccaattggccccctcgcctgacatttggcgggggaagcaaagtcgagattaagagaaccgtggccgcgccctctgttttcatctttcctccgtccgacgaacagctcaaaagcggcacggcctctgtggtctgcctgctgaacaatttctatccccgggaggctaaggtgcagtggaaagttgataacgccctccaatccggcaatagccaggagtccgtgaccgaacaggactctaaggatagcacatactccctgagctctacccttacactgtccaaggctgactatgagaaacacaaggtctacgcctgtgaagtgacccatcaggggctcagctctcctgtgacgaaatcctttaaccgcggagagtgc

SEQ ID NO: 43332 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattggccccctcgcctgacatttggcgggggatctaaagtcgagattaagagaaccgtggccgcgccctccgttttcatctttcctccgagcgatgaacagctcaaatctggcacggcctccgtggtctgcctgctgaacaatttctatccccgggaggctaaggtgcagtggaaagttgacaacgccctccaaagcggcaattcccaggagtctgtgaccgaacaggatagcaaggactccacatacagcctgtcttccacccttacactgagcaaggctgattatgagaaacacaaggtctacgcctgtgaagtgacccatcaggggctctctagccctgtgacgaaatcctttaaccgcggagagtgc

SEQ ID NO: 43333 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttagccacaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagacttcgctgtgtactattgtcagcattacaccaattttccccctcgcctgacattcggcgggggatctaaagtcgagattaagagaaccgtggccgcgccctccgtttttatcttccctccgagcgatgaacagctcaaatctggcacggcctccgtggtctgcctgctgaacaatttttatccccgggaggctaaggtgcagtggaaagttgacaacgccctccaaagcggcaattcccaggagtctgtgaccgaacaggatagcaaggactccacatacagcctgtcttccacccttacactgagcaaggctgattatgagaaacacaaggtctacgcctgtgaagtgacccatcaggggctctctagccctgtgacgaaatccttcaaccgcggagagtgc

SEQ ID NO: 43334 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattttccccctcgcctgacattcggcgggggatctaaagtcgagattaagagaaccgtggccgcgccctccgtttttatcttccctccgagcgacgaacagctcaaatctggcacggcctccgtggtctgcctgctgaacaatttttatccccgggaggctaaggtgcagtggaaagttgataacgccctccaaagcggcaattcccaggagtctgtgaccgaacaggacagcaaggattccacatacagcctgtcttccacccttacactgagcaaggctgactatgagaaacataaggtctacgcctgtgaagtgacccaccaggggctctctagccctgtgacgaaatccttcaaccgcggagagtgc

SEQ ID NO: 43335 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaatctgttgacagcaaccttgcgtggtaccagcagaagccggggcaggctccccgcctgctcgtgtattccgcctctaccagagccacaggcattcctgctcggttcagcggatccgggagcggaaccgagtttacactggccatctcttcccttcaaagcgaagatttcgctgtgtactattgtcagcactacaccaattatccccctcgcctgacatttggcgggggatctaaagtcgagattaagagaaccgtggccgcgccctccgttttcatctttcctccgagcgacgaacagctcaaatctggcacggcctccgtggtctgcctgctgaacaatttctacccccgggaggctaaggtgcagtggaaagttgataacgccctccaaagcggcaattcccaggagtctgtgaccgaacaggacagcaaggattccacatatagcctgtcttccacccttacactgagcaaggctgactacgagaaacataaggtctacgcctgtgaagtgacccaccaggggctctctagccctgtgacgaaatcctttaaccgcggagagtgc

SEQ ID NO: 43336 - RNA, 648 nt, synthetic construct
  misc_feature 1..648: note = derived and/or modified sequence opt5 from anti-influenza_Chain
  source 1..648: mol_type = other RNA
gagaccacactgacgcagagccccgccaccctctccgtgtctcctggcgaaagagctacactgagctgccgggcctcccaagtcatctctcacaaccttgcgtggtaccagcagaagccggggcaggctccccgcctgctcatttatggagccagcaccagagcctccggcatccctgctcggttctctgggagcggatccggcacagactacaccctgacaattaccagccttcaatctgaggattttgccgtttattactgtcagcattattccaattggccccctcgcctgacgttcgggggaggcaccaaagtggaaatcaagagaacagtggctgcccccagcgtctttattttccctccgtctgacgagcagctcaaatccggcaccgcgagcgtggtttgcctgctgaacaatttttacccccgggaagccaaggtgcagtggaaagtcgataacgctctccaatctggaaattcccaggagagcgtgacagagcaggactccaaggattctacctatagcctgtccagcacgcttacactgtctaaggccgactacgaaaaacacaaggtttacgcttgtgaggtgacccatcaggggctctccagccctgtcacaaaatctttcaaccgcggcgaatgc

SEQ ID NO: 43337 - RNA, 648 nt, synthetic construct; identical to SEQ ID NO: 39218
  misc_feature 1..648: note = derived and/or modified sequence opt5 from anti-influenza_Chain
  source 1..648: mol_type = other RNA

SEQ ID NO: 43338 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaacccgaggattttgccgtgtattactgtcagcattattctaattggcctccccgcctgacattcgggggaggcaccaaagtggaaattaagagaacggtcgctgccccttccgtgagcatctttccgccctctgacgagcagctcaaatccggcaccgcgagcgttgtgtgcctgctgaacaatttctaccctcgggaagccaaggtccagtggaaagtggataacgctctccaatctggaaattcccaggagagcgttacagagcaggactccaaggattctacctatagcctgtccagcacacttaccctgtctaaggccgactacgaaaaacacaaggtgtacgcttgtgaggtcacgcatcaggggctctccagccccgtgacaaaatcttttaaccgcggcgaatgc

SEQ ID NO: 43339 - RNA, 648 nt, synthetic construct
  misc_feature 1..648: note = derived and/or modified sequence opt5 from anti-influenza_Chain
  source 1..648: mol_type = other RNA
gagatcgtgatgacccagagccccgccacactgtccgtctctcctggcgaaagagctacgctcagctgccgggcctcccaagttatttctcacaacctggcgtggtaccagcagaagccggggcaggctccccgccttctgatctatggagccagcaccagagcctccggcattcctgctcggttctctgggagcggatccggcacagactacaccctcacaatcaccagcctgcaatctgaggattttgccgtgtattactgtcagcattattccaattggccccctcgccttacattcgggggaggcaccaaagtggaaattaagagaacggtcgctgcccccagcgtgtttatcttccctccgtctgacgagcagctgaaatccggcaccgcgagcgttgtgtgcctcctgaacaatttttacccccgggaagccaaggtccagtggaaagtggataacgctctgcaatctggaaattcccaggagagcgttacagagcaggactccaaggattctacctatagcctctccagcacactgaccctttctaaggccgactacgaaaaacacaaggtgtacgcttgtgaggtcacgcatcaggggctgtccagccctgtgacaaaatctttcaaccgcggcgaatgc

SEQ ID NO: 43340 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaatctgaggattttgccgtgtattactgtcagcattattccaattttccccctcgcctgacattcgggggaggcaccaaagtggaaattaagagaacggtcgctgcccccagcgtgttcatctttcctccgtctgacgagcagctcaaatccggcaccgcgagcgttgtgtgcctgctgaacaatttctacccccgggaagccaaggtccagtggaaagtggataacgctctccaatctggaaattcccaggagagcgttacagagcaggactccaaggattctacctatagcctgtccagcacacttaccctgtctaaggccgactacgaaaaacacaaggtgtacgcttgtgaggtcacgcatcaggggctctccagccctgtgacaaaatcttttaaccgcggcgaatgc

SEQ ID NO: 43341 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaatctgaggattttgccgtgtattactgtcagcattattccaattatccccctcgcctgacattcgggggaggcaccaaagtggaaattaagagaacggtcgctgcccccagcgtgtttatcttccctccgtctgacgagcagctcaaatccggcaccgcgagcgttgtgtgcctgctgaacaatttttacccccgggaagccaaggtccagtggaaagtggataacgctctccaatctggaaattcccaggagagcgttacagagcaggactccaaggattctacctacagcctgtccagcacacttaccctgtctaaggccgactacgaaaaacacaaggtgtatgcttgtgaggtcacgcatcaggggctctccagccctgtgacaaaatctttcaaccgcggcgaatgc

SEQ ID NO: 43342 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccgccacactctccgtctctcctggcgaaagagttacgctgagctgccgggcttcccaatctgtggccaacaatcttgcgtggtaccagcagaagccggggcagagcccccgcctgctcatttatggagcttccaccagagacacaggcatccctgcccggttctctgggagcggatccggcaccgagtttacactgaccattagctctcttcaatccgaagatttcgccgtgtactattgtcagcagtacaacaattggccccctatgtatacatttgggcagggaaccaaactggagatcaagcgcacggtcgctgcccccagcgtgttcatttttcctccgtctgacgaacaactcaaatccggcaccgctagcgttgtgtgcctgctgaacaatttctaccccagagaggccaaggtccagtggaaagtggataacgcgctccagtctggcaattcccaggagagcgttacagaacaagactccaaggattctacctatagcctgtccagcacacttaccctgtctaaggccgactacgagaaacacaaggtgtacgcttgtgaagtcacgcatcaggggctctccagccctgtgacaaaatcttttaaccggggagagtgc

SEQ ID NO: 43343 - RNA, 648 nt, synthetic construct
  misc_feature 1..648: note = derived and/or modified sequence opt5 from anti-influenza_Chain
  source 1..648: mol_type = other RNA
gacatcgtgatgacccagagcccctccacactgtctgccagcgtcggcgatagagttacgattacctgccgggcttcccaatctatcgggaactggctcgcctggtaccagcagaagcctggaaaagcgccgaagctgcttatttataaagtgagcacactggagtccggcgtgccctctcgcttcagcgggtccggaagcggcaccgaatttacactcaccatcaattctctgcagcctgacgatttcgctacatactattgtcaaagatacacctccaacagccaggggtttacgttcggacagggcaccaagctggagattaaacggacagtcgccgccccctctgtgtttatcttccctccctccgacgaacagcttaagagcggcaccgcttctgttgtgtgcctcctgaataacttttatcctcgcgaggccaaggtccaatggaaagtggataatgctctgcagtccgggaacagccaggaatccgttacagagcaggactctaaggatagcacctactccctcagctctacgctgacactttccaaagccgactatgagaagcacaaagtgtacgcgtgtgaagtcacccatcaaggactgagctctccggtgacaaagagcttcaatagaggcgagtgc

SEQ ID NO: 43344 - RNA, 648 nt, synthetic construct
  misc_feature 1..648: note = derived and/or modified sequence opt5 from anti-influenza_Chain
  source 1..648: mol_type = other RNA
gacatccagctgacccaaagccccctctcccctccggtgacactgggccagcccgcctctattagctgcagatcctctcagagccttctgtacacggatgggttcacctatctctcctggtaccaccagcggcctggacaatctccccgcagactgatctataagattagcaaccgggactccggcgtccctgatcgctttagcgggtctggatccggcacagacttcacccttaaaatcagcagagttgaggctgaagatgtgggggtgtactattgtatgcaggccacacattggcccctgacctttggagagggcacaaaggtcgaaattaaacctaaggcggctccgtctgtgaccctctttcccccttccagcgaggaactgcaggccaataaagccacgctggtttgcctcatctctgacttctaccccggcgctgtgaccgtcgcctggaaggctgattccagccctgtgaaggccggggttgagacaaccacaccctccaaacagtctaacaataagtatgcggccagctcctacctgagccttaccccggagcaatggaaatctcacaagtcctacagctgtcaggtgacgcatgaaggatctacagtcgagaaaaccgtggctcctacagaatgcagc

SEQ ID NO: 43345 - RNA, 648 nt, synthetic construct
  misc_feature 1..648: note = derived and/or modified sequence opt5 from anti-influenza_Chain
  source 1..648: mol_type = other RNA
gagatcgtgctgacccagagccccggcacactcagcctgtctcctggggaaagagccacgcttagctgccgggcttcccaatctgtccgcagcaacaatctggcctggtaccagcacaagccgggacaggcgcccagactcctgattttcggcgcttcctctcgggccaccgggatccctgaccgctttagcggatccggcagcgggacagatttcacccttacaatttctagactggagcccgaagactttgccgtttattactgtcagcaatatggatccagccctgctctcaccttcggcggcgggacaaaagtggagatcaagcggaccgtggccgctccctctgtctttattttccctccgtccgatgaacagctgaaaagcggaacggcctctgtggtttgcctgctcaacaatttttacccccgcgaggcgaaggtgcagtggaaagtcgacaacgccctgcagtccggcaatagccaagagtccgtgaccgaacaggattctaaggacagcacatattcccttagctctaccctgacactctccaaggctgattacgagaaacataaggtttatgcctgtgaagtgacccaccaggggctgagctctcctgtcacgaaatccttcaacagaggagagtgc

SEQ ID NO: 43346 - RNA, 648 nt, synthetic construct
  misc_feature 1..648: note = derived and/or modified sequence opt5 from anti-influenza_Chain
  source 1..648: mol_type = other RNA
cagagcgtgctgacccaacccccttccgcctctggcagcagagggcagtccatcacaatttcttgcacgggaagcacctccgacatcggctcttacaactatgtcagctggtaccagcagcacccggggacagctcccaaggttattctctatgaggtgtcccaacggcctagcggagtgcccgatcgcttctctggctccaaaagcgggaataccgcctttctgacagtctctggacttcagaccgacgatgaagcggactactattgtgcttcctacgccggcaacaatatctatgtgttcggcagcgggacaaaggttaccgtgctgggacagcctaaagccaaccccacggtcaccctctttcctccgtcttccgaggaactgcaggctaataaggccacacttgtgtgcctgattagcgatttctaccccggcgctgttaccgtggcctggaaagcggactcctctcctgtcaaggccggggtggagacaaccacgcccagcaagcaatccaacaataaatacgctgccagctcttatctctccctgacacctgaacagtggaaaagccataagtcttacagctgtcaggtgacccacgagggatccacagtcgagaagaccgttgctcccaccgaatgctct

SEQ ID NO: 43347 - RNA, 651 nt, synthetic construct
  misc_feature 1..651: note = derived and/or modified sequence opt5 from anti-influenza_Chain
  source 1..651: mol_type = other RNA
cagcccgtgctgacccaacctccgagcgcctccggctctcccgggcagagagtcacaatcagctgctccggatctagctccaacattggctcttacacggttaattggtatcagcagctccctgggaccgctcccaagctgcttatctacagcctgaaccaacggccttccggagtgcccgaccgcttcagcggctctaaatccgggacaagcgcctctctcgcgatttccggactgcagagcgaggatgaagctgtgtattactgtgccgcctgggacgattctctttccgctcacgtcgtgtttggcggcgggaccaagctgacagttctcggacagcctaaagccgctccgagcgtgaccctgtttcccccttcctctgaggaactgcaggccaataaggcgacactcgtctgcctgatcagcgacttctatcccggcgccgtgaccgttgcttggaaagccgattccagccctgtgaaggctggggtcgagacgaccacaccctctaagcaatccaacaataaatacgccgcgagctcttatcttagcctgaccccggaacagtggaagtcccatagatcttacagctgtcaggtgacacacgagggatccaccgtggagaaaacggtcgcccctacagaatgcagc

SEQ ID NO: 43348 - RNA, 651 nt, synthetic construct
  misc_feature 1..651: note = derived and/or modified sequence opt5 from anti-influenza_Chain
  source 1..651: mol_type = other RNA
cagcccgtgctgacccaacctccgagcgcctccggcacacccgggcagagagtcacgatctcttgcagcggatcctctagcaacattggctccaataccgtttcttggtaccaacaggtgcctgggacagctcccaagctcctgatctatggaaacaatgagcggcctagcggcgtgcccgaccgcttctccgggagcaaatctgccacctccgcgagccttgctatttctggactgcagtccgaagatgaggccgactactattgtgccgcttgggatgacagcctcaacggcttttgggtcttcggcgggggaacaaagctgaccgtgcttggccagcctaaagccgctccgtctgttacactgtttcccccttccagcgaggaactccaggccaataaggcgaccctggtgtgcctgatctccgatttctaccccggggccgtcacggtggcttggaaagccgactctagccctgttaaggctggagtggaaaccacaaccccctccaagcagagcaacaataaatatgccgcgtcttcctacctcagcctgacaccggagcaatggaagtctcacaaaagctattcctgtcaggtcacccatgagggctctacggtggaaaagacagtggcccctaccgagtgcagc

SEQ ID NO: 43349 - RNA, 651 nt, synthetic construct
  misc_feature 1..651: note = derived and/or modified sequence opt5 from anti-influenza_Chain
  source 1..651: mol_type = other RNA
agctacgtgctgacccagcccccttccgtctctggcacaccggggcaaagagttatcattagctgctccggatattctagcaacatcggctccaatacggtgaactggtaccagcagttccccgggaccgcccctcggctcctgatttatgctaataaccagagaccccctggagtgcccgaccgcttttctggcagcaagtccgggacaagcgcctctcttgcgatctccggactgcaaagcgatgacgagtctgattactattgtgctgcctgggacgattccctcaatggccactgggtcttcggcgggggaaccaaactgacagtgcttggccagcctaaggccgctccgagcgttaccctgtttcccccttcttccgaggaactccaggccaacaaagctacactggtgtgcctgattagcgacttctaccccggggccgtcaccgtggcgtggaaggccgattcctctcctgttaaagctggagtggaaacgaccacacccagcaagcagtccaataacaagtatgccgctagctcttacctctccctgaccccggagcaatggaaaagccatcggtcttacagctgtcaggtcacacacgaaggctccaccgtggagaagacggtggcccctacagagtgctct

SEQ ID NO: 43350 - RNA, 654 nt, synthetic construct
  misc_feature 1..654: note = derived and/or modified sequence opt5 from anti-influenza_Chain
  source 1..654: mol_type = other RNA
agctacgtgctgacccagcccccttccgtctctgttgccccgggccaaacagctagaatcacgtgcgggggaaacaatattggcagcaagtccgtgcactggtatcagcagaaacccgggcaggcccctgtgctcgtcgtgtacgacgattctgaccggcccagcggaatccctgagcgcttctccggctctaacagcgggaataccgcgacactgaccatttccagagttgaagctggagatgaggccgactattactgtcaagtgtgggattctagctccgaccatgccgtctttggcggcgggacacagcttaccgtgctgggagctgccgctggccagcccaaggccgcgcctagcgttacactcttcccgccctcttccgaggaactgcaggccaacaaagctacccttgtgtgcctgatcagcgatttttatcctggggccgtcacggtggcttggaaggccgactcttcccccgtgaaagcgggagtcgaaaccacaacccctagcaagcaatccaataacaagtacgccgcttctagctatctctccctgacacccgagcagtggaaaagccaccggtcttactcctgtcaggttacccatgagggcagcacggtggaaaagacagtggccccgaccgagtgctct

SEQ ID NO: 43351 - RNA, 654 nt, synthetic construct
  misc_feature 1..654: note = derived and/or modified sequence opt5 from anti-influenza_Chain
  source 1..654: mol_type = other RNA
cagagcgtggtcacccaacccccttccgtttctgtggccccgggccagacagctagaatcacgtgcgggggaaacaatattggcagcaagtccgtgcactggtaccagcagaaacccgggcaagcccctgtcctggtggtttatgacgattctgaccggcccagcggaatccctgagcgcttctccggctctaacagcgggaataccgcgacactcaccatttccagagtggaagctggagatgaggccgactactattgtcaggtctgggatagcagctccgaccattacgtgtttggcacaggcaccaaggttacagtgctgggggccgctgccggacagcccaaagctgcccctagcgtcacccttttcccgccctcttccgaagaactgcaggcgaacaaggccacgctcgtgtgcctgatcagcgatttttatcctggcgctgtgaccgtcgcctggaaagctgactcttcccccgttaaggccggggtggaaacaaccacacctagcaagcaatccaataacaaatacgcggcctctagctatctttccctgacccccgagcagtggaagtctcaccggtcttactcctgtcaggtgacgcatgagggaagcacagtcgagaaaaccgtggctccgacagagtgctct

SEQ ID NO: 43352 - RNA, 654 nt, synthetic construct
  misc_feature 1..654: note = derived and/or modified sequence opt5 from anti-influenza_Chain
  source 1..654: mol_type = other RNA
ctgagcagaatcaaccacttcgagaagattcagatcattcccaaatcctcttggagcgaccatgaagcctcctctggcgtgagctccgcttgcccttaccaagggaccccgagctttttccggaatgtcgtttggctcatcaagaaaaacaatacatatcccacgattaagcgctcttacaacaataccaaccaggaggatctgcttatcctgtggggaatccaccattccaatgacgccgcggaacagacaaaactctatcagaaccctaccacatacattagcgtgggcacctctacactgaatcaaagacttgtgcccaagatcgctacccggtccaaggtcaacgggcagaatggacgcatggactttttctggacgattctgaaacctaacgatgccatcaattttgagagcaacggcaatttcattgcccccgaatatgcttacaagatcgtgaaaaagggggattctgccattgttaaatccgaggtggagtatggaaactgtaacaccaagtgccagacacctatcggcgctatcaatagctctatgccgtttcacaacattcatcccctcaccatcggcgaatgtcctaagtacgtcaaatccaataagctggtgctggccacagggctcagaaacagccccctg

SEQ ID NO: 43353 - RNA, 657 nt, synthetic construct
  misc_feature 1..657: note = derived and/or modified sequence opt5 from anti-influenza_Chain
  source 1..657: mol_type = other RNA
agctccgagctgacccagcccccttctgccagcggcacaccggggcaaagagtgacgatctcctgctctggaagcacctccaacattggctacaatcccgtctcttggtatcagcaggttcctgggacagctcccaaactcctgatctacagcaacaccgaacggccttccggagtgcccgaccgcttcagcggctctaaatccgggacaagcgcctctcttgcgatttccggactgcagagcgaggatgaagctgactattactgtgccgcctgggatgacaccctcaatggccctgtgtttggcgggggaacaaaggtcaccgtgctgggccaaagaacggttgctgccccgtctgtgttcatctttcccccttccgatgagcagcttaaaagcgggaccgcttccgtcgtgtgcctgctcaacaatttctatccccgggaagccaaggttcagtggaaagtggacaacgcgctgcagtctggaaatagccaagagtccgtcacagagcaggatagcaaggactctacctactccctgagctctacactcaccctgagcaaggccgattatgaaaaacacaaggtgtacgcttgtgaggtgacgcatcagggcctttcctctcctgtcacaaagagctttaaccgcggggaatgc

SEQ ID NO: 43354 - RNA, 657 nt, synthetic construct; identical to SEQ ID NO: 39234
  misc_feature 1..657: note = derived and/or modified sequence opt5 from anti-influenza_Chain
  source 1..657: mol_type = other RNA

SEQ ID NO: 43355 - RNA, 660 nt, synthetic construct
  misc_feature 1..660: note = derived and/or modified sequence opt5 from anti-influenza_Chain
  source 1..660: mol_type = other RNA
agctacgtgctgacccagcccccttccgcctctggcacaccggggcaaagagtcacgatcagctgctccggatctaccttcaacattggcagcaatgctgttgactggtatcggcagctccccgggacagcccctaagctgcttatctactccaacaatcagcgcccctctggagtgcctgatagatttagcggctcccggagcgggacctctgcgtccctggctattagcggactccagtctgaggacgaagccgattattactgtgccgcttgggacgatatcctgaacgtgcccgtcttcggcggcgggacaaaacttaccgtgctgggagccgctgccggccaacctaaggcggccccgtccgttacactctttccccctagctctgaggaactgcaggctaataaagccaccctggtgtgcctcatttccgacttctatcccggggctgtcacggtggcctggaaggcggatagctcccctgttaaagccggagtggagaccacaaccccctctaagcagagcaacaataagtacgctgcctccagctatctgtctcttacaccggaacagtggaaatcccaccgcagctactcttgtcaagtcacccatgagggcagcacggtggagaagacagtggctcctaccgaatgctcc

SEQ ID NO: 43356 - RNA, 660 nt, synthetic construct
  misc_feature 1..660: note = derived and/or modified sequence opt5 from anti-influenza_Chain
  source 1..660: mol_type = other RNA
cagagcgccctgacccaacccgctgccgtgtccggctctcctgggcagagcatcacaatttcctgcacgggaacctctagcgacgtcggcgggtacaactatgtttcctggtaccagcagcacccgggaaaggcgcccaaactcatgatctatgaggtgtctaatagacctagcggcgtgtccaaccggttcagcgggtctaagtccggaaatacagctagcctgaccatttctggccttcaagccgaagatgaggccgactactattgttccagctacacatcttccagcacctatgtctttggcacagggaccaaagtgacggttctgggagctgccgctggccagcccaaggccgcgccttccgtgaccctctttcccccttctagcgaggaactgcaggccaacaaagctacacttgtctgcctgatctccgatttctacccgggggccgtgaccgttgcttggaaggccgacagctctcccgtgaaggcgggagtcgaaacaaccacgccttccaaacagagcaataacaagtacgccgcttctagctatctctccctgacacccgagcaatggaaatctcatcgcagctactcctgtcaggtgacccacgagggcagcacagtggaaaagaccgtcgcccctaccgagtgctct

SEQ ID NO: 43357 - RNA, 660 nt, synthetic construct
  misc_feature 1..660: note = derived and/or modified sequence opt5 from anti-influenza_Chain
  source 1..660: mol_type = other RNA
agctacgtgctgacccagcccccttccgtctctggcacaccggggcaaagagttacgatcagctgctccggatctcggagcaacgtgggcgacaattccgtgtattggtaccagcacgtccccgagatggcccctaagctcctggtgtataaaaacacccagcgcccctctggggttcctgctagattcagcggatccaagagcggcacatctgcctcccttgcgattatcgggctgcagagcggagatgaagctgactactattgtgtggcctgggatgactctgtcgatggctacgtgtttggctccgggaccaaagttacagtgctcggagccgctgccggccaacccaaggctgcccctagcgtcaccctgttcccgccctcttccgaggaacttcaggcgaataaagccacactggtgtgcctcattagcgacttttatcctggggctgtgaccgtcgcctggaaggctgattcctctcccgttaaggccggagtggagacgaccacacctagcaaacagtccaacaataagtacgcggccagctcttacctgtccctgacccccgaacagtggaaaagccatcggtcttatagctgtcaagtgacacacgagggctccaccgtcgagaagacggtggctccgacagaatgctct

SEQ ID NO: 43358 - RNA, 660 nt, synthetic construct
  misc_feature 1..660: note = derived and/or modified sequence opt5 from anti-influenza_Chain
  source 1..660: mol_type = other RNA
agctacgtgctgacccagcccccttccgcctctggcacaccggggcaaagagtcacgatcagctgctccggatctagctccaacattggctctaattatgtttactggtatcagcagctccccgggaccgctcctaagctgcttatctaccgggacggacagcgccccagcggcgtgcctgatagattctccgggagcaaatctggaacatccgccagcctggcgatttctggcctccggtccgacgatgaggctgactattactgtgccacctgggatgacaacctgagcggccccgtgtttgggggaggcacaaaacttaccgtcctgggggccgctgccggacaacctaaggctgccccgtctgtgacactctttcccccttccagcgaggaactgcaggcgaataaggccaccctggtttgcctcatctccgatttctatcccggcgctgtgacggtcgcctggaaagctgactctagccctgtgaaggccggggttgaaaccacaaccccctccaagcagagcaacaataaatacgcggcctcttcctacctgagccttacaccggagcagtggaagtctcaccgcagctattcctgtcaagtgacccatgaaggatctacggtcgagaaaacagtggctcctaccgagtgcagc

SEQ ID NO: 43359 - RNA, 660 nt, synthetic construct
  misc_feature 1..660: note = derived and/or modified sequence opt5 from anti-influenza_Chain
  source 1..660: mol_type = other RNA
cagagcgccctgacccaacccgcttccgtgtctggcagccctgggcagtccatcacaatttcttgcacgggaaccagctccgacgtcggcgggtacaactatgtttcttggtaccagcagcacccgggaaaggcccccaaactcatgatctatgaggtgagcaatagaccttccggcgtgagcaaccggttctctgggtccaagagcggaaatacagcgtctctgaccatttccggccttcaagctgaagatgaggccgactactattgtagctcttacacatccagctccaccctggtctttggcacagggaccaaagtgacggttctcggagccgctgccggccagcccaaggctgccccttctgtgaccctgtttccccctagctccgaggaacttcaggcgaacaaagccacactggtctgcctcatcagcgatttctatccgggggctgtgaccgttgcctggaaggctgactcttcccccgtgaaggccggagtcgaaacaaccacgcctagcaaacagtctaataacaagtacgcggccagctcctacctgtctctgacacccgagcaatggaaaagccatcgctcctatagctgtcaggtgacccacgagggctctacagtggaaaagaccgtcgctcctaccgagtgctcc

SEQ ID NO: 43360 - RNA, 660 nt, synthetic construct
  misc_feature 1..660: note = derived and/or modified sequence opt5 from anti-influenza_Chain
  source 1..660: mol_type = other RNA
accgtgctgacacagccccctagcgtctccggcgccccggggcaaagagttacgatctcttgcaccggaagctcctctaacattggcgctgggtacgacgtgcactggtatcagcagctccccggaacagcccctaagctgcttatctacggcaatagcaaccggccctccggggtgcctgatcgcttctctggaagcaaatccggcaccagcgcgacactgggcattaccgggctccagacaggagacgaggctgattattactgtggcacctgggactcttccctgagcgcctatgtctttgggacgggaaccaaggtgacagttcttggcgccgctgccgggcaacccaaagctgccccttctgtgaccctgttcccgccctccagcgaggaactccaggcgaataaggccacactggtctgcctgatctctgatttttaccctggagctgtgaccgttgcctggaaagctgactccagccccgtgaaggccggcgtcgaaacgacaaccccttccaagcagtctaacaataaatatgcggccagctcctacctcagcctgacacccgagcagtggaagtctcatagatcctacagctgtcaagtgacccacgaaggctctaccgtggagaaaacagtcgctccgacggagtgcagc

SEQ ID NO: 43361 - RNA, 663 nt, synthetic construct
  misc_feature 1..663: note = derived and/or modified sequence opt5 from anti-influenza_Chain
  source 1..663: mol_type = other RNA
cagagcgtgctgacccaacccccttccgtctctgccgctccgggccagaaggttacaatcagctgctccgggtctagctccaacattggaaatgactacgtgtcttggtatcagcagctccccggcacggcccctaaactgcttatctacgataacaataagagacccagcgggattcctgaccggttctccggaagcaaatctggcacctccgcgacactggggatcaccggactccaaacaggcgatgaggctaactattactgtgccacctgggaccgcagacccacagcctatgtggtctttggcgggggaaccaagctgacggtgcttggcgctgccgctgggcagcctaaagccgcgccgagcgttaccctgtttcccccttcttccgaggaactccaggccaataaggctacactggtgtgcctgattagcgatttctaccccggagccgtcaccgtggcttggaaggccgactcttcccctgttaaagcgggcgtggaaacaaccacgcccagcaagcagtccaacaataaatatgccgcttctagctacctctccctgacaccggagcaatggaaaagccaccggtcttactcctgtcaggtcacccatgaagggagcacagtggagaagaccgtggcccctaccgagtgctct

SEQ ID NO: 43362 - RNA, 675 nt, synthetic construct
  misc_feature 1..675: note = derived and/or modified sequence opt5 from anti-influenza_Chain
  source 1..675: mol_type = other RNA
atggtgggcttcacccccgtcgccctggctgccctcgcggctacaggggccctggcctttcctgctggaaacgccacggagcttgaaaagagacagaccacaccgaatagcgagggctggcacgacgggtactattactcctggtggtctgatggaggcgctcaagccacctatacaaacctggaagggggaacctacgagatcagctggggcgacggcgggaatctcgttggaggcaaagggtggaaccccggactgaatgcgcgggccattcatttcgaaggcgtgtatcagcctaacggaaattcctaccttgctgtgtatgggtggacacgcaaccccctggtcgagtactacatcgtggagaattttggcacctatgatccttctagcggcgccacggacctcgggaccgttgaatgcgatggatccatttacagactgggcaagacaacccgggtgaacgctccctctatcgacgggacacagaccttcgatcagtattggagcgtccgccaagacaaaagaacgtccggaacagtgcagaccggctgtcactttgatgcctgggcgcgggccgggctgaatgttaacggagaccattactatcagattgtggctacagagggctacttcagctctggctatgcccgcatcaccgtcgctgatgtgggg

SEQ ID NO: 43363 - RNA, 687 nt, synthetic construct
  misc_feature 1..687: note = derived and/or modified sequence opt5 from anti-influenza_Chain
  source 1..687: mol_type = other RNA
agaagcgacaagacccacacatgtcccccttgcccggcccccgagctgctcggcgggccttccgtgttcctgtttccccctaaacccaaggatacgcttatgatctctcggacccctgaagtcacatgcgttgtggtggacgtcagccatgaggatccggaagtgaaattcaactggtacgttgacggagtggaggtccacaatgctaagaccaaaccccgcgaagaacagtataactccacatacagagtggtttctgtgctgaccgtcctccatcaagattggctgaatggcaaggagtataagtgtaaagtgagcaacaaggcccttcctgcgcccattgagaaaacaatctccaaggctaaagggcagcctcgggagccccaggtgtacaccctgccgccttctcgcgaagagatgacgaagaatcaggtcagcctgacctgcctcgttaagggattttatccctccgacattgccgtggagtgggaaagcaacggccaacctgagaataactacaaaacaacccctcccgtgctggattctgacgggtccttctttctctatagcaagctgacagtcgataaatctagatggcagcagggaaatgtgttctcctgtagcgttatgcacgaagcccttcataaccactacacccagaagtctctgtccctcagccccggcaaa

SEQ ID NO: 43364 - RNA, 696 nt, synthetic construct
  misc_feature 1..696: note = derived and/or modified sequence opt5 from anti-influenza_Chain
  source 1..696: mol_type = other RNA
cacgcccaggacatcctggagaagacccataacggcaaactctgcgatctggacggggtgaagccccttattctgagagattgtagcgtcgctggatggctcctgggcaatcctatgtgcgacgagttcatcaacgttccggaatggtcctacattgtggaaaaagccaatcccgcgaacgatctttgttatcctgggaattttaacgactacgaggaactgaagcacctcctgtctcggatcaatcatttcgagaaaattcaaatcatccccaagagctcctggtctgatcacgaggctagctccggagtgtctagcgcctgcccttatcagggcacaccctcctttttccgcaacgtcgtgtggctgattaagaaaaataacacgtaccctaccatcaagagaagctataataacacaaatcaggaagacctcctgattctttgggggatccatcactctaacgatgccgctgagcagaccaaactgtaccaaaatccgacaacctatatttccgttggaacaagcaccctcaaccagcggctggtgcccaagatcgccacgcgctctaaagtcaacggccagaatggcagaatggactttttctggaccattcttaagcctaacgatgctatcaattttgaatccaacgggaatttcatcgcccccgagtacgcgtacaagattgtgaaaaag

SEQ ID NO: 43365 - RNA, 699 nt, synthetic construct
  misc_feature 1..699: note = derived and/or modified sequence opt5 from anti-influenza_Chain
  source 1..699: mol_type = other RNA
atgagacccagcatccagttcctgggcctcctgctgttttggctgcacgggggacaatgcgacattcagatgacccagtccccttctagcctctccgcctctctgggcgggaacgtgacaatcacgtgtaaagctagccaggatattaataaatacatcgcctggtatcaacataagccgggaaaaggcccccggcttgtcattcactacacctccacactgcagcctgggatcccctctcgcttcagcggatccggcagcggcaccgactattctttttccatcagcaacctcgagcctgaagatattgcgacatactattgcctgcagtacgacatcctgtataccttcgggggaggcacaaagctcgagattaaaagagctgatgccgcccccaccgtttctatctttcctccgtccagcgaacagctgacgtctgggggagcttccgtggtgtgtttccttaataacttttaccccaaggacattaatgtcaagtggaaaatcgatggcagcgagcggcaaaacggggtgcttaattcctggaccgaccaggattctaaggacagcacatactccatgagctctaccctcacactgaccaaagatgaatatgagcgccataactcctacacgtgcgaggccacacacaagaccagcacatctcctattgttaagagcttcaatagaaacgaatgt

SEQ ID NO: 43366 - RNA, 702 nt, synthetic construct
  misc_feature 1..702: note = derived and/or modified sequence opt5 from anti-influenza_Chain
  source 1..702: mol_type = other RNA
atgatgagctccgcccagttcctgggcctcctgcttctgtgctttcaagggaccagatgtgacatccagatgacacagacgtctagctccctctctgctagcctgggagatcgggtgaccatttcctgccgcgcctctcaggacatcagaaactaccttaattggtatcaacagaagcccgatggcacagtcaaactgctcatttactataccagccggctgcactccggggttcctagccgcttctctgactccggaagcggcacagattactctctgaccatctccaacctcgagcaggaagacctggcgacatatttttgtcagcaaacctacacgcttccgtggaccttcgggggaggcacaaagctggagattaaaagagctgatgccgcccccaccgtgagcatctttcctccctcttccgaacagctcacaagcggcggggcttccgtggtctgcttcctgaataacttttatcctaaggacatcaatgtgaaatggaagattgatggatctgagcggcagaacggcgttcttaatagctggaccgaccaggattccaaggacagcacgtactctatgtccagcacactgaccctcacaaaagatgaatacgagcgccataactcttatacctgtgaggccacccacaagacaagcacgtcccccatcgtgaaatctttcaatagaaacgaatgc

SEQ ID NO: 43367 - RNA, 702 nt, synthetic construct
  misc_feature 1..702: note = derived and/or modified sequence opt5 from anti-influenza_Chain
  source 1..702: mol_type = other RNA
atggaggcccccgctcagctcctgttcctgcttctgctctggctgcctgacaccacaggcgaaatcgtgcttacgcaaagcccggccaccctgtccctctctcccggggagagagcgacactgagctgccgggcttccgaaaacatttggaataacctggcctggtaccagcagaagcctggacaggctccccgcctcctgatctctggcgccagcaccggggccacaggagtcccttccagatttcggggctctgggagccgcaccgagttcacacttaccatttccagcctgcaatctgaagattttgctatctatttctgtcagcagtacaattcctggcccagaacgtttggacctggcaccaaagttgagattaagcggacagtggccgcgccgagcgtgttcatctttcccccttctgacgagcagctcaaatccggcaccgccagcgtcgtgtgcctgcttaacaatttctatccccgcgaagctaaggttcaatggaaagtggataacgccctgcagtctggaaattcccaggagagcgtcacagaacaggactccaaggattctacctacagcctctccagcacgctgacactgtctaaggctgactatgagaaacacaaggtgtacgcctgtgaggttacccatcaagggctctccagccctgtgacaaaatcttttaacagaggcgaatgc

SEQ ID NO: 43368 - RNA, 705 nt, synthetic construct
  misc_feature 1..705: note = derived and/or modified sequence opt5 from anti-influenza_Chain
  source 1..705: mol_type = other RNA
atggagacccccgcccagctcctgttcctgcttctgctctggctgcctgacacaacgggcgaaatcgtgcttacccaaagcccggggacactgtccctctctcccggagagagagctaccctgagctgccgggcctcccagtctctgagctcctctagcctcgtctggtaccagcagaagcctggccaagcgccccgcctgcttatttatggggcttccagcagagccacaggaatccctgatcggttttctggctccgggagcggaaccgacttcacactgaccatttctcgcctcgaacccgaggattttgccgtttactattgtcagcagtacggcaactccccttatacgttcggccaggggacccaagtggaaatcaaaagaacagtggctgccccgagcgtctttatttttcccccttctgacgagcagctgaagtccggaaccgctagcgtggtttgccttctgaataacttctacccccgggaggccaaagtgcagtggaaggtcgataatgcgctccagtccggcaactctcaagaaagcgtgacagagcaggactccaaagatagcacctattctctgtccagcacgctgacactctctaaggccgactacgaaaagcacaaagtttacgcttgtgaggtgacccatcaggggctgagctcccctgtcacaaagtctttcaatcgcggagagtgc

SEQ ID NO: 43369 - RNA, 705 nt, synthetic construct
  misc_feature 1..705: note = derived and/or modified sequence opt5 from anti-influenza_Chain
  source 1..705: mol_type = other RNA
atggagacccccgcccagctcctgttcctgcttctgctctggctgcctgacacaacgggcgaaaccgtgcttacacaaagcccggggaccctgtccctctctcccggagagagagctacactgagctgccgggcctcccagtctgtcagcatctcctacctggcgtggtatcagcgcaaacctggccaggctcccagactcctgatttacggggcctctcggcgcgccaccggaatccctgatagatttagcggctccgggagcggaacagacttcacccttacgatttctcggctggaacccgaggattttgctgtttattactgtcaacagtatggctccagcccttacaccttcggccaggggacaaaactcgaaatcaagcgcaccgtggccgctccgtctgtgtttatttttcccccttccgacgagcagctgaaaagcggaacagcctctgtcgtgtgccttctgaacaatttctatcccagagaggcgaaggttcaatggaaagtggataacgccctccagtccggcaatagccaggaatccgtcaccgagcaggactctaaggatagcacgtactccctgagctctacactgaccctctccaaggctgactacgaaaaacacaaggtgtatgcctgtgaggttacacatcaagggctgagctctcctgtgaccaagagcttcaaccggggagagtgc

SEQ ID NO: 43370 - RNA, 705 nt, synthetic construct
  misc_feature 1..705: note = derived and/or modified sequence opt5 from anti-influenza_Chain
  source 1..705: mol_type = other RNA
atggcctggatgatgctgctcctgacccttctgatccactgcacaggcagctgggctcagtccgtgctcacgcaacccccttctgtcagcgccgcgccggggcagaaggttaccatttcctgttctggaagctcctctaacatcggcaaaaattacgtgagctggtatcagcagctgcccgggacagctcctaaacttctgatttacgacaacgataagagaccctccggaatccctgaccggttcagcggctctaagtccgggaccagcgccacactcggaattaccggcctgcaaacaggcgatgaggccgactatcattgcggggcttgggattcttccctgaatggaggcgtgtttgggggaggcaccaaagtcacggtgctcgggcagcccaaggccgctcctagcgttaccctgttcccgccctcttccgaggaacttcaggccaacaaggcgacactggtgtgtctcatcagcgacttttaccctggagccgtcaccgtggcttggaaagccgattcctctcccgttaaggctggcgtggaaacaaccacgcctagcaaacagtccaataacaagtatgccgcgagctcttacctgtcccttacacccgagcaatggaaaagccaccgctcttatagctgccaggtcacccatgaaggctccacagtggagaagaccgtggccccgaccgagtgttct

SEQ ID NO: 43371 - RNA, 714 nt, synthetic construct
  misc_feature 1..714: note = derived and/or modified sequence opt5 from anti-influenza_Chain
  source 1..714: mol_type = other RNA
atgatgaagaaaaagagctggttcaccctgatgatcacaggcgtgatttccctctttttctctgtcagcgcctttgctgggaacgttttctgggagcccctgtcctactttaattctagcacgtggcagaaagccgacggatattccaacggccaaatgttcaattgcacctggagagcgaacaatgtgaactttacaaatgatgggaaacttaagctgtctctcaccagccctgctaacaataagttcgactgtggagaataccggtccacaaacaattatggctacgggctgtatgaggtgagcatgaagccggccaaaaacaccggaatcgtctcttcctttttcacatacaccggccccagccacggcacgcagtgggatgaaattgacatcgagtttcttgggaaggataccacaaaagtgcagttcaattattacaccaacggagttggcgggcatgaaaagattatcaatctgggatttgacgcctctacatccttccacacctacgctttcgattggcagcctggctatatcaaatggtacgtggacggggtcctcaagcatacggccacaaccaacattcccagcacacctggaaagatcatgatgaacctgtggaatggcaccggcgtggattcttggctggggtcctataacggagctaatcccctctacgccgagtatgactgggttaaatacaccagcaac

SEQ ID NO: 43372 - RNA, 729 nt, synthetic construct
  misc_feature 1..729: note = derived and/or modified sequence opt5 from anti-influenza_Chain
  source 1..729: mol_type = other RNA
caggtgcaactggtccagagcggcgccgaggttaagaaacccgggtcctctgtgaaggtgagctgcaaggcttccggaggcaccttctctagctacgccatctcctgggtcagacaggcgcctgggcagggactcgaatggatgggcgggattatgggaatgtttggcacaacgaactatgctcaaaaattccagggccgggtgaccatcacagccgacgagtttacctctgccgcttacatggaactgcgcagccttagatccgaggatacagccgtttattactgtgctcggagctctgggtattacccggaatatttccaggactggggacagggcaccctggtgacagtctccagcgggaccggaggctctgggggaacgggctccggcaccgggggaagcacacaatctgtgctcacccagcccccttccgagagcgtttcccccggccagacagcctctgtgacctgcagcgggcacaaactgggagataagtacgtctcctggtaccagcaaaagcctggccagagccccgtgcttctgatttatcaggacaatcgcagaccttctgggatcccggagcggtttattggatccaacagcggcaatacggcgacactcaccatctctggcacacaagccctggatgaagctgactactattgtcaggcctgggatagctccaccgctgtgttcgggggaggcaccaaactgacagtcctcggg

SEQ ID NO: 43373 - RNA, 729 nt, synthetic construct
  misc_feature 1..729: note = derived and/or modified sequence opt5 from anti-influenza_Chain
  source 1..729: mol_type = other RNA
caggtgcaactggtccagagcggcgccgaggttaagaaacccgggtcctctgtgaaggtgagctgcaaggcttccggaggccctttcagaaactttgccatcaattgggtccggcaggcgccggggcagggactcgaatggatgggcgggattatcgctgtgttcggaaccacaaagtacgcccacaaatttcaaggccgcgttacgattaccgccgacgattctacaaacaccgcttatatggagctgggcagccttaagtccgaagacacagccgtgtactattgtgctagagggccccattactattctagctacatggatgtctggggagagggcaccacagtgaccgtttccagcgggacgggaggctctgggggaaccggctccggcacagggggaagcaccgacatccagctgacacagtctccttccagcctctctgcctccgtgggcgatcgggtcaccattacgtgccgcgcgagccaggggatctccacatatctggcctggtaccaacagaagcccggaaaagtgcctaaacttctgatctacgctgcctctaccctccagagcggcgtgccctccagattcagcgggtctggatccggcacagactttaccctgaccattagctctctgcagcctgaagatgtcgctacatattactgtcaaaaatataatagcgccccgtccttcggccccgggacgaaggttgacatcaaacgg

SEQ ID NO: 43374 - RNA, 729 nt, synthetic construct
  misc_feature 1..729: note = derived and/or modified sequence opt5 from anti-influenza_Chain
  source 1..729: mol_type = other RNA
atgagctacagagtgaagcggatgctgatgctcctggtcaccggccttttcctgtccctctctacatttgccgctagcgcctccgcgcagaccgggggatctttctatgagccctttaacaattacaacacgggcctgtggcaaaaagctgacgggtatagcaatggaaacatgttcaattgcacatggcgcgccaacaatgtttccatgacctctcttggcgaaatgagactgagcctcacatcccctagctacaacaagtttgattgtggggagaatcggtctgtgcagacctatggatacggcctgtatgaagtgaacatgaaaccggccaagaatgtcggcatcgtgtccagcttctttacatacaccgggcccacggacggaaccccttgggatgagattgacatcgagttcctgggcaaagatacaaccaaggttcagtttaactactatacaaatggggtgggaaaccacgaaaagattgtcaatctcggcttcgacgctgccaactcttaccatacctatgcttttgattggcagcccaactccatcaaatggtacgtggacgggcaactgaagcacacggccacaacccagattcctcagacacccggaaaaatcatgatgaatctttggaacggcgcgggcgttgatgagtggctggggagctataatggagtgacccctctctctcgctccctgcattgggtcagatacaccaagcgg

SEQ ID NO: 43375 - RNA, 735 nt, synthetic construct
  misc_feature 1..735: note = derived and/or modified sequence opt5 from anti-influenza_Chain
  source 1..735: mol_type = other RNA
caggtgcaactgcagcagagcggcgccgaggtcaagaaacccgggtcctctgttaaggtgagctgcaaagtgtccggagtcatcttctctggcagcgctatttcctgggtgagacaggcccctgggcaaggactcgaatggatgggcgggatctctccgctgtttggaaccacaaactacgcgcagaagttccagggccgggttacgattaccgctgaccagagcacaaataccacatatatggaggtgaactcccttcgctacgaagataccgccgtctatttttgtgccagaggccccaaatactatagcgagtacatggacgtgtgggggaagggaacaaccgttacggtgtcttccggcaccgggggaagcggcgggacaggatctggcaccggcgggtccacagatatccaaatgacccagagcccttcttccctgagcgcttccgtcggagaccgggtgacgattacatgccgcgcctctcagggcatcagctcctatctcgcttggtaccagcaaaagcccgggaaagtgcctaccctgcttatctacgatgccagcacactgagatctggagtcccctcccggttcagcggctctgggagcgcgaccgactttaccctcacaatttcctctctgcagcctgaagatgttgccacgtattactgtcagcgctataatagcgctccgcccatcaccttcggacaaggcacaagactggagattaagcgg

SEQ ID NO: 43376 - RNA, 735 nt, synthetic construct
  misc_feature 1..735: note = derived and/or modified sequence opt5 from anti-influenza_Chain
  source 1..735: mol_type = other RNA
gaggtgcagctggtcgaatccggcgccgaggttaagaaacccgggtcctctgtgaaggtgagctgcaaggcttccggaggcaccttctctagctacgggatctcctgggtcagacaagcccctggacagggcctcgaatggatgggggacattatcggaatgtttggctctacaaactatgcgcagaatttccagggccggctgacgattaccgctgatgagagcacatccaccgcctacatggaacttagctctctgcgctccgaggacacagccgtgtattactgtgctagaagctctgggtattacccggcctatctcccccactggggacaaggcaccctggttacagtgtccagcgggaccggaggctctgggggaacgggctccggcaccgggggaagcacagagatcgtccttacccagtcccctggcacactgtctctcagccccggggaacgggctaccctgtcctgccgcgccagccagtctgtgtccagctcttacctggcgtggtaccagcaaaaacctggacaggcccccagactcctgatttatggcgctagctcccgggccacggggatccctgatcgcttttctggaagcggctccggcacagacttcacccttacaatcagcagactggagccggaagattttgctgtttactattgtcagcagtacgggtctagcccccggaccttcggaggcgggaccaaagtggagattaagcgc

SEQ ID NO: 43377 - RNA, 735 nt, synthetic construct
  misc_feature 1..735: note = derived and/or modified sequence opt5 from anti-influenza_Chain
  source 1..735: mol_type = other RNA
gaggtgcagctggtcgaaagcggcgccgaggttaagaaacccgggtcctctgtgaaggtgagctgcaaggcttccggaggcaccttctctagctacgccatctcctgggtcagacaagcgcctgggcagggactcgaatggatgggcgggattatcggaatgtttggcacagctaactatgcccagaaattccagggccgggtgacgattaccgccgacgagtttacatctaccgcttacatggaactgagctcccttcgcagcgaggatacagccgtttattactgtgctagagggaattattactatgagtcttccctggactactggggacaaggcaccctcgtgacagtcagctctgggaccggaggctccgggggaacgggcagcggcaccgggggatctacacagtccgtggttacccagccgcccagcgtgtccgtcgcccctggccagacagcgcggattacctgcgggggaaacaatatcggctctaaaagcgtgcactggtaccaacagaagcccgggcaggcccctgtgctggtcgtttatgatgactccgatcgccccagcggaatccctgaaagattctctggctccaacagcggcaatacggctacacttaccatctctcgggtggaggccggggacgaagctgattactattgtcaggtgtgggacagctcctctgatcattacgtctttggaacaggcaccaaggtgaccgttctgggg

SEQ ID NO: 43378 - RNA, 735 nt, synthetic construct
  misc_feature 1..735: note = derived and/or modified sequence opt5 from anti-influenza_Chain
  source 1..735: mol_type = other RNA
gaggtgcagctggtccaaagcggcgccgaagttaagaaacccggggcttccgtgaaggtgtcttgcaaagccagcggatacaccttcacaggctattacgtctattgggtgagacaggcgcctgggcagggactcgagtggatgggctggatctccgcttacaacgggaatacgaactatgcccagaagtttcaaggacgggttaccattacagccgacaaatctaccagcacagcttacatggaactgtcctctcttcgcagcgaggataccgccgtgtattactgtgctagatcccggagcctggacgtctggggccagggcacaaccgtgacggtttcttccgggaccggaggcagcgggggaacaggctctgggaccggaggctccacagatgtggtcatgacccagagcccggactctctcgccgtgtccctgggcgaacgcgcgacgatcaattgcaagagctcccagtctgtgctttacagctccaacaataagaactatctggcctggtaccaacagaaacccgggcagcctcccaagctcctgatttattgggctagcacaagagagtctggagtccctgatcggttctccggcagcgggtctggaaccgactttacactgaccatcagctccctccaggccgaggatgttgctgtgtactattgtcaacagtactattctacacccctgaccttcggcgggggaacgaaagtggacattaagcgc

SEQ ID NO: 43379 - RNA, 735 nt, synthetic construct
  misc_feature 1..735: note = derived and/or modified sequence opt5 from anti-influenza_Chain
  source 1..735: mol_type = other RNA
gaggtgcagctggtcgaaaccggcgccgaggttaagaaacccgggagctccgtgaaggtgccttgcaaatctagcggatccccgttcagatctaacgctgtcagctgggtgcggcaagcccccggccaggggctcgaatgggttggaggcatcctgggggtgtttggatccccttcttacgcgcagaagttccagggccgcgtcacaattacggctgacgagagcaccaatacagtgcacatggaacttagaggcctgcggtccgaggataccgccgtttattactgtgcccgcgggcccacatattactatagctacatggacgtgtggggaaaaggcaccacagtcaccgtgtcttccgggacgggaggcagcgggggaaccggctctggcacagggggatccaccagctatgtgctcacacaacctccctctgagtccgtcgctcctggccagaccgccagaatcacgtgcgggggaaacaatattggccggaacagcgttcattggtaccagcagaagccggggcaagctcccgtgctggtggtctacgatgactccgatcgcccttctggaatccccgaaagatttagcggctccaagagcggcaatacagccacccttattatctctcgggtggaggttggggacgaagcggattattactgtcaggtgtggcactccagctctgaccattatgtcttcggaacaggcaccaaagtgaccgttctgggg

SEQ ID NO: 43380 - RNA, 735 nt, synthetic construct
  misc_feature 1..735: note = derived and/or modified sequence opt5 from anti-influenza_Chain
  source 1..735: mol_type = other RNA
cagatgcaactggtgcagagcggcgccgaggtcaagaaacccgggtcctctgttaaggtgagctgcaaggcttccggaggcaccttctctagctacgccatctcctgggtgagacaggcgcctgggcagggactcgaatggatgggcgggatttttggaatgttcggcacagctaactatgcccaaaagtttcagggccgggtcacgatcaccgccgacgagttcacatctgctgcctacatggaactgagctcccttgggagcgaggataccgctatgtattactgtgcccgcagctccggatattacccgcagtattttcaggactggggccaagggacactggtgaccgttagctctggaacaggcgggtccggaggcaccggcagcgggacgggaggctctaccgaaattgtgatgacacagtcccccgggaccctcagcctgtcccctggacagagagcgacactttcttgccgggccagccagtccgtctcttcttcctacctggcttggtaccaacagaaacccggccaggcccctcgcctcctgatgtatggggctagctctagagccaccggaatccccgatcggttcagcggctccggctctgggacggactttacactgaccattagccgcctcgagcctgaggatttcgcggtgtactattgtcaacagtacggatccagctctctgacatttggcgggggaaccaaacttgaaatcaagaga

SEQ ID NO: 43381 - RNA, 735 nt, synthetic construct
  misc_feature 1..735: note = derived and/or modified sequence opt5 from anti-influenza_Chain
  source 1..735: mol_type = other RNA
caggtgcaactggtccagagcggcgccgaggttaagaaacccgggtcctctgtgaaggtgagctgcaaggcttccggagtcaccttctcttactatgccatgagctgggtgagacaggcgcctggccaggggctcgaatggatgggaggcatctccccgatgtttgggacaacgacctacgctcaaaaattccagggacgggttacaattaccgccgacgattctacaagcaccgcctatatggaggtgcgctccctgagaagcgaagacacagctgtctactattgtgcccggtcttccaactactatgatagcgtgtacgactactggggccagggcacccttgttacggtgtcttccgggaccggaggcagcgggggaacaggctctgggaccggaggctccacacagagcgtcgtgacccaacccccttccgagtctgtggctcccggccagacggcccgcatcacatgcgggggacacaatattggcagcaactccgtccattggtatcagcagaaacctgggcaagcgcccgttctggtggtgtacgataatagcgacagaccttctggaatcccggaacggttttccggcagcaactctgggaataccgccacactcaccattagccgcgtcgaggctggagatgaggccgactattactgtcaggtgtggggctcctctagcgatcactatgttttcggcaccgggacaaaggtgacggtcctggga

SEQ ID NO: 43382 - RNA, 738 nt, synthetic construct
  misc_feature 1..738: note = derived and/or modified sequence opt5 from anti-influenza_Chain
  source 1..738: mol_type = other RNA
caggtgcaactggtccagagcggcgggggactcgttaagcccggcgggtccctgagactttcttgcgccgctagcggattcaccttttcctcttacagcatgaactgggtgcggcaggcccctggcaaagggctggagtgggtgtcctctatcagctcctctagctcctatatttactatgtcgacagcgtgaagggacgcttcacaatctctagagataatgcgaaaaactccctctacctgcagatgaatagccttcgggctgaagacacggccgtttattactgtgcccgcggcggcgggtcttatggagcttacgagggctttgattactgggggcaaggaaccctggtgacagtctccagcggcaccgggggatccggcggcacagggtctggaaccggcgggagcacagaaattgtgctcacccagtccccgggaacgctgagcctgtctcccggcgagagagccaccctctcctgccgggctagccagcgcgtttctagctatctggcctggtaccagcaaaagcctgggcaggcgcccagacttctgatctatggagcctccacacgggctgccggcattcctgaccgcttctctggcagcgggtccggaaccgattttacactcaccatcagcagactggaacccgaggactctgctgtgtactattgtcagcagtacggccggacgcctcttacattcgggggaggcaccaaagtcgagatcaagcgc

SEQ ID NO: 43383 - RNA, 738 nt, synthetic construct
  misc_feature 1..738: note = derived and/or modified sequence opt5 from anti-influenza_Chain
  source 1..738: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacctcttacgtgcttacacaacctccctccgtcagcgtggctcctggccagaccgcccgcattacgtgcgggggaaacaatatcggctctaaatccgtgcattggtatcagcagaagccggggcaagcgcccgtcctggttgtgtacgacgatagcgacagaccttccggaatccccgagcggttctctggcagcaactccggcaatacagccaccctcacaattagccgcgtggaagctggggatgaggccgactactattgtcaggtctgggattcttccagcgaccacgctgtgtttggaggcgggacccagctgaccgttcttgga

SEQ ID NO: 43384 - RNA, 738 nt, synthetic construct
  misc_feature 1..738: note = derived and/or modified sequence opt5 from anti-influenza_Chain
  source 1..738: mol_type = other RNA
gaggtgcagctggtcgaaaccggcgccgaggttaagaaacccggggctagcgtgaaggtgtcctgcaaagcctctggatacacattcacgagctattacatgcactgggtcagacaagcgcctggccaggggctcgaatggatgggatggatcaaccccaattccggcgggaccaactatgctcagaagtttcagggacgggtgacaatgacccgcgacacatctattagcaccgcctacatggagctgtccagacttcggtctgatgacacagccgtttattactgtgctcgcgaaggcaaatggggcccgcaagccgctttcgatatctgggggcagggaaccatggtgacggtcagctccggcaccgggggaagcggcgggacaggatctggcaccggcgggtccacagagattgtgatgacccagagccctggaacgctgtctctctcccccggcgagagagccacactgagctgccgggcgtctcagtccgttagctcctcttatcttgcctggtaccaacagaagcctgggcaggctccccgcctgctcatctacgacgccagctccagagctaccgatattcctgaccggtttagcggatctggctccgggacagatttcaccctgaccatcagccgcctggaaccggaggactttgccgtgtattactgtcagcaatatggatctagcctctggacattcggccagggcacgaaggtcgaaatcaaaaga

SEQ ID NO: 43385 - RNA, 738 nt, synthetic construct
  misc_feature 1..738: note = derived and/or modified sequence opt5 from anti-influenza_Chain
  source 1..738: mol_type = other RNA
gaggtgcagctggtcgaaagcggcgggggactcgttcaacccggcgggtccctgagactttcttgcgccgctagcggattcaccttttccatctacgccatgtcttgggtgcggcaggcgcctggcaaggggctggagtgggtgagcgctatttcctctagcggagactccacatattacgccgatagcgtcaaaggccgcttcacgatctctagagacaacgcccggaataccctctatctgcagatgaactcccttcgcgctgaagatacagccgtgtactattgtgctagagcctacggctatacctttgacccgtgggggcagggaacactggttaccgtgagctctggcacagggggatccggcgggaccggaagcggcacgggcgggtctaccgagattgtcctcacacaaagccccctgtccctgcctgtgacccccggagaacctgcgtccatctcttgccggagctcccagagcctcctgcactctaatggctacaactaccttgattggtatctgcagaagcccgggcagtcccctcaactcctgatttaccttggaagcaatcgcgcctctggcgttccggacagattcagcgggtccggatctggcacagattttaccctgaaaatcagccgggtggaggctgaggacgtcggcgtgtattactgtatgcaggccctccagacgcccctgacattcgggggaggcaccaaggtggaaatcaaacgc

SEQ ID NO: 43386 - RNA, 738 nt, synthetic construct
  misc_feature 1..738: note = derived and/or modified sequence opt5 from anti-influenza_Chain
  source 1..738: mol_type = other RNA
gaggtgcagctggtcgaaaccggcgccgaggttaagaaacccgggagctccgtgaaggtgtcttgcaaagctagcggaggcacattcagaacgcacgccatctcctgggtccggcaagcgcctgggcagggactcgaatggatgggcgggattatcgctatttttggaaccgccaactacgcccagaagttccagggccgcatcacaattaccgctgacgagtctacaagcaccgcctatatggaactgtcctctcttagaagcgaggatacagctgtgtacttttgtgcccggggctccgggtatcatatcagcaccccgttcgacaattggggacaaggcacgctggttaccgtgtcttccgggacaggaggcagcgggggaaccggctctggcacagggggatccaccagctacgtcctcacgcagcccccttctgtgtccgttgcgcccggccagacagcccgcattacctgcgggggaaacaatatcggcagcaaaggggtgcactggtatcagcaaaagcctggacaggctcccgtcctggtggtgtacgatgactccgatagaccttctggcatcccggagcggtttagcggctccaacagcgggaatacagccacccttaccatttctcgcgtcgaagctggagacgaggccgattattactgtcaggtttgggactccagctctgatcatgtggtgttcggcgggggaacaaagctgacggtcctcggc

SEQ ID NO: 43387 - RNA, 738 nt, synthetic construct
  misc_feature 1..738: note = derived and/or modified sequence opt5 from anti-influenza_Chain
  source 1..738: mol_type = other RNA
gaggtgcagctggtccaaagcggcgccgaagttaagaaacccgggtcctctgtgaaggtgagctgcaaagcctccggaggcatcttcagatctaacagcatttcctgggtccggcaggcccctgggcagggactcgagtggatgggcgggatctttgcgctgttcggaaccacagactacgctcagaagtttcaaggccgcgtgacgattaccgccgatgaatctagcacaaccgtttatcttgagctgtccagcctcacatctgaagacaccgccgtgtactattgtgctagaggctccgggtacacaacccggaattatttcgattactggggacagggcacgctggtcaccgtgagctctgggacaggaggctccgggggaaccggcagcggcacagggggatctaccgagatcgttcttacgcagtccccgggcacactgagcctctcccccggggagcgcgccaccctgtcttgcagagctagccagtccgtgagctctaactatctgggatggtaccaacagaaacctggccaggctccccggctcctgatttacggggcgtccagccgcgcctctggaatccctgacagatttagcggcggcgggtccggaacagatttcacccttaccatctctcggctggaacccgaggactttgctgtctattactgtcagcaatatggcagctcccctctcacattcgggggaggcacgaaggtggaaattaagcgc

SEQ ID NO: 43388 - RNA, 738 nt, synthetic construct
  misc_feature 1..738: note = derived and/or modified sequence opt5 from anti-influenza_Chain
  source 1..738: mol_type = other RNA
gaggtgcagctggtcgaaagcggcgccgaggttaagaaacccgggtcctctgtgaaggtgagctgcaaggcttccggaggcatcttcaactcttacgccattagctgggtcagacaagcgcctgggcagggactcgaatggatgggcgggatcattgctatctttcacaccccgaaatatgcccagaaattccagggacgggtgacaattacggccgacgagtccaccaatacagcttacatggaactgcgctctcttaagagcgaggataccgccctgtattactgtgctagaggctccacatatgactttagctctggcctcgattactgggggcaaggaaccctggttacagtgtccagcggcaccgggggatctggcgggacgggatccggcaccggcgggagcacacaggccggacttacccagcccccttctgtctccgtggcgcccggccagacagcccggattacctgcgggggaaacaatatcggcagcaagtccgttcattggtatcaacagaaacctgggcaggctcccgtgctggtcgtgtacgacgattctgaccgccctagcggaatcccggagagattctccggcagcaactctggcaatacggccacactcaccatctcccgggtggaagctggggatgaggccgactactattgtcaggtctgggatagctctagcgaccacgttgtgtttggaggcgggacaaagctgaccgtgctggga

SEQ ID NO: 43389 - RNA, 741 nt, synthetic construct
  misc_feature 1..741: note = derived and/or modified sequence opt5 from anti-influenza_Chain
  source 1..741: mol_type = other RNA
cagatgcaactggtgcagagcggcgccgaggtcaagaaacccgggtcctctgttaaggtgagctgcaaggcttccggaggcaccttctctagctacgccatcacatgggtgagacaggcgcctgggcagggactcgaatggatgggcgggattatcggaatgtttggctccacgaactatgctcaaaatttccagggccgggtcaccattacagccgacgagtctaccagcacagcctacatggaactgtccagccttcgctctgaggataccgctgtgtattactgtgccagatccacagggtattacccggcttatctgcaccattggggacagggcaccctcgttacggtgagctctgggaccggaggctccgggggaacaggcagcggcaccgggggatctacacagtccgccctgacccaaccccggagcgtctccggctctcctgggcagagcgtgacgatctcctgcacaggaaccagctctgacgttggcgggtacaactacgtgtcctggtatcagcagcaccccggaaaagcgcctaaacttatgatttacgatgtcagcaagcgcccctctggcgtgcctgacagatttagcggctccaagtctgggaatacagccagcctgaccatctccggactccaagctgaagatgaggccgactattactgtagctcttatacctccagctctacacatgtgttcggcacggggaccaaagtcacagttctggga

SEQ ID NO: 43390 - RNA, 744 nt, synthetic construct
  misc_feature 1..744: note = derived and/or modified sequence opt5 from anti-influenza_Chain
  source 1..744: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacctcttacgtgcttacacaacctccctccgctagcggcacccctgggcagcgcgtcacgatttcttgctccggaagcacattcaacatcggctccaatgccgtggactggtatagacagctgccggggaccgcgcccaaactcctgatctactctaacaatcagcggcctagcggagtgcccgatcgcttttccggcagcagatctggcacatccgccagccttgctatttctgggctgcaaagcgaggacgaagccgattactattgtgctgcctgggacgatatcctcaacgtccctgttttcggaggcgggaccaagctgaccgtgctggga

SEQ ID NO: 43391 - RNA, 744 nt, synthetic construct
  misc_feature 1..744: note = derived and/or modified sequence opt5 from anti-influenza_Chain
  source 1..744: mol_type = other RNA
caggtgcaactggtccagagcggcgccgaggttaagaaacccgggtcctctgtgaaggtgagctgcaaggcttccggaggccctttcagatcttacgccatcagctgggtccggcaggcgccggggcagggacccgaatggatgggcgggattatccctatttttggaaccacaaaatatgctcccaaattccaaggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacccagtctgctcttacacagcctgccgcggtgtccggcagccccgggcaatctattaccatctcctgcacgggaacaagctccgacgtcggcgggtacaactatgtgtcttggtaccagcagcatcctggaaaagccccgaagctgatgatctacgaagtgagcaatcgcccctccggcgtcagcaacagattctctggctccaaaagcgggaataccgcttctctcacaattagcggactgcaggccgaggatgaggctgactattactgttcctcttataccagctccagcacctacgtttttggcacagggacgaaggtgaccgtgcttgga

SEQ ID NO: 43392 - RNA, 744 nt, synthetic construct
  misc_feature 1..744: note = derived and/or modified sequence opt5 from anti-influenza_Chain
  source 1..744: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacctcttacgtgcttacacaacctccctccgtcagcggcacccctgggcagcgcgtgacgatttcttgctccggaagcagatccaacgtgggcgacaattctgtctattggtaccagcatgttccggagatggctcccaaactgctcgtgtacaagaacacacagcggcctagcggggtgcccgcccgcttctccggaagcaaatctggcacctccgcgagcctggccatcatcggccttcaatctggggatgaagctgactattactgtgtcgcctgggatgacagcgtggatggatatgtttttggctccgggacaaaggtgaccgtcctggga

SEQ ID NO: 43393 - RNA, 744 nt, synthetic construct
  misc_feature 1..744: note = derived and/or modified sequence opt5 from anti-influenza_Chain
  source 1..744: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacctcttacgtgcttacacaacctccctccgctagcggcacccctgggcagcgcgtcacgatttcttgctccggaagctcctctaacatcggcagcaattatgtgtactggtaccagcagctgccggggacagcccccaaactcctgatctatagagacggacaacggccttccggcgtgcccgatcgcttcagcggctctaagtccgggaccagcgcgtctcttgccattagcggactgagatccgacgatgaggctgactactattgtgccacatgggatgacaacctctctggccctgtctttgggggaggcaccaaactgaccgttctgggg

SEQ ID NO: 43394 - RNA, 744 nt, synthetic construct
  misc_feature 1..744: note = derived and/or modified sequence opt5 from anti-influenza_Chain
  source 1..744: mol_type = other RNA
gaggtgcagctggtcgaaagcggcgccgaggttaagaaacccgggtcctctgtgaaggtgagctgcaaggcttccggaggcaccttctctttttacagcatgtcctgggtcagacaagcccctgggcagggactcgaatggatgggcgggatcattccgatgttcggaacaacgaactatgcgcagaaatttcagggccgggtgaccatcacagctgttgagtctaccagcacagcctacatggaagtgtccagcctgcgctctgaggacaccgccgtctattactgtgctagaggcgataaagggatttattactattacatggacgtgtggggaaagggcacaaccgttacggtgtccagcgggaccggaggctctgggggaacaggctccggcaccgggggaagcacacaatctgcccttacccagcccgcttccgtcagcggctcccctgggcagtctatcacgattagctgcacaggaacctccagcgatgtgggcgggtacaattatgtgtcttggtaccagcaacaccccggaaaggcccctaaactgatgatctatgaggtctccaaccggcccagcggcgtttctaatcgcttcagcggctccaagtctgggaacacagcgagcctcaccatctccggactgcaggccgaagacgaggctgattactattgtagctcttacacctccagctctacacttgtgtttggcacggggaccaaagtgacagtcctggga

SEQ ID NO: 43395 - RNA, 744 nt, synthetic construct
  misc_feature 1..744: note = derived and/or modified sequence opt5 from anti-influenza_Chain
  source 1..744: mol_type = other RNA
atgagcctgttcggcgacaccatcgcctacctcctgtcccttattgaggatggggaaggaaaggctgagctggccgaaaaactccactgctggtttggcgggaaggagttcgacctggattctgcgcttgaatggatcaaaaacaagagatgtctgacagacattcagaaagctctcatcggagccagcatttgctttctgaagcccaaggatcaagagcggaaacgcagattcatcacggagcctctgtccggcatggggaccacagccaccaagaaaaagggactcatcctggctgaacggaaaatgcgcagatgtgtgtcttttcatgaggccttcgaaattgctgagggccacgagagctccgcccttctgtattgcctcatggtcatgtacctgaatccggaaaactattctatgcaggttaaacttggcacactgtgtgcgctctgcgagaagcaggccagccattcccaccgggctcatagccgcgccgctagatcttccgtgcccggggtgcggcgcgaaatgcagatggtcagcgccatgaataccgcgaagacaatgaacggaatgggcaagggggaggacgtgcaaaaactggccgaggaactgcagaataacatcggagttctcagatctctgggcgcttcccagaagaatggggagggaattgccaaagatgtgatggaagtccttaagcagagctctatgggcaactccgctctggtgcggaaatacctc

SEQ ID NO: 43396 - RNA, 747 nt, synthetic construct
  misc_feature 1..747: note = derived and/or modified sequence opt5 from anti-influenza_Chain
  source 1..747: mol_type = other RNA
gaggtgcagctggtcgaaagcggcgccgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgggacgggaggctctgggggaaccggctccggcacagggggaagcacccaatctgtgcttacacagcctccctccgtcagcgctgcccctggccagaaagtgaccatttcttgctccgggagctcctctaacatcggaaatgactacgtgagctggtatcagcaactgccgggcacggcgcccaagctcctgatctacgataacaataaacgcccttccgggattcccgacagattcagcggatctaagtccggcacaagcgccacccttggcatcacagggctgcagaccggagatgaggctaactactattgtgccacctgggaccggcgccctacagcttacgtcgtttttggcgggggaacgaaactcaccgtgctgggc

SEQ ID NO: 43397 - RNA, 750 nt, synthetic construct
  misc_feature 1..750: note = derived and/or modified sequence opt5 from anti-influenza_Chain
  source 1..750: mol_type = other RNA
caggtgcaactggtccagagcggcgccgaggttaagaaacccgggtcctctgtgagagtgagctgcaaggcttccggatctatcttccggaactacgccatgagctgggtccgccaggcgcctggccaggggctcgaatggatgggaggcattatcgctatttttgggaccccgaaatatgcccaaaagttccagggaagagtgacaatcacggccgacgagtccacctctacagtttacatggaactgagcggccttcggtccgaggataccgctatgtattactgtgcccgcattccccactataattttggcagcgggtcttacttcgactattggggacagggcacactggtgaccgtctccagcgggacaggaggctctgggggaaccggctccggcaccgggggaagcacgacagtgctcacccagcctccctctgtttccggcgctcctgggcaaagagtgacaatcagctgcaccggatcctctagcaacatcggcgccgggtacgatgtccattggtaccagcagctgcccggaacggcgcctaaacttctgatttatggcaattccaaccggccgagcggcgtgcccgaccgcttttctgggtccaagagcggaacatctgccaccctcggcatcacagggctgcagaccggagatgaagctgactactattgtggcacctgggatagctccctgtctgcctacgtgttcgggacaggcacgaaggtcaccgttctcgga

SEQ ID NO: 43398 - RNA, 756 nt, synthetic construct
  misc_feature 1..756: note = derived and/or modified sequence opt5 from anti-influenza_Chain
  source 1..756: mol_type = other RNA
gaggtgcagctggtcgaaagcggcgccgaggttaagaaacccgggtcctctgtgaaggtgagctgcaaagcctccggacacatcttctctggctacgccattagctgggtcagacaagcgcctgggcagggactcgaatggatgggcgggatcattccgatctttggaaccacaaactatgctcagaagttccagggccgggtgacgattaccgccgaccaatccacatctaccgcctacatggatctgagcaatcttcgctccgaggacacagctgtttattactgtgccagagtgaaagatggctattgcaccctgacaagctgtcccgtcgggtggtactttgacctctggggacggggcaccctggtgacggtttcttccgggaccggaggcagcgggggaacaggctctggcaccgggggatccacagaaatcgtgatgacccagagccctggcacgctttctctgtcccccggggagcgcgctacactcagctgcagagcctcccagtctgtcagctccagctatctggcgtggtaccagcaaaagcctggacaggctccccggctgctcatcttcggcgcttcttcccgcgccaccgggattcctgatagatttagcggatctggcagcggcacagacttcaccctgaccatctcccggcttgagccggaagattttgctgtgtactattgtcagcagtacgggtctagcctgacattcggaggcgggacgaagctcgagattaaacgc

SEQ ID NO: 43399 - RNA, 768 nt, synthetic construct
  misc_feature 1..768: note = derived and/or modified sequence opt5 from anti-influenza_Chain
  source 1..768: mol_type = other RNA
caggtgcaactggtccagagcggcgccgaggttaagaaacccgggtcctctgtgaaggtgagctgcaaggcttccggaggcttcttttctagctacgccatctcctgggtcagacaggcgcctgggcagggactcgaatggatgggcggggtgattccgatcttccggaccgctaactatgcccaaaattttcagggacgcgttacaattacggccgacgagttcacctcttacatggaactgagctcccttagaagcgatgacacagctgtgtattactgtgcccggctgaactatcacgattctggcacctactataatgctccccgcggctggtttgacccttgggggcagggaacactcgtcaccgtgtccagcggcacagggggatctggcgggaccggatccggcacgggcgggagcaccgatatccagatgacacaatctcccgactccctggccgttagccttggagagaaagcgaccattaactgcaaatcctctcagagcatcctcaattccagcaacaataagaactacctggcctggtaccagcagaagcctggccaaccccctaaactgctgatctattgggcttctacaagagaatccggggtgccggatcggttcagcggatctggcagcgggaccgactttacgctcacaatttcctctctgcaggccgaggatgtcgctgtgtactattgtcagcaatactatagctcccctcccaccttcggacagggcacaaaggtggagatcaaacgc

SEQ ID NO: 43400 - RNA, 768 nt, synthetic construct; identical to SEQ ID NO: 43399
  misc_feature 1..768: note = derived and/or modified sequence opt5 from anti-influenza_Chain
  source 1..768: mol_type = other RNA

SEQ ID NO: 43401 - RNA, 771 nt, synthetic construct
  misc_feature 1..771: note = derived and/or modified sequence opt5 from anti-influenza_Chain
  source 1..771: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgagttcattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttggggcattcaccactccaacgacgctgccgagcaaaccaagctgtatcagaatccgacgacctacatcagcgtgggaacatctaccctcaaccagcggctggttcccaaaatcgctacacgctccaaggtgaatggccagaacgggagaatggactttttctggaccattcttaagcctaatgatgccatcaactttgagagcaatggaaacttcattgcgcccgaatacgcctataaaatcgtcaagaaa

SEQ ID NO: 43402 - RNA, 771 nt, synthetic construct; identical to SEQ ID NO: 43401
  misc_feature 1..771: note = derived and/or modified sequence opt5 from anti-influenza_Chain
  source 1..771: mol_type = other RNA

SEQ ID NO: 43403 - RNA, 777 nt, synthetic construct
  misc_feature 1..777: note = derived and/or modified sequence opt5 from anti-influenza_Chain
  source 1..777: mol_type = other RNA
atggtgaaaagcaaatacctggtcttcatctccgtgttttctctcctgttcggcgtgtttgtggtcgggttcagccaccagggagtgaaggccgaggaagagagacccatgggcaccgctttttatgaatccttcgacgcctttgatgacgagcggtggtctaaagcgggggtttggacaaacggacaaatgttcaatgctacgtggtaccctgaacaggtgaccgccgatggccttatgcgcctgacaattgccaagaaaaccacaagcgctagaaactataaggccggggagctccggaccaatgacttttaccattatggactgttcgaggtctccatgaagccggctaaagtggaaggcacagtttctagctttttcacctacacgggcgagtgggattgggacggggatccctgggacgaaatcgatattgagtttcttggaaaggacaccacacgcatccagttcaactatttcaccaatggcgttgggggaaacgagttttactacgatctgggcttcgacgcctccgagagctttaatacatatgcgttcgaatggagagaagattctattacctggtacgtcaacggggaggccgtgcacacggctacagaaaatatccctcagacaccccaaaagatcatgatgaacctctggcctggagtgggcgtcgacggctggaccggggtttttgacggagataatacccccgtgtattcctactatgactgggtgcggtacacccctctgcagaactatcagattcatcag

SEQ ID NO: 43404 - RNA, 777 nt, synthetic construct; identical to SEQ ID NO: 43403
  misc_feature 1..777: note = derived and/or modified sequence opt5 from anti-influenza_Chain
  source 1..777: mol_type = other RNA

SEQ ID NO: 43405 - RNA, 783 nt, synthetic construct
  misc_feature 1..783: note = derived and/or modified sequence opt5 from anti-influenza_Chain
  source 1..783: mol_type = other RNA
gacatccagatgacccaaagcccctcctctgtgagcgcctccgtcggcgatagagttacaattacgtgccgggcttctcaggacatcagcacctggctggcctggtaccagcagaagcctgggaaagcgccgaagctcctgatttatgctgcctcctctcttcaaagcggagtgccctcccgcttcagcggctctgggtccggaacagattttaccctgacaatcagctctctccagcctgaggacttcgccacctacttttgtcagcaggctaactcctttccccctacattcggctgcgggaccaaactggaaattaagggaggcggcgggagcggaggcgggggatctggcgggggaggctccggcgggggaggcagcgaggtgcaacttgtcgtgtccgggggaggcctggttaaacccgggggatctctcagactgagctgtgccgcttccggcctgagcttcctcaatgcctggatgtcttgggtgcggcaggcgcctggcaagtgcctggaatgggtcgggcgcatcaagtccaacacggatggaggcaccacagactatgccgctccggtgaaagggagatttagcatctctcgggatgacagcaagaatatgcttttcctgcacatgtcctctctccgcaccgaggatacagccgtttactattgtgctaccgacggaccctacagcgatgactttagatccggctatgccgcgcggtaccgctacttcgggatggatgtgtggggccagggaacgacagtcaccgtgagctct

SEQ ID NO: 43406 - RNA, 783 nt, synthetic construct; identical to SEQ ID NO: 43405
  misc_feature 1..783: note = derived and/or modified sequence opt5 from anti-influenza_Chain
  source 1..783: mol_type = other RNA

SEQ ID NO: 43407 - RNA, 789 nt, synthetic construct
  misc_feature 1..789: note = derived and/or modified sequence opt5 from anti-influenza_Chain
  source 1..789: mol_type = other RNA
atgggcttcgtgctgtttagccagctcccctccttcctgcttgtctctaccctgctcctgtttcttgttatcagccactcctgcagagcccaaaacgggggatcttacccttataagagcggcgagtaccggacaaaatccttctttgggtatggatactatgaagtgcgcatgaaggctgccaaaaatgtgggcattgtctctagcttctttacgtacaccgggccgtccgacaacaatccctgggatgagatcgacattgagttcctgggaaaggatacaaccaaagtgcagtttaactggtataagaatggcgttggcgggaacgaatacctccataatctgggattcgacgcgagccaggattttcacacatacggcttcgaatggagacctgactatatcgatttttacgtggacgggaagaaagtctatcggggaacccgcaacattcccgtgacacctggcaagatcatgatgaatctgtggcccgggatcggagttgatgagtggctcggcagatacgacggccggacccctctgcaggctgagtatgaatacgtgaaatattacccgaacgggcgctctaaacttgtcgtgaatacgcccttcgtggccgtcttctccaactttgatagctctcaatgggagaaggccgactgggctaatggatccgttttcaactgtgtgtggaagcctagccaggtgaccttttctaatggcaagatgattctgacactcgatagagaatacgtcgaccatcaccatcaccaccataaagacgagctg

SEQ ID NO: 43408 - RNA, 789 nt, synthetic construct; identical to SEQ ID NO: 43407
  misc_feature 1..789: note = derived and/or modified sequence opt5 from anti-influenza_Chain
  source 1..789: mol_type = other RNA

SEQ ID NO: 43409 - RNA, 840 nt, synthetic construct
  misc_feature 1..840: note = derived and/or modified sequence opt5 from anti-influenza_Chain
  source 1..840: mol_type = other RNA
atggcccaggtgggcagaggggctagccccctgtcccgggcccgcgtccctccgctcccccaccctctggacggagagcatcttccccacgatcctgcgggcgggggacatggcaaggcttctagccaagacgcccccgttgggcagctgcctggacacctcgccagaccggctttctttcattacctgaaaaactccttccttgtgtgctctctgaccacagtgtttgccctcgctgtcgccacgttcgcgggctatgccctggctcggtttcgcttccccggcgccgaactgtttgggggaagcgtgctcgttacccaggtgatccctggcattctgttccttatccccatttacatcatgtatatttacgtccagaattgggtgagatccgctctggggctcgaggttcggctggtgggatcttatggcgggcttgtctttacatacaccgccttctttgtgcctctgagcatctggatcctccgcggattctttgcgtccattcccaaggaactggaggaagccgctatggtggatggcgccacaccgttccaggctttccacagagtcatcctgcctctcgccctgcccggccttgccgctaccgcggtttatatttttctgacagcctgggacgagctcctgttcgctcaagtgcttaccacggaggccaccgccacagtgcctgtcgggatccggaactttgtgggaaattaccagaaccgctacgatctggttatggctgccgcgaccgtggctacactccccgtcctggtgctgttctttttcgttcagagacaactcattcagggcctgaccgccggggccgtgaaagga

SEQ ID NO: 43410 - RNA, 840 nt, synthetic construct; identical to SEQ ID NO: 43409
  misc_feature 1..840: note = derived and/or modified sequence opt5 from anti-influenza_Chain
  source 1..840: mol_type = other RNA

SEQ ID NO: 43411 - RNA, 843 nt, synthetic construct
  misc_feature 1..843: note = derived and/or modified sequence opt5 from anti-influenza_Chain
  source 1..843: mol_type = other RNA
atggccgacaacatgaccacaacgcagatcgaggtgggccccggggctaccaatgccacaattaacttcgaagcgggaatcctggagtgctacgaaagatttagctggcaacgggctctcgattatcctggccaggaccgcctgcacagacttaagcggaaactggagtcccgcattaagacccataataaatctgaaccggagaacaagagaatgagcctcgaggaacggaaagccatcggggtcaagatgatgaaggttctgcttttcatggatccctccgccggaattgagggctttgaaccttactgtgtgaaaaatccctctacaagcaagtgccctaactatgactggaccgattatccccctacaccggggaaatacctggacgatatcgaggaggaacccgagaatgtggaccaccctatcgaagtcgtgctccgcgatatgaacaataaggacgctagacagaaaattaaggatgaggttaacacccagaaggaaggaaaattccggctgacgatcaagcgcgacattagaaatgtgctgtccctccgggtcctggtgaacggcacctttcttaaacatcccaatggcgataagtctctgagcacactccaccgcctgaacgcctacgaccaaaatgggggacttgttgctaaactggtggccaccgacgatagaacagtcgaggacgagaaggatggccatcggatcctcaactccctgttcgaacgctttgacgaggggcacagcaaacctattagagcggccgaaaccgctgtgggagtgctgtctcagttcggccaggagcaccggctctcccccgaagagggggataac

SEQ ID NO: 43412 - RNA, 843 nt, synthetic construct; identical to SEQ ID NO: 43411
  misc_feature 1..843: note = derived and/or modified sequence opt5 from anti-influenza_Chain
  source 1..843: mol_type = other RNA

SEQ ID NO: 43413 - RNA, 858 nt, synthetic construct
  misc_feature 1..858: note = derived and/or modified sequence opt5 from anti-influenza_Chain
  source 1..858: mol_type = other RNA
atgtgcaccatgcccctgatgaagctcaaaaagatgatgagacggacagccttcctgcttagcgtgctgatcggctgttccatgctcgggtctgaccgcagcgataaagctcctcactgggagctggtctggtccgacgaatttgattactctggacttccggaccccgagaagtgggattatgacgttggcgggcatggatggggcaaccaggaactgcaatactatacgagagcccggattgagaatgcgcgcgtcgggggaggcgtgctcatcattgaagctagacacgagccttacgagggccgggaatataccagcgcccgcctggtgacaagagggaaagcctcctggacctacggacggttcgagatccgcgctagactgccctctggccgggggacatggcctgccatttggatgctccccgatcgccagacctatggaagcgcttactggcctgacaacggcgaaatcgatatcatggagcatgtggggtttaatccggacgttgtgcacggaacagtccataccaaggcctacaaccatctgcttggcacgcagagaggcgggtccattcgggtgcccaccgcgcgcacagatttccacgtttatgccatcgagtggacccctgaagagattagatggtttgtggacgatagcctgtactatcggttccccaatgaaagactcacagaccctgaggctgactggcgccactggccctttgatcagccgttccacctgatcatgaacattgccgtcggaggcgcttggggagggcaacagggcgtggaccctgaagcctttcccgcgcagcttgtggtcgattacgttcgggtgtatagatgggtggag

SEQ ID NO: 43414 - RNA, 858 nt, synthetic construct; identical to SEQ ID NO: 43413
  misc_feature 1..858: note = derived and/or modified sequence opt5 from anti-influenza_Chain
  source 1..858: mol_type = other RNA

SEQ ID NO: 43415 - RNA, 900 nt, synthetic construct
  misc_feature 1..900: note = derived and/or modified sequence opt5 from anti-influenza_Chain
  source 1..900: mol_type = other RNA
aacgtgcccgagtggagctacatcgtcgaaaaggccaatcctgctaacgacctgtgctatccgggcaatttcaacgattacgaggaactcaaacatctgctttccagaattaatcactttgagaagatccaggggtatattcccgaagcccctcgggacggacaagcgtacgttcgcaaagatggcgagtgggtgctgctctctaccttcctgagaagcgacaagacacacacgtgtcccccttgccccgctcctgagcttctcgggggaccgtccgtgtttctgtttccccctaaacccaaggataccctgatgatctctcggacacctgaagtcacctgtgtggttgtggacgtcagccatgaggatcccgaagtgaagttcaactggtatgttgacggcgtggaggtccacaatgccaaaacaaagccgcgcgaggaacagtacaactccacctatagagtggtgtctgtcctgacagttctccatcaggattggctgaatgggaaagagtacaagtgcaaagtgagcaacaaggcccttcctgctcccattgaaaagaccatctccaaagccaagggacagcctcgggagccccaagtgtacacgctgccccctagccgcgaagagatgaccaaaaatcaggtctctctcacatgtctggtgaagggcttctatccgtccgacatcgctgttgagtgggaaagcaacggccagcccgagaataactacaaaaccacacctcccgtgcttgattctgacgggtcctttttcctgtatagcaagctcaccgtcgataaatctagatggcagcaaggaaatgtgttttcctgcagcgttatgcacgaagccctgcacaaccattacacgcagaagtccctgtctctcagccctggcaag

SEQ ID NO: 43416 - RNA, 900 nt, synthetic construct; identical to SEQ ID NO: 43415
  misc_feature 1..900: note = derived and/or modified sequence opt5 from anti-influenza_Chain
  source 1..900: mol_type = other RNA

SEQ ID NO: 43417 - RNA, 927 nt, synthetic construct
  misc_feature 1..927: note = derived and/or modified sequence opt5 from anti-influenza_Chain
  source 1..927: mol_type = other RNA
atggtgaacagacgggacctgatcaagtggagcgccgtcgctctcggcgccggggcgggactggctggccccgcccctgccgctcacgccgctgatcttgagtgggaacagtacccggttcccgccgcgcctgggggaaatcgctcctggcaactgctcccctctcatagcgacgatttcaactataccggcaaacctcagacatttagagggcggtggctggaccagcacaaggatggatggtccggccccgccaattctctttacagcgctcgccattcctgggtggccgacggcaacctgattgtggaggggagacgggctcctgatggacgcgtctattgcggctacgtgacgtctagaaccccggttgaatatcccctctacacagaggtgctgatgcgggtcagcgggctgaaactctccagcaatttctggctgctttctcgcgacgatgtgaacgaaatcgacgttattgagtgttatggaaatgagtccctgcacggcaagcatatgaacaccgcctaccacatctttcagagaaatcctttcacagaactcgcgcggagccaaaaagggtactttgccgatggatcttatggctacaacggcgagaccggacaggtgttcggggacggcgctgggcagcccctgcttcgcaatggatttcacagatatggcgtccattggatttccgccacagagttcgatttttacttcaacgggcggctggtgcgcagactcaatcggagcaacgacctgagagaccctcgctctcggtttttcgatcagcccatgcacctgatcctcaataccgaatcccatcaatggagagtggaccgcggaatcgagccgacggatgctgaactggccgaccctagcattaacaacatctattaccggtgggtcagaacctatcaggccgtt

SEQ ID NO: 43418 - RNA, 927 nt, synthetic construct; identical to SEQ ID NO: 43417
  misc_feature 1..927: note = derived and/or modified sequence opt5 from anti-influenza_Chain
  source 1..927: mol_type = other RNA

SEQ ID NO: 43419 - RNA, 960 nt, synthetic construct
  misc_feature 1..960: note = derived and/or modified sequence opt5 from anti-influenza_Chain
  source 1..960: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgagttcattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttggggcattcaccactccaacgacgctgccgagcaaaccaagctgtatcagaatccgacgacctacatcagcgtgggaacatctaccctcaaccagcggctggttcccaaaatcgctacacgctccaaggtgaatggccagaacgggagaatggactttttctggaccattcttaagcctaatgatgccatcaactttgagagcaatggaaacttcattgcgcccgaatacgcctataaaatcgtcaagaaaggcgattctgctattgtgaagtccgaggtggaatacgggaattgcaacacgaaatgtcaaacacctatcggagccatcaatagctccatgccctttcataacattcacccgctgaccatcggcgagtgccctaagtatgtcaaatctaataagctcgttctggctacagggctgcggaacagccccctc

SEQ ID NO: 43420 - RNA, 960 nt, synthetic construct; identical to SEQ ID NO: 43419
  misc_feature 1..960: note = derived and/or modified sequence opt5 from anti-influenza_Chain
  source 1..960: mol_type = other RNA

SEQ ID NO: 43421 - RNA, 960 nt, synthetic construct; identical to SEQ ID NO: 43419
  misc_feature 1..960: note = derived and/or modified sequence opt5 from anti-influenza_Chain
  source 1..960: mol_type = other RNA

SEQ ID NO: 43422 - RNA, 978 nt, synthetic construct
  misc_feature 1..978: note = derived and/or modified sequence opt5 from anti-influenza_Chain
  source 1..978: mol_type = other RNA
accctgtgcatcggctaccacgccaacaatagcacagacacggtggataccgtcctcgagaagaacgttacagtgacccattccgtgaatctgcttgaagacaaacacaacgggaagctgtgtaaactcagaggagtcgctcccctgcatcttggcaagtgcaatattgccgggtggatcctgggaaaccctgagtgtgaatctctcagcacagcgtcctcttggagctatattgtggagacctcctctagcgataatggcacatgctacccgggggacttcatcgattatgaggaactgcgggagcagctgtccagcgtttcttcctttgaacgcttcgagatttttcccaaaaccagctcttggcctaaccacgactccaataagggagtgacggctgcctgtccccatgccggcgctaagagcttctacaaaaacctcatctggctggtcaagaaaggcaattcttatcctaaactttccaagagctacatcaacgataaggggaaggaagtgctggttctctggggcattcaccacccctccacctctgccgaccaacagagcctgtatcagaatgctgatgcctacgtgtttgtcggaacatccagatacagcaaaaagttcaaacctgagatcgcgattcggccgaaggtgcgcgaccaggaggggagaatgaactattactggacccttgtggaacccggagataaaatcacatttgaggccaccggcaatctggtcgttcctcggtatgctttcgccatggaacgcgacgctgggtctggaattatcatttccgatacgcccgtgcatgactgcaacacaacctgtcaaacacctaagggcgccatcaacaccagcctcccctttcagaatatccacccgattaccatcggcaaatgccctaagtacgtgaagtctacaaaactgagactggcgacggggctccggaacgtccccagcattcagtcccgc

SEQ ID NO: 43423 - RNA, 978 nt, synthetic construct; identical to SEQ ID NO: 43422
  misc_feature 1..978: note = derived and/or modified sequence opt5 from anti-influenza_Chain
  source 1..978: mol_type = other RNA

SEQ ID NO: 43424 - RNA, 960 nt, synthetic construct; identical to SEQ ID NO: 43419
  misc_feature 1..960: note = derived and/or modified sequence opt5 from anti-influenza_Chain
  source 1..960: mol_type = other RNA

SEQ ID NO: 43425 - RNA, 990 nt, synthetic construct
  misc_feature 1..990: note = derived and/or modified sequence opt5 from anti-influenza_Chain
  source 1..990: mol_type = other RNA
atgtgcagctccatcccctctctgagagaggtgttcgccaacgactttcggattggcgctgccgtcaatcctgttaccctcgaagcgcagcaaagcctgcttatccgccacgtgaactccctgacagctgagaatcatatgaagttcgaacacctccagccggaggaagggagatttacgttcgatattgccatcaaatctagcacctcccccttttctagccatggagtgcggggccacacactggtctggcataaccagaccccttcctgggtgttccaggacagccaagggcactttgttggacgcgatgtgcttctggagagaatgaagtctcacatttccacagtcgtgcagcggtacaaaggcaaggtttattgttgggacgtgatcaatgaggccgtcgctgatgaagggagcgagtggctccgcagctccacctggagacagatcattggagacgatttcatccagcaagcctttctgtacgctcatgaagccgaccccgaggcgctcctgttctataacgattacaatgagtgctttcctgaaaaacgggagaagatttatacactggtgaagtctcttcgcgacaaaggcatccccattcacggcatcgggatgcaggcccattggtctctgaacagacctaccctcgatgaaattcgggctgccatcgagcgctacgcttccctgggagtgatccttcacattacggaactggacatcagcatgttcgagtttgatgaccacagaaaggacctcgccgcgccgaccaatgagatggtcgaacggcaggccgagcgctatgaacagattttctccctgttcaaagagtacagagatgttatccaaaacgtgacattttggggcattgctgacgatcatacctggctggaccacttccccgtgcaggggcggaagaattggcctctcctgtttgatgaacagcataaccccaaacctgccttctggagagtcgtgaatatc

SEQ ID NO: 43426 - RNA, 990 nt, synthetic construct; identical to SEQ ID NO: 43425
  misc_feature 1..990: note = derived and/or modified sequence opt5 from anti-influenza_Chain
  source 1..990: mol_type = other RNA

SEQ ID NO: 43427 - RNA, 1002 nt, synthetic construct
  misc_feature 1..1002: note = derived and/or modified sequence opt5 from anti-influenza_Chain
  source 1..1002: mol_type = other RNA
atgaagaacagagtgatcagcctgctcatggcctccctgcttctggtcctctctgttattgtggctcccttctacaaagccgaggcggctaccgtggtcaatacaccttttgtggccgttttcagcaactttgactcctctcagtgggaaaaggccgattgggctaatggcagcgtgttcaactgcgtctggaaaccgtcccaagtgacgttttctaatgggaagatgatcctgacccttgaccgggagtatggaggcagctacccctataaatccggggaataccgcacaaagagcttctttggatatggctactatgaggttagaatgaaggccgctaaaaacgtggggattgtctcttccttctttacctacacaggacctagcgataataacccctgggacgaaatcgatattgagttcctgggcaaggacaccacaaaagtgcagtttaattggtacaagaacggcgtgggaggaaatgagtatctccacaacctgggcttcgatgcctctcaggactttcatacctacgggttcgaatggcggcctgattatatcgacttctacgtcgatgggaaaaaggtttatcgcggcacgagaaatatccccgtgacccctgggaagattatgatgaacctgtggccgggaatcggcgtggacgagtggctcggccggtacgatgggcgcacacccctgcaggcggaatatgagtacgtcaaatactatcctaatggagtgccccaagacaaccctacccccacaccgaccattgccccttccacgcccacaaaccctaatcttcccctgaagggcgacgttaacggggatggacacgtgaatagctctgactactccctctttaaaagatatctgcttcgggtcatcgatcgcttccccgtgggcgaccagagcgttgctgatgtgaacagagacgggcggattgattccaccgacctgacaatgctcaagcgctacctgatcagagccattccttctctg

SEQ ID NO: 43428 - RNA, 1002 nt, synthetic construct; identical to SEQ ID NO: 43427
  misc_feature 1..1002: note = derived and/or modified sequence opt5 from anti-influenza_Chain
  source 1..1002: mol_type = other RNA

SEQ ID NO: 43429 - RNA, 1041 nt, synthetic construct
  misc_feature 1..1041: note = derived and/or modified sequence opt5 from anti-influenza_Chain
  source 1..1041: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgagttcattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttggggcattcaccactccaacgacgctgccgagcaaaccaagctgtatcagaatccgacgacctacatcagcgtgggaacatctaccctcaaccagcggctggttcccaaaatcgctacacgctccaaggtgaatggccagaacgggagaatggactttttctggaccattcttaagcctaatgatgccatcaactttgagagcaatggaaacttcattgcgcccgaatacgcctataaaatcgtcaagaaaggcgattctgctattgtgaagtccgaggtggaatacgggaattgcaacacgaaatgtcaaacacctatcggagccatcaatagctccatgccctttcataacattcacccgctgaccatcggcgagtgccctaagtatgtcaaatctaataagctcgttctggctacagggctgcggaacagccccctcggatacattcctgaagcgccccgcgacggccaggcctatgtgagaaaggacggcgagtgggtgctgctttccaccttcctg

SEQ ID NO: 43430 - RNA, 1041 nt, synthetic construct; identical to SEQ ID NO: 43429
  misc_feature 1..1041: note = derived and/or modified sequence opt5 from anti-influenza_Chain
  source 1..1041: mol_type = other RNA

SEQ ID NO: 43431 - RNA, 1047 nt, synthetic construct
  misc_feature 1..1047: note = derived and/or modified sequence opt5 from anti-influenza_Chain
  source 1..1047: mol_type = other RNA
atgaacatcaagaaaaccgccgtcaagagcgctctggccgtcgcggctgccgccgctgccctcacaacgaatgtttccgctaaagacttctctggcgccgagctgtacacccttgaagaggtgcagtatgggaagtttgaagcgagaatgaaaatggccgctgccagcggaacagtgtcctctatgttcctgtaccaaaacggcagcgagattgctgatgggcggccctgggtcgaagtggacatcgaggttctcggaaagaatcctggctcctttcagtctaacattatcaccgggaaggccggagcgcagaaaacaagcgagaagcaccatgccgtgtccccggctgccgatcaggctttccacacctatggcctggaatggacacccaattacgtccgctggaccgtggacggccaagaggttagaaaaacggaagggggacaggtgagcaaccttaccggcacacaggggctgcggtttaatctctggtcttccgagagcgccgcctgggtcggacagttcgatgagtctaagctgcctctgtttcaattcattaactgggtgaaagtgtataagtacacccccggccagggggaaggaggctccgactttacactcgattggaccgacaatttcgatacgtttgacggcagccgctgggggaagggagattggacattcgacggcaacagagtcgatctgaccgacaaaaatatctattctcgggacgggatgcttatcctggctctcacacgcaagggacaggagtcctttaacggccaggttcctagagatgacgaacccgcgcctcaaagctcctctagcgccccggcttcctctagctccgtgcccgccagctctagctccgtgcctgcctctagctccagcgctttcgtgcccccttcttccagctctgccaccaatgcgattcatgggatgcggaccacacccgctgtggccaaagagcaccgcaacctggttaatgccaagggagctaaagtgaacccgaacggccataagagataccgggtcaatttcgaacac

SEQ ID NO: 43432 - RNA, 1047 nt, synthetic construct
  misc_feature 1..1047: note = derived and/or modified sequence opt5 from anti-influenza_Chain
  source 1..1047: mol_type = other RNA
gaggtgcagctggtcgaaagcggcgggggagttgtgcaacccggcagatccctccggctgtcttgcgccgctagcgggttcgcctttcacaaccgcgcgatgcattgggtgagacaggctcctggaaagggccttgagtgggtcgccctgatctacttcgacgggtccaaacagtattacgccgattctgtgaagggacggtttaccattagccgcgacaattccaaaaacacagttttcctccagatgaatagcctgagaccggaagatacggctgtgtattactgtgccgtccccggccctatctttggcattttcccgccttggtcttattttgaccactgggggcaaggaatccttgtgaccgtttccagcgcttctacaaagggcccctccgtgttccctctggccccgagctctaaatccaccagcgggggaacagcggccctcggctgcctggtcaaggattactttcccgagcctgtgaccgtgtcttggaactccggggctctgacaagcggagtccataccttccccgccgttctccagtcctctggcctgtatagcctttccagcgtggtgacggtcccttcttccagcctgggcacccagacatacatttgtaatgtgaaccacaagccctctaataccaaagttgacaagaaagtggaacccaagagctgcgataaaacacatacctgtcctccctgccctgctcccgagctccttgggggaccctccgtctttctgttccctccgaagcccaaggacacgctgatgatctctcggacacctgaggtgacctgtgttgtggtcgatgtgagccacgaagaccccgaggtcaaatttaactggtacgtggatggcgttgaagtgcacaatgccaagacaaaacctcgcgaggagcagtataactccacctacagagtcgtgagcgttctcaccgtgctgcatcaagactggctgaatgggaaggaatataaatgcaaggtctctaacaaagcgctccccgccccgatcgagaagacaatttccaaggctaaagga

SEQ ID NO: 43433 - RNA, 1047 nt, synthetic construct; identical to SEQ ID NO: 43432
  misc_feature 1..1047: note = derived and/or modified sequence opt5 from anti-influenza_Chain
  source 1..1047: mol_type = other RNA

SEQ ID NO: 43434 - RNA, 1047 nt, synthetic construct; identical to SEQ ID NO: 43431
  misc_feature 1..1047: note = derived and/or modified sequence opt5 from anti-influenza_Chain
  source 1..1047: mol_type = other RNA

SEQ ID NO: 43435 - RNA, 1161 nt, synthetic construct
  misc_feature 1..1161: note = derived and/or modified sequence opt5 from anti-influenza_Chain
  source 1..1161: mol_type = other RNA
atgaacaagttcctgaataaaaagtggagcctcatcctgaccatgggcgggatttttcttatggccacactgtccctcatcttcgctacgggcaaaaaggcctttaacgaccagacctctgcggaggatattcccagcctggctgaagccttcagagactactttcctatcggagccgctattgagccggggtatacaaccggacaaatcgccgaactttacaaaaagcacgtgaatatgctggtcgctgagaacgccatgaagcccgcgtccctccagcctacagaaggcaatttccagtgggccgatgctgaccggatcgttcagtttgccaaagagaacgggatggagctgcgcttccataccctggtgtggcacaatcaaacacccaccggattttctctcgataaggaaggcaaacctatggtggaggaaacggacccccagaagagagaggagaaccggaaactgcttctgcagcgcctcgaaaattatattagagctgtcgtgctgcggtacaaggatgacatcaagagctgggatgttgtgaacgaggtcattgaacctaatgacccgggcgggatgcgcaactccccctggtatcagatcaccggaacagagtacattgaagtggccttcagagcgacccgggaggccggcgggtctgatatcaaactttatattaatgactacaacacagatgaccctgttaagcgcgacatcctgtacgagctcgtgaaaaatctgctggaaaagggagtccccatcgatggcgtggggcatcaaacccacattgacatctataaccctcccgtggagagaattatcgaaagcattaaaaagtttgctggactcggcctggataacatcatcacggagcttgacatgtccatttacagctggaatgatcggtctgactatggcgattccatcccggactacattctgacactccaggccaaacgctatcaggaactgttcgatgctcttaaggagaacaaggacatcgtcagcgccgttgtgttttgggggatttctgataaatactcctggctgaatggattccctgtgaagagaaccaacgctcccctcctgttcgaccggaattttatgcctaaacccgccttctgggcgatcgtcgaccccagccgcctgagagag

SEQ ID NO: 43436 - RNA, 1161 nt, synthetic construct; identical to SEQ ID NO: 43435
  misc_feature 1..1161: note = derived and/or modified sequence opt5 from anti-influenza_Chain
  source 1..1161: mol_type = other RNA

SEQ ID NO: 43437 - RNA, 1221 nt, synthetic construct
  misc_feature 1..1221: note = derived and/or modified sequence opt5 from anti-influenza_Chain
  source 1..1221: mol_type = other RNA
atgagaaacgtggtccggaagcccctgaccatcggcctcgccctgacacttctgctccctatggggatgacggctaccagcgccaaaaatgcggactcctacgctaagaaaccgcacatttctgccctgaacgctccccagcttgatcaacgctataagaatgagttcacaatcggagccgccgttgaaccttaccagctgcagaacgagaaagacgtgcagatgctcaagagacattttaatagcattgtggctgaaaacgtcatgaagcccatctccattcaacctgaggaaggcaaattcaattttgagcaggccgatcggatcgtgaagttcgcgaaagccaacgggatggacatccgctttcacaccctggtttggcattctcaggtgccccagtggttctttctggataaggagggaaaacctatggtcaatgaaacagacccggtgaagagagagcaaaacaagcagctcctgcttaaacggctggaaacccacattaagacaatcgttgagcgctataaagatgacattaagtactgggatgtggtcaatgaggtggtgggcgacgatgggaaactcagaaacagcccctggtatcagatcgctggaattgactacatcaaggtcgccttccaggctgcccggaaatatggcggcgataatattaagctgtacatgaacgactacaataccgaagttgagcctaagcgcacggcgctttataacctggtgaaacaactcaaggaagagggggtgcccatcgacggaatcggccatcagtcccacattcagatcgggtggccttctgaagccgagattgagaaaaccatcaacatgtttgctgccctgggactggataatcaaattacagaactcgacgtcagcatgtacggctggcccccgagagcttatcctacctacgatgccatccccaagcagaaattcctggaccaggccgctcggtatgatcgcctttttaagctgtacgagaagctctccgacaaaatcagcaacgtgacattctgggggattgcggataatcacacctggctggactctagagccgatgtttattacgacgctaacggaaatgtggtcgtggatcctaacgccccctacgccaaggttgaaaaaggcaagggcaaagacgctccctttgtgttcgggcctgactataaggtcaagccggcctactgggcgatcattgatcataaa

SEQ ID NO: 43438 - RNA, 1221 nt, synthetic construct; identical to SEQ ID NO: 43437
  misc_feature 1..1221: note = derived and/or modified sequence opt5 from anti-influenza_Chain
  source 1..1221: mol_type = other RNA

SEQ ID NO: 43439 - RNA, 1233 nt, synthetic construct
  misc_feature 1..1233: note = derived and/or modified sequence opt5 from anti-influenza_Chain
  source 1..1233: mol_type = other RNA
ctgagcagaatcaaccacttcgagaagattcagatcattcccaaatcctcttggagcgaccatgaagcctcctctggcgtgagctccgcttgcccttaccaagggaccccgagctttttccggaatgtcgtttggctcatcaagaaaaacaatacatatcccacgattaagcgctcttacaacaataccaaccaggaggatctgcttatcctgtggggaatccaccattccaatgacgccgcggaacagacaaaactctatcagaaccctaccacatacattagcgtgggcacctctacactgaatcaaagacttgtgcccaagatcgctacccggtccaaggtcaacgggcagaatggacgcatggactttttctggacgattctgaaacctaacgatgccatcaattttgagagcaacggcaatttcattgcccccgaatatgcttacaagatcgtgaaaaaggggtatattcctgaggccccgagagatggacaggcttacgttcggaaagacggcgagtgggtgctcctgtctacctttctgcgctccgataagacacacacctgtcccccttgccccgcccctgaactcctgggcgggcccagcgtcttcctttttccgcctaagcccaaagacacactgatgatctctagaacccctgaggtgacgtgtgttgtggtcgatgtgtcccatgaagaccccgaggtgaagttcaactggtacgtcgatggagttgaggtgcacaacgcgaaaacaaagccccgggaggaacagtataatagcacctaccgcgtggtctccgtgctcacagttctgcaccaagactggcttaacggcaaagaatataagtgcaaagtgtctaataaggccctgcctgctccgatcgagaagaccattagcaaagccaaggggcagcccagagaacctcaggtctacaccctgcccccttcccgggaggagatgacaaagaaccaggtgagcctcacgtgtctggttaagggattttatccctctgatatcgctgtggaatgggagtccaatggccaaccggaaaacaattacaaaaccacacctcccgtcctcgacagcgacgggtctttctttctgtatagcaaacttaccgtggataagtcccgctggcagcagggaaacgtcttctcttgcagcgtgatgcatgaggccctgcacaatcattacacacaaaaatccctcagcctgtctcctggcaag

SEQ ID NO: 43440 - RNA, 1233 nt, synthetic construct; identical to SEQ ID NO: 43439
  misc_feature 1..1233: note = derived and/or modified sequence opt5 from anti-influenza_Chain
  source 1..1233: mol_type = other RNA

SEQ ID NO: 43441 - RNA, 1293 nt, synthetic construct
  misc_feature 1..1293: note = derived and/or modified sequence opt5 from anti-influenza_Chain
  source 1..1293: mol_type = other RNA
atggacgatcacgccgagaagttcctgtggggcgtggctaccagcgcctaccagatcgaaggggcgacacaagaggacggaagaggcccctccatttgggatgcttttgcccggcgccctggggccatcagagacggatctacgggcgaaccggcttgcgatcattatcggcgctacgaggaagacattgccctcatgcagagcctgggggtcagagcttatcggttctccgttgcctggccccgcatccttcctgagggaagaggccggattaaccccaaaggcctggcgttttacgatcgcctcgtggacagactgcttgcctctgggatcacccctttcctgacactctatcactgggatctgcccctggctctcgaggaacggggaggctggcgcagcagagagaccgcctttgctttcgccgaatacgcggaggccgtggctcgggccctggctgaccgcgtcccgtttttcgccacacttaatgagccttggtgttccgcctttctggggcattggaccggagaacacgctcccggcctcagaaacctggaggcggcccttcgggctgcccatcatctgctcctggggcacggactggccgtggaagctctcagagccgcgggcgctcgccgggttggcatcgtgctgaatttcgcccctgcctatggggaggatcccgaagctgtcgacgtggccgatagataccacaaccgctactttcttgaccctattctgggaaagggctatcccgagtctccgttccgggaccctccccctgttcccatcctcagcagagatctggagcttgtggctcgccccctggactttctcggggtcaattactatgcccctgtgcgggtggcgccgggaacaggcaccctgcccgtcagatacctgcctcccgaagggcctgccacggctatgggatgggaggtttatcccgaaggcctccaccatctgcttaaacgcctgggccgggaggtgccgtggcctctctacgtgaccgaaaacggggccgcttatcccgatctgtggacaggagaggccgtcgtggaggaccctgaaagagttgcgtaccttgaggcccacgtggaagctgccctgcgcgctcgggaggaaggcgtcgatctcagagggtacttcgtgtggtccctgatggacaatttcgagtgggcctttggatatacccggcgcttcggcctgtactatgttgattttcccagccagagacggattcctaagagatctgccctctggtaccgcgagcggatcgctagagcgcagaca

SEQ ID NO: 43442 - RNA, 1293 nt, synthetic construct
  misc_feature 1..1293: note = derived and/or modified sequence opt5 from anti-influenza_Chain
  source 1..1293: mol_type = other RNA
atgaccgagaacgccgaaaagttcctgtggggcgtggctacaagcgcctaccagatcgagggggcgacgcaagaagacggaagaggcccctccatttgggatgcttttgcccagcggcctggggccatccgcgacggatctaccggcgagccggcttgcgatcactatagacggtacgaagaggacattgccctcatgcagagcctgggggtccgcgcttatagattctccgttgcctggccccggatccttcctgagggacgcggcagaattaatcccaaaggcctggcgttttacgatcggctcgtggaccgcctgcttgcctctgggatcacacctttcctgaccctctatcattgggatctgcccctggctctcgaagagagaggaggctggcggagccgcgaaacagcctttgctttcgccgagtacgcggaggccgtggctagagccctggctgaccgggtcccgtttttcgccacccttaacgaaccttggtgttccgcctttctggggcactggacaggagagcatgctcccggcctccgcaatctggaagcggcccttagagctgcccaccatctgctcctggggcacggactggccgtggaggctctccgggccgcgggcgctagacgcgttggcatcgtgctgaacttcgcccctgcctatggggaagatcccgaggctgtcgacgtggccgatcggtaccacaatagatttttccttgaccctattctgggaaagggctaccccgagtctccgtttcgcgatcctccccctgttcccatcctcagccgggacctggaacttgtggctagacccctggacttcctcggggtcaactattacgcccctgtgcgcgtggcgccgggaaccggcacgctgcccgtccggtatctgcctcccgaggggcctgccaccgctatgggatgggaagtttaccccgagggcctctatcatctgcttaaaagactgggccgcgaagtgccgtggcctctctacgtgacagagaatggggccgcttatcccgatctgtggaccggagaggccgtcgtggaagaccctgagcgggttgcgtaccttgaagcccacgtggaggctgccctgagagctcgcgaagagggcgtcgatctccgggggtacttcgtgtggtccctgatggacaactttgagtgggccttcggatatacaagacggtttggcctgtactatgttgatttccccagccagcgccggattcctaagagatctgccctctggtacagagaacgcatcgctcgggcgcaaacc

SEQ ID NO: 43443 - RNA, 1293 nt, synthetic construct
  misc_feature 1..1293: note = derived and/or modified sequence opt5 from anti-influenza_Chain
  source 1..1293: mol_type = other RNA
atggccgagaacgctgaaaagttcctgtggggcgtggccaccagcgcgtaccagatcgagggggctacacaagaagacggaagaggcccctccatttgggatacgtttgcccggcgccctggggccatcagagacggatctaccggcgagccggcttgcgatcactatcatcggtacgaagaggacattgccctcatgcagagcctgggggtcggagtttatcgcttctccgtggcttggcccagaatccttcctgagggccggggccgcattaatcccaaagggctggccttttacgatagactcgtggaccggctgcttgcggccggaatcacacctttcctgaccctctatcactgggatctgccccaggctctggaagaccgcggcgggtggagatctcgggagacagcctttgctttcgccgaatacgcggaggccgtcgctcgcgccctcgctgatagagtgccgtttttcgccaccctgaacgagccttggtgtagcgcctttcttggacattggacaggcgaacacgctcccgggctgcggaatctcgaggcggccctgcgcgctgcccatcaccttctgctcggacacggcctggccgttgaagctctgagagccgcgggcgctaagcgggtggggatcgtcctcaacttcgcccctgtgtatggagaggaccccgaagccgttgatgtggctgacagataccataatcgctactttctggatcctattcttggccgggggtatcccgagtccccgttccaggaccctccccctacccccaacctgtctagagacctcgagctggtcgcccgcccccttgattttctgggagtgaattactatgctcctgtgcgggtcgccccgggcacggggcccctccctgttagatacctgccccctgaaggacccgtgaccgcgatgggctgggaggtgtatccggaaggcctgtaccacctcctgaaacgccttgggcgggaggtcccttggcccctgtatatcacagaaaacggagccgcttaccctgacctctggaccggcgaggccgtggttgaggatcccgaaagagtggcttacctggaggcccatgtcgaagcggcccttcgcgctcgggaggaaggggtggacctgagaggatatttcgtttggagcctcatggataatttcgagtgggcctttggctacacacgccggttcgggctgtattacgtggactttccttcccaaagacggattcccaagcgcagcgctctgtggtatagagagcggatcgccagagcccagctc

SEQ ID NO: 43444 - RNA, 1293 nt, synthetic construct; identical to SEQ ID NO: 43441
  misc_feature 1..1293: note = derived and/or modified sequence opt5 from anti-influenza_Chain
  source 1..1293: mol_type = other RNA

SEQ ID NO: 43445 - RNA, 1293 nt, synthetic construct; identical to SEQ ID NO: 43442
  misc_feature 1..1293: note = derived and/or modified sequence opt5 from anti-influenza_Chain
  source 1..1293: mol_type = other RNA

SEQ ID NO: 43446 - RNA, 1293 nt, synthetic construct; identical to SEQ ID NO: 43443
  misc_feature 1..1293: note = derived and/or modified sequence opt5 from anti-influenza_Chain
  source 1..1293: mol_type = other RNA

SEQ ID NO: 43447 - RNA, 1296 nt, synthetic construct
  misc_feature 1..1296: note = derived and/or modified sequence opt5 from anti-influenza_Chain
  source 1..1296: mol_type = other RNA
atgttcaagcccaactaccactttttccctatcaccggctggatgaatgacccgaacgggctgatcttttggaaaggaaagtatcatatgttctaccagtataatcccagaaaacctgagtggggcaacatttgctgggggcacgccgtgagcgatgacctcgtccattggcggcaccttcccgttgctctttaccctgatgacgaaacacatggagtgttttccggctctgccgtggagaaggatgggaaaatgttcctggtctatacgtactatcgcgaccccacccacaataagggagaaaaggagacacaatgtgtggcgatgagcgaaaacggcctcgattttgttaaatacgacggcaatcctgtgatttccaagccgcccgaggaggggacccacgctttcagagatcctaaagtcaaccggtctaatggagaatggcgcatggtgctgggcagcgggaaggacgagaaaatcggaagagttcttctgtacacatccgatgacctctttcattggaagtatgaaggcgtgattttcgaggatgagaccacaaaggaaatcgagtgccccgacctggtccggatcggggaaaaagacattctgatctactctattaccagcacgaactccgtgctctttagcatgggagagctgaaggaaggcaaacttaatgtggagaagcgcggcctgctcgatcacgggaccgacttctatgccgcccagacatttttcggaaccgatagagtcgttgtgatcggctggctgcagtcttggcttcggacagggctgtaccctaccaaacgcgagggatggaacggcgtgatgtccctccccagagaactgtatgtcgagaataacgaactgaaggtgaaaccggttgacgagctcctggctctgcggaagcgcaaggtgttcgaaacggccaaaagcgggacatttctgctcgatgtcaaggaaaattcttacgagattgtgtgtgagttctccggagagatcgaactgagaatgggcaacgagagcgaagaggttgtgattaccaaatctcgggacgagcttatcgtcgatacaacccgctccggcgtgagcgggggagaagtcagaaagtccaccgtggaggacgaagctacaaaccggatcagagcctttctggattcttgcagcgttgagttctttttcaatgactccattgcgtttagcttccgcatccatcctgagaacgtgtataatattctctctgtcaaatccaaccaggtgaagctggaagtttttgagctggaaaatatctggctc

SEQ ID NO: 43448 - RNA, 1296 nt, synthetic construct; identical to SEQ ID NO: 43447
  misc_feature 1..1296: note = derived and/or modified sequence opt5 from anti-influenza_Chain
  source 1..1296: mol_type = other RNA

SEQ ID NO: 43449 - RNA, 1323 nt, synthetic construct
  misc_feature 1..1323: note = derived and/or modified sequence opt5 from anti-influenza_Chain
  source 1..1323: mol_type = other RNA
gaggtgaagctggtcgaaagcggcgggggactcgttcagcccggcgggtccctgagactttcttgcgccaccagcggattcacattttccgactactatatgtcttgggtgcggcaaagccctggcaaagctctggagtggctcgggttcacgcgctccagagtgctgggatacaccacagattattctgccagcgtcaagggccggtttaccatctcccgcgacaacagccagtctattctttacctgcagatgaactccctcagaggcgaagatagcgcgacatattactgtgctcgggaccgcccgatggattattgggggcagggaacctctgtgacagtttccagcgccaaaaccacgcccccttctgtgtaccccctggcccctggctccgctgcccaaaccaatagcatggtcacactggggtgcctcgtgaagggatacttccccgagcctgttaccgtgacatggaactccggctctctgagctccggggtccacacctttccggctgtgcttcagagcgacctgtatacgctctcttccagcgtgacagtcccctctagcacctggccttccgaaacagttacctgtaatgtggcccatcccgcgtctagcaccaaagtggataagaagatcgtccctagagactgcggatgtaaaccctgcatttgtacagtgccggaggtttccagcgtgttcatctttcctcccaagcctaaagatgtcctgacgattacccttacacccaaggtgacctgcgttgtggtcgacatctctaaagatgaccccgaggtgcagttctcctggtttgtcgatgacgtggaagttcacacagcccagacccaacctcgggaggaacagttcaatagcacgtttcgctctgtgtccgagctgccgatcatgcatcaggactggctcaacggcaaggagttcaagtgtagagtcaatagcgctgcctttcccgctcctattgagaaaacaatctccaagaccaaaggccggcccaaggcccctcaggtgtacaccattcccccgcctaaagaacaaatggcgaaggataaagtttctctgacatgcatgatcaccgacttcttccccgaagatattacagtggagtggcagtggaacgggcagcctgccgaaaattataagaacacgcaacccatcatggacaccgatggaagctactttgtctattccaagctgaatgtgcagaaatctaactgggaggctggcaatacattcacctgtagcgtgctccacgaggggctgcataaccaccacacagaaaagtcccttagccattctcctggaaaa

SEQ ID NO: 43450 - RNA, 1323 nt, synthetic construct; identical to SEQ ID NO: 43449
  misc_feature 1..1323: note = derived and/or modified sequence opt5 from anti-influenza_Chain
  source 1..1323: mol_type = other RNA

SEQ ID NO: 43451 - RNA, 1329 nt, synthetic construct
  misc_feature 1..1329: note = derived and/or modified sequence opt5 from anti-influenza_Chain
  source 1..1329: mol_type = other RNA
gaggtgcagctgcaacagagcggccccgaactcgtcaagcctggggcctccgttaaaatgtcttgcaaggctagcggatacaccttcacatcctatgtgatgcactgggtgaaacagaagccgggccaggggctggagtggatcggatacattaacccctataatgacggcacgagatacaacgaaaaatttcgggtcaaggccacccttacatctgataagagctcctctaccgcgtatatggagctgagctccctcacaagcgaagactctgctgtgtactattgtgcccgcagagggctgatcaccacacctacccttgattactggggacaaggcacgaccctgacagtttccagcgccaaaaccacacccccttctgtgtaccccctcgctcctggctccgccgctcagaccaatagcatggtcacgctggggtgcctggtgaagggatatttcccggagcccgttacagtgacctggaactctggctccctcagctccggggtccatacatttcctgccgtgctgcagtctgacctttacaccctgagctccagcgtgaccgtcccctcttccacatggcctagcgagacggttacctgtaatgtggcgcaccccgcctctagcacaaaagtggataagaaaattgtcccgcgggactgcggatgtaagccttgcatctgtaccgtgcccgaagtttcctctgtgttcatttttcctcccaagcccaaagatgtcctcacaatcaccctgacgcctaaggtgacatgcgttgtggtcgacatcagcaaagatgacccggaggtgcagttctcctgggtcgatgacgtggaagttcataccgctcaaacccagccccgcgaggagcagtttaacagcacattcagatctgtgtccgaacttcctattatgcaccaggattggctgaatggcaaggagtttaaatgtcgggtcaacagcgccgctttccccgcccctatcgaaaagaccatttctaaaacaaaggggcgccccaaggcgccgcaagtgtatacgatccctccccctaaagagcagatggccaaggacaaagtttccctgacctgcatgattacagactttttccccgaagatatcaccgtggagtggcagtggaatggacaacctgctgagaactacaagaatacacagcccattatggacaccgatggcagctattttgtctactccaaactcaacgtgcagaagtctaattgggaagccggcaacacgttcacctgtagcgtgctgcatgaggggctccacaatcaccatacagaaaagtccctgtctcacagcccgggaaaa

SEQ ID NO: 43452 - RNA, 1329 nt, synthetic construct; identical to SEQ ID NO: 43451
  misc_feature 1..1329: note = derived and/or modified sequence opt5 from anti-influenza_Chain
  source 1..1329: mol_type = other RNA

SEQ ID NO: 43453 - RNA, 1332 nt, synthetic construct
  misc_feature 1..1332: note = derived and/or modified sequence opt5 from anti-influenza_Chain
  source 1..1332: mol_type = other RNA
aacgtgcccgagtggagctacatcgtcgaaaaggccaatcctgctaacgacctgtgctatccgggcaatttcaacgattacgaggaactcaaacatctgctttccagaattaatcactttgagaagatccaaattatccccaaatctagctggtccgaccacgaagcctctagcggggtttcctctgcgtgtccttatcaaggaacccccagcttctttcggaacgtggtgtggctgattaagaaaaataacacataccctacgatcaagcgctcctataataacaccaatcaggaggatctcctgatcctttggggcattcatcacagcaacgacgctgccgagcagacaaagctgtaccagaatcccaccacatatatctctgtcgggacctccacactcaaccaaagactggtgcctaaaattgccacccggagcaaggttaatggacagaacggccgcatggatttcttttggacgatcctgaaaccgaacgacgctattaatttcgaatctaacgggaattttatcgcccccgagtacgcttacaagattgtgaaaaagggatatatccctgaagcccccagagatggccaggcgtacgtccggaaggacggcgagtgggtgctcctgtccaccttccttcgcagcgataaaacacatacctgccctccctgtccggcccctgagctgctcgggggaccctctgtttttctgttccctcccaagcccaaagacacacttatgatctccagaacccctgaagtgacgtgcgtcgtggtggatgtcagccacgaggacccggaagttaagtttaactggtatgtggatggcgtggaggtccacaatgctaaaacaaagccccgggaggaacagtacaactccacctatcgcgtggtttctgtgctgacagtcctccatcaagactggctgaatgggaaagagtacaagtgtaaggtgagcaacaaagccctgcctgctcccattgaaaagaccatctccaaagccaagggacagcctagagagccccaggtttataccctcccgcctagccgggaagagatgacgaaaaatcaggtgtctctgacatgccttgtcaagggcttctacccctccgacattgcggtggaatgggagagcaacgggcaacctgagaataactacaagaccacaccccctgtcctggattctgacggcagctttttcctctattccaaactgaccgtggataagtctcgctggcagcagggaaatgttttcagctgttccgtgatgcacgaagcccttcataaccactacacacagaaaagcctgtctctctcccccggcaag

SEQ ID NO: 43454 - RNA, 1332 nt, synthetic construct; identical to SEQ ID NO: 43453
  misc_feature 1..1332: note = derived and/or modified sequence opt5 from anti-influenza_Chain
  source 1..1332: mol_type = other RNA

SEQ ID NO: 43455 - RNA, 1341 nt, synthetic construct
  misc_feature 1..1341: note = derived and/or modified sequence opt5 from anti-influenza_Chain
  source 1..1341: mol_type = other RNA
caggtgcaactgcaggagagcggccccgggctcgtcaagccttccgaaaccctgtctcttacatgcacggttagcggaggcctgatcgggaccggatcctactattggggctggattagacagacaccggggaaaggaatggagtggatcggctctattagctactccggctctacctattaccaccccagcctcaagtcccgggtgacaatcagcgacgatacctctaaaaaccagctgttccttaagctgcgctccgtgacagccgctgacaccgcccaatattactgtgcgagatataattgggggattcggtactttgatttctggggacgcggcacgctcgtcaccgtgagctctgcttccacaaaagggcctagcgtttttcccctggccccttgctctagatccaccagcgaatccacagccgctctgggatgtctcgtgaaggactacttccccgagcctgtcaccgtgtcttggaacagcggcgccctgacgtccggggttcatacatttccggctgtgcttcagagctctggactgtattccctcagctctgtcgtgaccgtgcccagctcctctctgggcacaaagacctatacctgcaatgtcgatcacaaacctagcaacacaaaggttgacaaaacgcgggaatccaagtacgggcccccttgtcccagctgcccggcccctgagttccttggcggaccctctgtgtttctgttccctcccaaacccaaggataccctcatgatctcccgcacacctgaggtgacctgtgtcgtggttgacgtgagccaggaagatccggaggtccagtttaattggtacgtggacggcgttgaagtgcataacgcgaagacaaaacccagagaggagcaattcaattctacctatcgggtcgtgtccgtcctgacggtgctgcaccaggattggctcaacgggaaggaatacaaatgcaaggttagcaataaaggactgccttcctctatcgagaagacaattagcaaagccaagggccagccccgcgaacctcaggtgtatacccttcccccggctcaagaggaaatgaccaagaaccaggtctccctgacatgtctcgtgaaagggttttacccttctgacatcgccgttgagtgggagagcaatggacagcccgaaaacaattacaagaccacacctcccgtgctggattccgacggcagcttctttctttattctagactgacggtcgacaaatcccggtggcaagagggcaacgtgttcagctgctctgtgatgcatgaagctctccacaatcactacacccagaagtccctgagcctgtctctcgggaaa

SEQ ID NO: 43456 - RNA, 1341 nt, synthetic construct; identical to SEQ ID NO: 43455
  misc_feature 1..1341: note = derived and/or modified sequence opt5 from anti-influenza_Chain
  source 1..1341: mol_type = other RNA

SEQ ID NO: 43457 - RNA, 1344 nt, synthetic construct
  misc_feature 1..1344: note = derived and/or modified sequence opt5 from anti-influenza_Chain
  source 1..1344: mol_type = other RNA
gaggtgcagctgcaagaaagcggccccgggctcgtcaagccttcccagaccctgtctcttacatgcaacgttagcggaggctccatcacgggggactacaaatggtcttggattagacagccgcccggaaagggcctggagtggatcgggcacattcatagcaccggaacaacctattacaatccttccctccggtctcgcatcacaattagcatggatacctccaaaaacaatctgagccttagactgacatctgtgaccgctgctgacacggccgtgtattactgtgcgtcccacaccctcacaagcggccattatccccgggatttcgacttttggggccaggggaccctggtcacagtgtcttccgctagcaccaagggaccttctgttttccccctggccccttgctcccgcagcacgtccgaatctacagccgctctcggctgtctggtgaaagattactttccggagcccgtcaccgtgagctggaactccggggcccttacaagcggagttcacaccttccctgctgtgctgcaatcttccggcctctatagcctgtctagcgtcgtgaccgtgacatcctctaattttgggacgcagacctacacatgcaacgtcgaccataagcccagcaataccaaggttgataaaacagtggaaagaaagtgttgcgtggagtgtcctccctgcccggcccctcccgtcgcgggaccttccgtgttcctttttcctcccaaacccaaggacaccctgatgatcagccggacgccggaggttacatgtgtggtcgtggatgtttctcacgaagaccccgaggtgcagttcaactggtacgtcgatggcatggaagtgcacaatgccaaaaccaagcctcgcgaggagcagtttaactccaccttcagagtcgtgagcgttctcacagtggtccatcaagactggctgaatggcaaggaatataaatgcaaggtgtctaacaaagggctgcccgctcctatcgagaagaccatttccaaaacaaagggacagccccgggaaccgcaggtttacacgctccctcccagccgcgaggaaatgaccaaaaatcaggtgtccctgacatgtcttgtcaagggcttttatccttctgatatcgccgtggagtgggagagcaacgggcaacccgaaaataactacaagaccacacctcccatgctggactccgacggatctttctttctctatagcaaactgaccgtggataagtccagatggcagcagggcaacgttttcagctgctctgtcatgcacgaggcccttcataatcactacacgcaaaaatccctgagcctctctgggaag

SEQ ID NO: 43458 - RNA, 1350 nt, synthetic construct
  misc_feature 1..1350: note = derived and/or modified sequence opt5 from anti-influenza_Chain
  source 1..1350: mol_type = other RNA
caggtgcaactgcagcagagcggcgccgaggtcaagaaacccgggtcctctgttaaggtgagctgcaaagtgtccggagtcatcttctctggcagcgctatttcctgggtgagacaggcccctgggcaaggactcgaatggatgggcgggatctctccgctgtttggaaccacaaactacgcgcagaagttccagggccgggttacgattaccgctgaccagagcacaaataccacatatatggaggtgaactcccttcgctacgaagataccgccgtctatttttgtgccagaggccccaaatactatagcgagtacatggacgtgtgggggaagggaacaaccgttacggtgtcttccgctagcaccaagggcccttctgtcttccccctggccccttccagcaaatctacatccgggggaaccgctgccctcggctgcctggtgaaggattattttcccgaacctgtgacagtcagctggaactccggggcgcttacctctggagttcacacgttcccggccgtgctgcaaagctccggcctctacagcctgtcttccgtggtcacagtgcccagctctagcctgggcacccagacatacatctgtaatgttaatcataaaccttccaacaccaaggtggacaaacgggtcgagcccaagtcttgcgataagacccacacatgtcctccctgcccggctcctgagctccttgggggacccagcgtgtttctgttccctcccaaacccaaggacacgctgatgatttcccgcacccctgaagttacatgtgtggtcgtggatgtcagccatgaggacccggaagtgaaatttaattggtatgttgatggcgtggaggtccacaacgccaagaccaaacccagagaggaacagtacaattctacatatcgggtggtttccgtgctcaccgtcctgcatcaggactggcttaacgggaaggagtacaaatgcaaggtgagcaataaggctctgcctgcccccatcgaaaagacgatctctaaggcgaaaggacaacctcgcgagccccaggtgtatacactcccgccttccagagaagagatgaccaagaaccaggttagcctgacctgtctggtcaaaggcttctacccctccgatattgccgtggagtgggaatctaatgggcaacctgagaacaattataagacaacaccccctgtgctcgacagcgatggatcctttttcctgtactctaaacttaccgtcgacaaaagccggtggcagcagggcaacgtgttttcctgcagcgttatgcacgaagctctgcacaaccattacacgcagaagtctctctccctgagccccggcaaa

SEQ ID NO: 43459 - RNA, 1350 nt, synthetic construct
  misc_feature 1..1350: note = derived and/or modified sequence opt5 from anti-influenza_Chain
  source 1..1350: mol_type = other RNA
caggtgcaactggtccagagcggcgccgaggttaagaaacccgggtcctctgtgaaggtgagctgcaaggcttccggaggcaccttctctagctacgccatctcctgggtcagacaggcgcctgggcagggactcgaatggatgggcgggattatgggaatgtttggcacaacgaactatgctcaaaaattccagggccgggtgaccatcacagccgacgagtttacctctgccgcttacatggaactgcgcagccttagatccgaggatacagccgtttattactgtgctcggagctctgggtattacccggaatatttccaggactggggacagggcaccctggtgacagtctccagcgcctctaccaaagggccctccgtgtttcctctcgcgcccagctctaagtccacgagcggaggcaccgccgctctggggtgccttgttaaggattacttccctgagcccgtgacagtctcctggaactctggagccctgaccagcggcgtgcacacatttcctgctgtgctccaatccagcggcctgtactctctgtccagcgtcgttaccgtgccgtctagctccctcgggacgcagacatatatttgtaatgtgaatcataaaccctctaacaccaaggtcgacaaacgcgtggagcctaagagctgcgataaaacacacacctgtcccccttgccccgccccggaactgcttggaggcccttccgttttcctgtttccccctaagcccaaggacaccctcatgatcagcagaacacccgaggtgacgtgtgtcgtggttgatgtgtctcatgaagaccctgaggtcaaattcaattggtacgtggatggggtcgaggtgcacaacgcgaagaccaaaccgcgggaggaacagtataattccacataccgcgttgtgagcgtcctgaccgtgcttcatcaggactggctgaacggaaaggaatataaatgcaaggtttctaataaagccctccccgctcctattgagaagacaatctccaaggccaaaggccaacccagagaacctcaggtgtacaccctgcccccgagccgggaggagatgacgaagaaccaggtctccctgacatgtctcgtgaaagggttttatccttctgatatcgctgtggaatgggagagcaatggacaacccgaaaacaattacaagaccacccctcccgttctggactccgatggctctttctttctttacagcaaactgacagtcgacaagtcccgctggcagcagggcaacgtgttcagctgctctgtgatgcacgaggccctccacaatcattatacccagaagtccctgagcctttctcctgggaaa

SEQ ID NO: 43460 - RNA, 1350 nt, synthetic construct
  misc_feature 1..1350: note = derived and/or modified sequence opt5 from anti-influenza_Chain
  source 1..1350: mol_type = other RNA
gaggtgcagctggtcgaaagcggcgctgaggttaagaaacccgggtcctctgtgaaggtgagctgcaaggcttccggaggcaccttctctagctacgggatctcctgggtcagacaagcccctggacagggcctcgaatggatgggggacattatcggaatgtttggctctacaaactatgcgcagaatttccagggccggctgacgattaccgctgatgagagcacatccaccgcctacatggaacttagctctctgcgctccgaggacacagccgtgtattactgtgctagaagctctgggtattacccggcctatctcccccactggggacaaggcaccctggttacagtgtccagcgcttctaccaaagggccttccgtctttccccttgcccctagctccaaatctacgagcggaggcaccgcggccctggggtgcctcgtgaaggattacttccccgagcctgttacagtgtcctggaacagcggagctctgacctctggcgtccatacatttccggccgtgctgcagtccagcggcctctactctctgagctccgtggtcaccgttccctctagctcccttgggacgcagacatatatctgtaatgtgaaccacaagcctagcaataccaaagtggacaagcgggtcgaacccaaatcttgcgataagacacatacctgtcctccctgcccggctcctgagctgctcggaggcccctccgtgttcctgtttcctcccaaacccaaggacacccttatgattagccgcacacctgaagttacgtgtgtggtcgtggatgtttctcacgaggacccggaggtgaagttcaactggtacgtcgatggggtggaagtccataatgccaaaaccaagcccagagaggaacagtataactccacataccgggtggttagcgtgctgaccgtcctccaccaagactggctgaatggaaaagagtataagtgcaaagtgtccaacaaggcgctgcctgcccccatcgagaaaacaatctctaaggctaagggccagcctcgcgaaccccaggtttacaccctcccgcctagcagagaggaaatgacgaaaaatcaggtgtccctgacatgtcttgtcaaggggttttatccctctgatattgccgtggagtgggaaagcaacggacaacctgagaataactacaaaaccacaccccctgtgctggactccgatggcagcttctttctctactctaagctgaccgttgacaaatcccggtggcagcagggcaatgtcttcagctgctctgtgatgcacgaagcccttcataaccactatacccaaaagtccctgagcctctctcccgggaag

SEQ ID NO: 43461 - RNA, 1350 nt, synthetic construct
  misc_feature 1..1350: note = derived and/or modified sequence opt5 from anti-influenza_Chain
  source 1..1350: mol_type = other RNA
gaggtgcagctggtcgaaagcggcgccgaggttaagaaacccgggtcctctgtgaaggtgagctgcaaggcttccggaggcaccttctctagctacgccatctcctgggtcagacaagcgcctgggcagggactcgaatggatgggcgggattatcggaatgtttggcacagctaactatgcccagaaattccagggccgggtgacgattaccgccgacgagtttacatctaccgcttacatggaactgagctcccttcgcagcgaggatacagccgtttattactgtgctagagggaattattactatgagtcttccctggactactggggacaaggcaccctcgtgacagtcagctctgcctccaccaaagggccgagcgtgttccccctggcgccttcttccaagagcacgtccggaggcaccgccgctcttgggtgcctggttaaggattactttcccgaacctgtgacagtctcttggaacagcggagccctcacctccggcgtgcacacattccccgctgtgctgcagagctctggcctgtattccctcagctctgtcgttaccgtgcctagctcctctctggggacgcagacatacatctgtaatgtgaaccataaaccgagcaataccaaggtcgacaaacgggtggagcccaagtcctgcgataaaacacacacctgtcctccctgccctgcccccgaacttctgggaggcccgagcgtttttctcttccctcccaagcctaaggacaccctgatgatttctcgcacacccgaggtgacgtgtgtcgtggttgatgtgtcccatgaggaccccgaagtcaaatttaactggtatgtggatggggtcgaggtgcacaatgcgaagaccaaacctagagaggaacagtacaacagcacatatcgggttgtgtctgtccttaccgtgctgcatcaagactggctcaatggaaaggaatacaaatgcaaggtttccaacaaagccctgccggctcccatcgagaagacaatcagcaaggccaaaggccagcctcgcgagccccaggtgtataccctgcctccctccagagaagagatgacgaagaatcaggtctctctcacatgtctggtgaaagggttctacccgagcgatattgctgtggaatgggagtccaacggacaacctgaaaataactacaagaccacaccccctgttcttgactctgatggcagctttttcctgtattccaaactcaccgtcgacaagagccggtggcagcagggcaatgtgttttcttgctccgtgatgcacgaggccctgcacaaccattacacccaaaagagcctttctctgtcccccgggaaa

SEQ ID NO: 43462 - RNA, 1350 nt, synthetic construct
  misc_feature 1..1350: note = derived and/or modified sequence opt5 from anti-influenza_Chain
  source 1..1350: mol_type = other RNA
gaggtgcagctggtccaaagcggcgccgaagttaagaaacccgggtcctctatgaaggtgagctgcaaggcttccggatctatcttcagcaactacggcatttcctgggtgagacaggcccctgggcagggactcgagtggatgggcgggatcattccgatctttggagcggctaattatgcccagaaattccaaggccgggtcaccattacagccgacgaatctacgagcaccgtgtacatggaggttcgctccctgagaagcgaagatacagctgtgtattactgtgcccggcgccagcagctttataaaggctactatcaccattgggggcagggaaccctggtcacagtgtcttccgctagcaccaagggcccctctgtttttcctctcgccccctccagcaagtctacatccgggggaaccgcggccctgggctgccttgtgaaagactacttccctgagcccgtcacggtgagctggaactccggggctctgacctctggagtgcacacatttcctgccgtcctccaaagctccggcctgtacagcctgtcttccgttgtgaccgtgccgagctctagcctcggcacacagacctatatctgtaatgtcaaccataagccctccaatacgaaagtggataagaaagttgagcctaagtcttgcgacaagacacacacctgtcccccttgccccgctccggaactgcttgggggacctagcgtgttcctgtttccccctaaacccaaggatacactcatgatctccagaacccccgaggtcacctgtgtggttgtggacgtcagccatgaagatcctgaggtgaaattcaactggtacgtcgacggcgtggaggttcacaatgccaagacaaaaccgcgggaggaacagtataactctacgtaccgcgtggtctccgtgctgaccgttcttcaccaggattggctgaatgggaaggaatataaatgcaaggtgagcaacaaggcgctccccgcccctattgagaaaacaatctctaaggctaaaggacaacccagagaacctcaggtctacaccctgcccccgtcccgggaggagatgacaaagaatcaggtgagcctgacctgtctcgtgaaaggcttttatccttccgacattgccgttgaatgggagtctaacgggcaacccgaaaataactacaagacgacacctcccgtcctggatagcgacggatccttctttctttactctaagctgaccgtggataaaagccgctggcagcagggcaatgtgttctcctgcagcgtcatgcatgaggctctccacaaccattatacccagaagtctctgtcccttagccctggcaaa

SEQ ID NO: 43463 - RNA, 1350 nt, synthetic construct
  misc_feature 1..1350: note = derived and/or modified sequence opt5 from anti-influenza_Chain
  source 1..1350: mol_type = other RNA
caggtgcaactggtccagagcggcgccggggttaagaaacccggatcctctatgaaggtgagctgcaaggcttccggctctatcttcagcaactacgggatttcctgggtgagacaggcccctggacagggcctcgagtggatgggagggatcattccgatctttggcgcggctaattatgcccaaaaattccagggccgggtcaccattacagccgacgaatctacgagcaccgtgtacatggaggttcgctccctgagaagcgaagatacagctgtgtattactgtgcccggcgccagcagctttataaagggtactatcaccattggggacaaggcaccctggtcacagtgtcttccgctagcaccaaggggccctctgtttttcctctcgccccctccagcaagtctacatccggaggcaccgcggccctggggtgccttgtgaaagactacttccctgagcccgtcacggtgagctggaactccggagctctgacctctggcgtgcacacatttcctgccgtcctccagagctccggcctgtacagcctgtcttccgttgtgaccgtgccgagctctagcctcgggacacagacctatatctgtaatgtcaaccataagccctccaatacgaaagtggataagaaagttgaacctaagtcttgcgacaagacacacacctgtcccccttgccccgctccggagctgcttggaggccctagcgtgttcctgtttccccctaaacccaaggatacactcatgatctccagaacccccgaggtcacctgtgtggttgtggacgtcagccatgaagatcctgaggtgaaattcaactggtacgtcgacggggtggaagttcacaatgccaagacaaaaccgcgggaggagcagtataactctacgtaccgcgtggtctccgtgctgaccgttcttcaccaagattggctgaatggaaaggaatataaatgcaaggtgagcaacaaggcgctccccgcccctattgagaaaacaatctctaaggctaaaggccagcccagagaacctcaggtctacaccctgcccccgtcccgggaggaaatgacaaagaatcaagtgagcctgacctgtctcgtgaaagggttttatccttccgacattgccgttgagtgggagtctaacggacagcccgaaaataactacaagacgacacctcccgtcctggatagcgacggctccttctttctttactctaagctgaccgtggataaaagccgctggcagcagggcaatgtgttctcctgcagcgtcatgcatgaggctctccacaaccattatacccaaaagtctctgtcccttagccctgggaaa

SEQ ID NO: 43464 - RNA, 1350 nt, synthetic construct
  misc_feature 1..1350: note = derived and/or modified sequence opt5 from anti-influenza_Chain
  source 1..1350: mol_type = other RNA
caggtgcaactggtccagagcggcgctgaggttagaaagcccgggtcctctgtgaaagtgagctgcaaggtctccggaggcatcattcggaaatacgctatcaactgggtgcgccaggcccctgggcagggactcgaatggatgggcgggattatcgcgattttcaataccgctaactatgcccaaaagtttcagggaagagttacaatcacggccgacgagtctaccagcacagtgtacatggaactgtcctctcttcggagcgaggataccgctctgtattactgtgcccgcggcatgaattattactccgactatttcgattactggggccaggggagcctcgtcacagtgtctccggcttccaccaaaggacccagcgtttttcctctggccccctcttccaagagcacatctggcgggaccgcggcccttggatgcctggtgaaggactacttccctgaacccgtcacggtgtcctggaacagcggcgctctcacctccggggtgcacacatttcctgccgtcctgcagtctagcggactgtattccctcagctctgttgtgaccgtgccgtccagctctctgggcacacaaacctacatctgtaatgtcaaccataaacccagcaatacgaaggtggataaaaaggttgagcctaaatcctgcgacaagacacacacctgtcccccttgccccgctccggagcttctgggcgggccttctgtgttcctctttccccctaagcccaaagatacactgatgattagcagaacccccgaagtcacctgtgtggttgtggacgtctcccatgaggatcctgaagtgaagttcaactggtatgtcgacggagtggaggttcacaatgccaaaacaaagccgcgggaggaacagtacaacagcacgtatcgcgtggtctctgtgcttaccgttctgcatcaggattggctcaatggcaaagagtacaagtgcaaagtgtccaacaaggcgctgcccgcccctatcgaaaagacaattagcaaagctaaggggcagcccagagagcctcaagtctataccctgcccccgtctcgggacgaactcaccaaaaatcaggtgtccctgacatgtcttgtgaagggattttaccctagcgatatcgccgttgagtgggagtccaacggccagcccgaaaataactacaaaacgacacctcccgtcctggactctgacgggagcttctttctctattccaagctgaccgtggataagtctcgctggcaacagggaaacgtgttcagctgctccgtcatgcacgaggcccttcacaatcattacacccagaaaagcctgtctctctcccctggcaag

SEQ ID NO: 43465 - RNA, 1350 nt, synthetic construct; identical to SEQ ID NO: 43464
  misc_feature 1..1350: note = derived and/or modified sequence opt5 from anti-influenza_Chain
  source 1..1350: mol_type = other RNA

SEQ ID NO: 43466 - RNA, 1350 nt, synthetic construct; identical to SEQ ID NO: 43462
  misc_feature 1..1350: note = derived and/or modified sequence opt5 from anti-influenza_Chain
  source 1..1350: mol_type = other RNA

SEQ ID NO: 43467 - RNA, 1350 nt, synthetic construct; identical to SEQ ID NO: 43463
  misc_feature 1..1350: note = derived and/or modified sequence opt5 from anti-influenza_Chain
  source 1..1350: mol_type = other RNA

SEQ ID NO: 43468 - RNA, 1350 nt, synthetic construct; identical to SEQ ID NO: 43458
  misc_feature 1..1350: note = derived and/or modified sequence opt5 from anti-influenza_Chain
  source 1..1350: mol_type = other RNA

SEQ ID NO: 43469 - RNA, 1350 nt, synthetic construct; identical to SEQ ID NO: 43459
  misc_feature 1..1350: note = derived and/or modified sequence opt5 from anti-influenza_Chain
  source 1..1350: mol_type = other RNA

SEQ ID NO: 43470 - RNA, 1350 nt, synthetic construct; identical to SEQ ID NO: 43460
  misc_feature 1..1350: note = derived and/or modified sequence opt5 from anti-influenza_Chain
  source 1..1350: mol_type = other RNA

SEQ ID NO: 43471 - RNA, 1350 nt, synthetic construct; identical to SEQ ID NO: 43461
  misc_feature 1..1350: note = derived and/or modified sequence opt5 from anti-influenza_Chain
  source 1..1350: mol_type = other RNA

SEQ ID NO: 43472 - RNA, 1353 nt, synthetic construct
  misc_feature 1..1353: note = derived and/or modified sequence opt5 from anti-influenza_Chain
  source 1..1353: mol_type = other RNA
gaggtgcagctggtcgaaagcggcgctgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgcttctacgaaagggccttccgtgttcccccttgcccctagctctaagtccaccagcggaggcacagcggccctggggtgcctcgtcaaagactactttccggagcccgtgaccgtgtcttggaactccggagctctgacaagcggcgtccataccttccctgccgttcttcaatcctctggcctgtatagcctctccagcgtggtgacggtcccctcttccagcctggggacacagacctacatttgtaatgtgaaccacaagccttctaatacaaaagttgataagcgcgtggaacccaagagctgcgacaaaacccatacctgtccgccttgccccgctcctgagctgctcggaggcccctccgtctttctgtttccccctaagccgaaagatacacttatgatctctagaacgcccgaagtgacctgtgttgtggtcgacgtgagccacgaggatcctgaggtcaagtttaactggtacgtggacggggttgaagtgcataatgccaaaacaaagccccgggaggaacagtataactccacctaccgcgtcgtgagcgttctgacagtgctccaccaggattggctgaatggaaaagagtataagtgcaaggtctctaacaaagcgcttcctgcccccatcgaaaagaccatttccaaagctaagggccaaccgagagagcctcaggtgtacacgctgccccctagccgggaggaaatgaccaaaaatcaggtgtctctcacatgtctggttaaggggttctatccctccgacatcgccgtcgagtgggaaagcaacggacagcctgagaataactacaagaccacacccccggtgctggattccgacggctctttcttcctctatagcaaactgaccgtggacaagtcccgctggcaacagggcaatgtcttttcttgcagcgtgatgcacgaagcccttcataaccactacacacagaaatccctgagcctctctcctgggaag

SEQ ID NO: 43473 - RNA, 1353 nt, synthetic construct
  misc_feature 1..1353: note = derived and/or modified sequence opt5 from anti-influenza_Chain
  source 1..1353: mol_type = other RNA
caggtgcaactggtccagagcggcgctgaggttaagaaacccgggtcctctgtgaaggtgagctgcaaggcttccggaggccctttcagatcttacgccatcagctgggtccggcaggcgccggggcagggacccgaatggatgggcgggattatccctatttttggaaccacaaaatatgctcccaaattccaaggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgcttctacgaaagggccttccgtgttcccccttgcccctagctctaagtccaccagcggaggcacagcggccctggggtgcctcgtcaaagactactttccggaacccgtgaccgtgtcttggaactccggagctctgacaagcggcgtccataccttccctgccgttcttcagtcctctggcctgtatagcctctccagcgtggtgacggtcccctcttccagcctggggacacagacctacatttgtaatgtgaaccacaagccttctaatacaaaagttgataagcgcgtggagcccaagagctgcgacaaaacccatacctgtccgccttgccccgctcctgagctgctcggaggcccctccgtctttctgtttccccctaagccgaaagatacacttatgatctctagaacgcccgaagtgacctgtgttgtggtcgacgtgagccacgaggatcctgaagtcaagtttaactggtacgtggacggggttgaggtgcataatgccaaaacaaagccccgggaggaacaatataactccacctaccgcgtcgtgagcgttctgacagtgctccaccaggattggctgaatggaaaagagtataagtgcaaggtctctaacaaagcgcttcctgcccccatcgaaaagaccatttccaaagctaagggccagccgagagagcctcaggtgtacacgctgccccctagccgggaagagatgaccaaaaatcaagtgtctctcacatgtctggttaaggggttctatccctccgacatcgccgtcgagtgggaaagcaacggacagcctgagaataactacaagaccacacccccggtgctggattccgacggctctttcttcctctatagcaaactgaccgtggacaagtcccgctggcagcaaggcaatgtcttttcttgcagcgtgatgcacgaagcccttcataaccactacacacagaaatccctgagcctctctcctgggaag

SEQ ID NO: 43474 - RNA, 1353 nt, synthetic construct
  misc_feature 1..1353: note = derived and/or modified sequence opt5 from anti-influenza_Chain
  source 1..1353: mol_type = other RNA
gaggtgcagctggtcgaaagcggcgccgaggttaagaaacccgggtcctctgtgaaggtgagctgcaaggcttccggaggcaccttctctttttacagcatgtcctgggtcagacaagcccctgggcagggactcgaatggatgggcgggatcattccgatgttcggaacaacgaactatgcgcagaaatttcagggccgggtgaccatcacagctgttgagtctaccagcacagcctacatggaagtgtccagcctgcgctctgaggacaccgccgtctattactgtgctagaggcgataaagggatttattactattacatggacgtgtggggaaagggcacaaccgttacggtgtccagcgcctctaccaaggggccctccgtcttccctcttgctcccagctctaaatccacaagcggaggcaccgccgcgctggggtgcctcgtgaaggattactttcctgagcccgtgacagtctcctggaactctggagccctgaccagcggcgttcacacgttccctgctgtgcttcaatccagcggcctgtattctctctccagcgtggtcacagtgccgtctagctccctggggacccagacatacatctgtaatgttaatcataaaccctctaacaccaaggtggacaaacgggtcgaacctaagagctgcgataagacccacacatgtcccccttgccccgccccggagctgctcggaggcccttccgtgtttctgtttccccctaaacccaaggacacgcttatgattagccgcacccccgaagttacatgtgtggtcgtggatgtctctcatgaggaccctgaggtgaaatttaattggtatgttgatggggtggaagtccacaacgctaagaccaaaccgagagaggaacagtacaattccacatatcgggtggttagcgtgctgaccgtcctccatcaggactggctgaacggaaaggagtacaaatgcaaggtgtctaataaggcccttcccgcgcctatcgagaaaacgatctccaaggccaaaggccaaccccgcgaacctcaggtgtatacactgcccccgagcagagaggaaatgaccaagaaccaggtttccctcacctgtctggtcaaagggttctacccttctgatattgctgtggagtgggaaagcaatggacagcccgagaacaattacaagacaacccctcccgtgctggactccgatggctctttcttcctctatagcaagctgacagtcgacaaatcccggtggcaacagggcaacgtgtttagctgctctgttatgcacgaagcccttcacaatcattacacgcagaagtccctgagcctctctcctgggaaa

SEQ ID NO: 43475 - RNA, 1353 nt, synthetic construct; identical to SEQ ID NO: 43472
  misc_feature 1..1353: note = derived and/or modified sequence opt5 from anti-influenza_Chain
  source 1..1353: mol_type = other RNA

SEQ ID NO: 43476 - RNA, 1353 nt, synthetic construct; identical to SEQ ID NO: 43473
  misc_feature 1..1353: note = derived and/or modified sequence opt5 from anti-influenza_Chain
  source 1..1353: mol_type = other RNA

SEQ ID NO: 43477 - RNA, 1353 nt, synthetic construct; identical to SEQ ID NO: 43474
  misc_feature 1..1353: note = derived and/or modified sequence opt5 from anti-influenza_Chain
  source 1..1353: mol_type = other RNA

SEQ ID NO: 43478 - RNA, 1356 nt, synthetic construct
  misc_feature 1..1356: note = derived and/or modified sequence opt5 from anti-influenza_Chain
  source 1..1356: mol_type = other RNA
caggtgcaactggtccagagcggcgggggactcgttaagcccggcgggtccctgagactttcttgcgccgctagcggattcaccttttcctcttacagcatgaactgggtgcggcaggcccctggcaaagggctggagtgggtgtcctctatcagctccagcagctcctatatttactatgtcgacagcgtgaagggacgcttcacaatctctagagataatgcgaaaaactccctctacctgcagatgaatagccttcgggctgaagacacggccgtttattactgtgcccgcggcggcgggtcttatggagcttacgagggctttgattactgggggcaaggaaccctggtgacagtctccagcgcctccaccaagggcccgtctgtgttccccctcgctcctagctccaaaagcacatctgggggaaccgccgcgctgggctgcctggttaaggactattttcccgaacctgtgacagtctcctggaacagcggcgccctcacctctggggtgcacacgttccccgctgtgctgcagagctccggactttactctctgagctccgtcgttaccgtgccttcttcttccctcggcacacagacctatatttgtaatgtgaaccataagccgagcaatacaaaagtcgataagagagtggagcccaaatcttgcgacaagacccacacgtgtcctccctgccctgcccccgaactgcttgggggaccgtccgtttttctgttccctcccaaacctaaggatacactcatgatcagccggacccccgaggtgacatgtgtcgtggttgacgtgtcccatgaggatcccgaagtcaagtttaactggtacgtggacggcgtcgaggtgcacaatgctaaaaccaagcctcgcgaagaacagtataactctacctacagagttgtgagcgtcctgacagtgctgcatcaagattggctcaatgggaaagagtataagtgcaaagtttccaacaaggccctgccggcgcccattgagaaaacgatctctaaggccaagggacagcctcgggagccccaggtgtacacccttcctcccagccgcgaagagatgaccaaaaatcaggtctccctgacctgtctcgtgaagggcttctacccgagcgacatcgctgtggaatgggagtctaacggccaacctgagaataactataaaacaacaccccctgttctggattccgacgggagctttttcctttactctaagctgacggtcgacaaatccagatggcagcagggaaacgtgtttagctgctctgtgatgcacgaagccctccacaatcattatacacaaaagagcctgtccctgagccccggcaag

SEQ ID NO: 43479 - RNA, 1356 nt, synthetic construct
  misc_feature 1..1356: note = derived and/or modified sequence opt5 from anti-influenza_Chain
  source 1..1356: mol_type = other RNA
caggtgcaactggtccagagcggcgccgaggttaagcagcccggggcttccgtgaaagtgtcttgcaaggccagcggatacaccttcaacgcgtattacatccactgggtcagacaggctcctggccaagggctcgaatggatgggatggattaatccgaactttggcgggacacattatgcccggaaattccagggacgcgtgacgatgaccagagacgcctccatcaatacagcttacatggagctggatcggcttatttctgacgataccgccgtttattactgtgtgcgctggagagctgccgcggtcatcatggaccagttttataagatggatgtgtggggccagggcacactggttaccgtgagctccgcctctacaaaagggcccagcgtcttccctctcgctccctgctcccggagcacctctgaatccacggccgctctgggatgtcttgtgaaggactactttcctgagcccgtgaccgtcagctggaactctggcgccctgacatccggggttcacaccttccctgcggtgctccaaagctctggactgtactccctgagctccgtggtcacagtgccgtctagctccctcggcaccaagacgtatacatgcaatgttgatcataaacccagcaacaccaaggtggacaaaacacgcgaatctaagtacgggcctccctgtccttcctgccccgccccggagtttctgggaggccctagcgtcttcctttttccccctaaacccaaggataccctgatgatttctagaacccccgaggtgacatgtgttgtggtcgacgtgagccaggaagatcctgaggtccagttcaattggtatgtggacggcgttgaagtgcacaacgctaagacgaaaccgcgggaggagcagtttaattccacctaccgcgtcgtgtctgttctcacagtgctgcatcaagattggcttaacgggaaggaatataaatgcaaggtcagcaataaaggactgccctccagcatcgagaagaccatctctaaagccaagggccagcctagagaaccccaggtgtacacactccctcccgctcaagaggaaatgaccaagaaccaggtgtccctgacgtgtctggttaaagggttctatccgagcgacattgccgtcgagtgggagtctaatggacagcctgaaaacaattacaagacaacaccccctgtgctcgactccgatggcagctttttcctgtactcccggcttaccgtggacaaatctcgctggcaggaggggaacgtcttcagctgctccgtgatgcacgaagccctgcacaaccattatacccaaaagtctctcagcctgtcccttggaaaa

SEQ ID NO: 43480 - RNA, 1356 nt, synthetic construct
  misc_feature 1..1356: note = derived and/or modified sequence opt5 from anti-influenza_Chain
  source 1..1356: mol_type = other RNA
gaggtgcagctggtccaaagcggcgccgaagttaagaaacccggggcttccgtgaaggtgtcttgcaaagccagcggatacatcttcaccggctattacattcactgggtcagacaggcgcctgggcagggactcgagtggatgggccggatcgacccgaacggggctggaacaacgtatgcccagaagtttcaaggccgcgtgaccctgacaatggatacctccattacaaccgcctacatggaactttctagactgcggttcgacgatacagctatctattactgtgcccgctgggactggaattttgatctctatctgggctggttcgacccctgggggcagggaacccctgttacggtggctagcgcctccaccaaaggcccctctgtctttcctcttgcgcccagctccaagagcacatctgggggaaccgccgctctgggctgcctcgtgaaggattacttccctgagccggttacagtgtcctggaacagcggggccctgacctctggagtccatacgtttcccgctgtgctgcagtccagcggcctctactctctgtccagcgtggtcacagttccttcctctagccttggcacccagacatatatttgtaatgtgaaccacaaaccctccaataccaaggtggacaaaaaggtcgaacctaaaagctgcgataagacccatacatgtcccccgtgcgcccctgagctgctcgggggaccctctgtgttcctgtttcctcccaagcccaaagacacgcttatgatctccagaacccctgaggttacatgtgtggtcgtggatgttagccacgaagacccggaggtgaagttcaactggtacgtcgatggcgtggaagtccataatgcgaaaaccaagccccgggaggagcaatataactctacataccgcgtggttagcgtgctgaccgtcctccaccaggactggctgaatgggaaagaatataagtgcaaagtgtccaacaaggccctgcctgctcccatcgagaagacgatttctaaagccaagggacagcctagagaaccccaggtttacacactcccgcctagccgggaggaaatgaccaaaaatcaagtgtccctgacctgtcttgtcaagggcttttatcccagcgacatcgctgtggagtgggagtctaacgggcagcctgaaaataactacaaaacaacaccccctgtgctggattccgacggcagcttctttctctactctaagctgaccgttgataagtcccgctggcagcaaggaaatgtcttcagctgctccgtgatgcacgaggcccttcataaccactatacgcagaaatctctgagcctctcccccggcaag

SEQ ID NO: 43481 - RNA, 1356 nt, synthetic construct; identical to SEQ ID NO: 43479
  misc_feature 1..1356: note = derived and/or modified sequence opt5 from anti-influenza_Chain
  source 1..1356: mol_type = other RNA

SEQ ID NO: 43482 - RNA, 1356 nt, synthetic construct; identical to SEQ ID NO: 43478
  misc_feature 1..1356: note = derived and/or modified sequence opt5 from anti-influenza_Chain
  source 1..1356: mol_type = other RNA

SEQ ID NO: 43483 - RNA, 1356 nt, synthetic construct; identical to SEQ ID NO: 43480
  misc_feature 1..1356: note = derived and/or modified sequence opt5 from anti-influenza_Chain
  source 1..1356: mol_type = other RNA

SEQ ID NO: 43484 - RNA, 1359 nt, synthetic construct
  misc_feature 1..1359: note = derived and/or modified sequence opt5 from anti-influenza_Chain
  source 1..1359: mol_type = other RNA
caggtgcaactggtccagagcggcgccgaggttaagaaacccgggtcctctgtgagagtgagctgcaaggcttccggatctatcttccggaactacgccatgagctgggtccgccaggcgcctggccaggggctcgaatggatgggaggcattatcgctatttttgggaccccgaaatatgcccaaaagttccagggaagagtgacaatcacggccgacgagtccacctctacagtttacatggaactgagcggccttcggtccgaggataccgctatgtattactgtgcccgcattccccactataattttggcagcgggtcttacttcgactattggggacagggcacactggtgaccgtctccagcgcttctacaaaagggccttccgtgtttcccctcgcccctagctctaagtccaccagcggaggcacggcggccctggggtgccttgttaaggattacttccccgaacctgtgaccgtctcctggaactctggagctctgacaagcggcgtgcatacctttccggccgtgctccagtccagcggcctgtactctctgtccagcgtcgttacagtgccctctagctccctcgggacccaaacgtatatctgtaatgtgaaccacaaaccttctaatacaaaggtcgacaaaagagtggagcccaagagctgcgataaaacccatacatgtcctccctgcccggctcctgagctgcttggaggcccctccgttttcctgtttcctcccaagcccaaggacaccctcatgatcagccggacccctgaagtgacatgtgtcgtggttgatgtgtctcacgaggacccggaagtcaaattcaactggtacgtggatggggtcgaggtgcataatgccaagacgaaaccccgcgaggaacagtataactccacctacagagttgtgagcgtcctgacagtgcttcaccaggactggctgaatggaaaggagtataaatgcaaggtttctaacaaagcgctccctgcccccattgaaaagaccatctccaaggctaaaggccagcctcgggagccccaagtgtacacactgccgcctagccgcgaagagatgaccaagaatcaggtctccctgacgtgtctcgtgaaagggttttatccctctgatattgccgtggagtgggaaagcaacggacagcctgagaataactacaagacaacaccccctgttctggactccgatggctctttctttctttacagcaaactgaccgtcgacaagtccagatggcaacagggcaatgtgttcagctgctctgtgatgcacgaagctctccataaccactatacccagaagtccctgagcctttctcccgggaaa

SEQ ID NO: 43485 - RNA, 1359 nt, synthetic construct
  misc_feature 1..1359: note = derived and/or modified sequence opt5 from anti-influenza_Chain
  source 1..1359: mol_type = other RNA
caggtgcaactggtccagagcggcgctgaggttaagaaacccggggcttccgtgaaggtgtcttgcaaagccagcggatacatcttcaccggctattacattcactgggtcagacaggcgcctgggcagggactcgaatggatgggccggatcgacccgaacgggtccggaacaacgtatgctcaaaagtttcagggccgcgtgaccctgacaatggatacctctattacaaccgcctacatggagcttagcagactgcggttcgacgatacagccatctattactgtgctcgctgggactggaattttgatctctatctgggctggttcgacccctgggggcagggaacccctgttacggtggcctccgcttctaccaaaggccccagcgtctttcctcttgccccctccagcaagtctacatccgggggaaccgcggccctgggctgcctcgtgaaggattacttccctgaaccggttacagtgagctggaactctggggctctgacctccggagtccatacgtttcccgccgtgctgcagagctctggcctctactccctgagctccgtggtcacagttccttctagctcccttggcacccaaacatatatttgtaatgtgaaccacaaacccagcaataccaaggtggacaaaaaggtcgagcctaaatcttgcgataagacccatacatgtcccccgtgccctgctcccgaactgctcgggggaccttccgtgttcctgtttcctcccaagcccaaagacacgcttatgatcagcagaaccccggaggttacatgtgtggtcgtggatgtttctcacgaggaccccgaagtgaagttcaactggtacgtcgatggcgtggaggtccataatgccaaaaccaagcctcgggaggaacagtataacagcacataccgcgtggtttccgtgctgaccgtcctccaccaggactggctgaatgggaaagagtataagtgcaaagtgtctaacaaggcgctgcccgcccctatcgaaaagacgattagcaaagctaagggacagcccagagagccgcaagtttacacactccctccctcccgggaagagatgaccaaaaatcaggtgagcctgacctgtcttgtcaagggcttttatccttctgacatcgccgtggaatgggagtccaacgggcagcccgagaataactacaaaacaacccctcccgtgctggatagcgacggatctttctttctctactccaagctgacagttgataagagccgctggcaacagggcaatgtcttctcctgctctgtgatgcacgaagcccttcataaccactatacgcagaaaagcctgtccctctctccgggcaag

SEQ ID NO: 43486 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggcttccgtgaaggtgtcttgcaaagccagcggatacatcttcaccggctattacattcactgggtcagacaggcgcctgggcagggactcgagtggatgggccggatcgacccgaacggggctggaacaacgtatgcccagaagtttcaaggccgcgtgaccctgacaatggatacctccattacaaccgcctacatggaactttctagactgcggttcgacgatacagctatctattactgtgcccgctgggactggaattttgatctctatctgggctggttcgacccctgggggcagggaacccctgttacggtggctagcgcctccaccaaaggcccctctgtctttcctcttgcgcccagctccaagagcacatctgggggaaccgccgctctgggctgcctcgtgaaggattacttccctgagccggttacagtgtcctggaacagcggggccctgacctctggagtccatacgtttcccgctgtgctgcagtccagcggcctctactctctgtccagcgtggtcacagttccttcctctagccttggcacccagacatatatttgtaatgtgaaccacaaaccctccaataccaaggtggacaaaaaggtcgaacctaaaagctgcgataagacccatacatgtcccccgtgccctgcccccgagctgctcgggggaccttctgtgttcctgtttcctcccaagcccaaagacacgcttatgatctccagaaccccggaggttacatgtgtggtcgtggatgttagccacgaagaccccgaggtgaagttcaactggtacgtcgatggcgtggaagtccataatgcgaaaaccaagcctcgggaggagcaatataactctacataccgcgtggttagcgtgctgaccgtcctccaccaggactggctgaatgggaaagaatataagtgcaaagtgtccaacaaggccctgcccgctcctatcgagaagacgatttctaaagccaagggacagcccagagaaccgcaggtttacacactccctcccagccgggaggaaatgaccaaaaatcaagtgtccctgacctgtcttgtcaagggcttttatcctagcgacatcgctgtggagtgggagtctaacgggcagcccgaaaataactacaaaacaacccctcccgtgctggattccgacggcagcttctttctctactctaagctgacagttgataagtcccgctggcagcaaggaaatgtcttcagctgctccgtgatgcacgaggcccttcataaccactatacgcagaaatctctgagcctctccccgggcaag

SEQ ID NO: 43487 - RNA, 1359 nt, synthetic construct
  misc_feature 1..1359: note = derived and/or modified sequence opt5 from anti-influenza_Chain
  source 1..1359: mol_type = other RNA
caggtgcaactggtccagagcggcgccgaggttaagaaacccggggcttccgtgaaggtgtcttgcaaagccagcggatacaccttcaacgcgcaccatatgcactgggtcagacaggctcctggccaggggctcggatggatgggctggatcgacccgaataacgatgggacaatttatgcccaaaagtttcagggacgggtgacgctgaccatggacacatccatccataccgcctacatggaactttctggcctgcgctatgatgacacagctatttactattgtgttagatgggcctggaatttcgactttttcctcggctggtttgatccctgggggcagggaaccctggtgacagtcgctagcgcctccaccaaaggcccttctgtgttcccccttgcgcctagctccaagagcacgtctgggggaaccgccgctctgggctgcctcgttaaggattactttcccgagcctgtgacagtctcctggaacagcggggccctgacctctggagtgcacacattcccggctgtgctgcagtccagcggcctctattctctgtccagcgtcgttaccgtgccctcctctagccttggcacgcaaacatacatctgtaatgtgaaccataaaccttccaataccaaggtcgacaaaaaggtggaacccaaaagctgcgataagacacacacctgtcctccctgcccggcccctgagctgctcgggggaccctctgtttttctgttccctcccaagcccaaagacacccttatgatttcccggacacctgaagtgacgtgtgtcgtggttgatgtgagccacgaggacccggaggtcaagtttaactggtacgtggatggcgtcgaagtgcataatgcgaaaaccaagccccgcgaggaacagtataactctacatacagagttgtgagcgtcctgaccgtgctccaccaggactggctgaatgggaaagagtataagtgcaaagtttccaacaaggccctgcctgctcccatcgagaagacaatctctaaagccaagggacagcctcgggaaccccaagtgtacaccctcccgcctagccgcgaggaaatgacgaaaaatcaggtctccctgacatgtcttgtgaagggcttctatcccagcgacattgctgtggagtgggaatctaacgggcagcctgagaataactacaaaaccacaccccctgttctggattccgacggcagctttttcctctattctaagctgaccgtcgataagtccagatggcaacagggaaacgtgttcagctgctccgtgatgcatgaggcccttcacaatcactacacccagaaatctctgagcctctcccccggcaag

SEQ ID NO: 43488 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacagcgatacaatttactccccctcttttcagggacaagtcacgatcagcgctgacaactccattagcaccgcctatcttcagtggtcttccctgaaagcgagcgatacagctatctactattgtgcctctggccctggctactccgggtatcactacggatggttcgacacctggggccaggggacactcgtgaccgttagctctgcctccacaaagggacccagcgtgtttcctctggctccctcctctaagagcacctccggcgggacggccgctcttggatgcctggtcaaagattacttccctgagccggtgaccgttagctggaatagcggcgccctcacatccggcgtgcatacctttcccgcggtcctgcagagctctgggctgtatagcctctcctctgtggtgacagtccctagctccagcctgggaacccaaacgtacatctgtaacgttaatcacaagccctctaacacaaaagtggacaagaaagtggaacctaagtcctgcgataagacccatacatgtcccccgtgccctgcccccgagcttctgggcgggcctagcgtcttcctctttcctcccaaacccaaggacaccctgatgatttctcggaccccggaggtgacatgtgttgtggtcgatgtgtcccacgaagaccccgaggttaaattcaattggtatgtggatggagtcgaagtgcataacgctaagacgaaacctcgcgaggagcagtacaatagcacctatagagtcgtgtccgttcttacagtgctgcaccaggactggctcaacggcaaggaatacaaatgcaaggtctctaataaggccctgcccgctcctatcgagaaaaccattagcaaggccaaagggcagccccgggaaccgcaagtgtatacactgcctccctcccgcgaggaaatgaccaagaaccaggtttctctcacgtgtctggtgaaaggattttaccctagcgatatcgcggtcgagtgggagtccaatggccagcccgaaaacaattacaagacaacccctcccgtgcttgacagcgacggctctttctttctgtattccaagctcaccgtggataaaagcagatggcaacaggggaacgttttctcttgctccgtcatgcacgaggccctgcataatcactacacacagaagtctctttctctgagcccgggaaaa

SEQ ID NO: 43489 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacgctgatgccatttacagcccctcctttcagggacaagtcacaatctctgcggacaacagcatttccacggcttatcttcagtggagctctctgaaagcctccgataccgccatctactattgtgctagcggccctggctactctgggtatcactacggatggttcgacacatggggccaggggaccctcgtgacagtttccagcgcctctaccaagggaccctccgtgtttcctctggctcccagctccaagtctacaagcggcgggaccgccgcgcttggatgcctggtcaaagattacttccctgagccggtgacggtttcctggaatagcggcgccctcacctctggcgtgcatacatttcccgctgtcctgcagtccagcgggctgtattctctcagctccgtggtgaccgtcccttctagctccctgggaacacaaacctacatctgtaacgttaatcacaagcccagcaacacgaaagtggacaagaaagtggaacctaagtcttgcgataagacacatacctgtcccccgtgccctgcccccgagcttctgggcgggccttccgtcttcctctttcctcccaaacccaaggacacactgatgattagccggaccccggaggtgacctgtgttgtggtcgatgtgtctcacgaagaccccgaggttaaattcaattggtatgtggatggagtcgaagtgcataacgctaagacaaaacctcgcgaggagcagtacaattccacgtatagagtcgtgagcgttcttaccgtgctgcaccaggactggctcaacggcaaggaatacaaatgcaaggtctccaataaggccctgcccgcgcctatcgagaaaacaatttctaaggccaaagggcagccccgggaaccgcaagtgtataccctgcctcccagccgcgaggaaatgacaaagaaccaggtttccctcacctgtctggtgaaaggattttacccttctgatatcgctgtcgagtgggagagcaatggccagcccgaaaacaattacaagacgacacctcccgtgcttgactccgacggcagcttctttctgtattctaagctcaccgtggataaatccagatggcaacaggggaacgttttcagctgctctgtcatgcacgaggccctgcataatcactacacccagaagtcccttagcctgtctccgggaaaa

SEQ ID NO: 43490 - RNA, 1359 nt, synthetic construct; identical to SEQ ID NO: 39233
  misc_feature 1..1359: note = derived and/or modified sequence opt5 from anti-influenza_Chain
  source 1..1359: mol_type = other RNA

SEQ ID NO: 43491 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacgctgatacaatttacagcccctcctttcagggacaagtcacgatctctgccgacaacagcatttccaccgcgtatcttcagtggagctctctgaaggcttccgatacagccatctactattgtgccagcggccctggctactctgggtatcactacggatggttcgacacctggggccaggggacactcgtgaccgtttccagcgcttctacaaaaggaccctccgtgtttcctctggcccccagctccaagtctaccagcggcgggacggctgcccttggatgcctggtcaaagattacttccctgagccggtgaccgtttcctggaatagcggcgcgctcacatctggcgtgcatacctttcccgccgtcctgcagtccagcgggctgtattctctcagctccgtggtgacagtcccttctagctccctgggaacccaaacgtacatctgtaacgttaatcacaagcccagcaacacaaaagtggacaagaaagtggaacctaagtcttgcgataagacccatacatgtcccccgtgccctgctcccgagcttctgggcgggccttccgtcttcctctttcctcccaaacccaaggacaccctgatgattagccggaccccggaggtgacatgtgttgtggtcgatgtgtctcacgaagaccccgaggttaaattcaattggtatgtggatggagtcgaagtgcataacgccaagacgaaacctcgcgaggagcagtacaattccacctatagagtcgtgagcgttcttacagtgctgcaccaggactggctcaacggcaaggaatacaaatgcaaggtctccaataaggctctgcccgcccctatcgagaaaaccatttctaaggcgaaagggcagccccgggaaccgcaagtgtatacactgcctcccagccgcgaggaaatgaccaagaaccaggtttccctcacgtgtctggtgaaaggattttacccttctgatatcgccgtcgagtgggagagcaatggccagcccgaaaacaattacaagacaacccctcccgtgcttgactccgacggcagcttctttctgtattctaagctcaccgtggataaatccagatggcaacaggggaacgttttcagctgctctgtcatgcacgaggctctgcataatcactacacacagaagtcccttagcctgtctccgggaaaa

SEQ ID NO: 43492 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccggggagctccgacacaatttactctcccagctttcagggacaagtcacgatctccgctgataacagcatttctaccgcctatcttcagtggtccagcctgaaagcgtctgacacagctatctactattgtgcctccggccctggctacagcgggtatcactacggatggttcgatacctggggccaggggacactcgtgaccgtttcttccgccagcacaaagggaccctccgtgtttcctctggctccctctagcaagtccaccagcggcgggacggccgctcttggatgcctggtcaaagactacttccctgagccggtgaccgtttcttggaactccggcgccctcacaagcggcgtgcatacctttcccgcggtcctgcagtctagcgggctgtattccctctctagcgtggtgacagtcccttccagctctctgggaacccaaacgtacatctgtaatgttaatcacaagccctccaacacaaaagtggataagaaagtggaacctaagagctgcgacaagacccatacatgtcccccgtgccctgcccccgagcttctgggcgggccttctgtcttcctctttcctcccaaacccaaggataccctgatgatttcccggaccccggaggtgacatgtgttgtggtcgacgtgagccacgaagatcccgaggttaaattcaattggtatgtggacggagtcgaagtgcataacgctaagacgaaacctcgcgaggagcagtacaattccacctatagagtcgtgtctgttcttacagtgctgcaccaggattggctcaacggcaaggaatacaaatgcaaggtcagcaataaggccctgcccgctcctatcgagaaaaccatttccaaggccaaagggcagccccgggaaccgcaagtgtatacactgcctccctctcgcgaggaaatgaccaagaaccaggttagcctcacgtgtctggtgaaaggattttacccttccgacatcgcggtcgagtgggagagcaatggccagcccgaaaacaattacaagacaacccctcccgtgcttgattctgacggctccttctttctgtatagcaagctcaccgtggacaaatctagatggcaacaggggaacgttttctcctgcagcgtcatgcacgaggccctgcataatcactacacacagaagtctcttagcctgtccccgggaaaa

SEQ ID NO: 43493 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacagcgatgctatttactccccctcttttcagggacaagtcacaatcagcgccgacaactccattagcacggcgtatcttcagtggtcttccctgaaagctagcgataccgccatctactattgtgcctctggccctggctactccgggtatcactacggatggttcgacacatggggccaggggaccctcgtgacagttagctctgcttccaccaagggacccagcgtgtttcctctggccccctcctctaagagcacatccggcgggaccgctgcccttggatgcctggtcaaagattacttccctgagccggtgacggttagctggaatagcggcgcgctcacctccggcgtgcatacatttcccgccgtcctgcagagctctgggctgtatagcctctcctctgtggtgaccgtccctagctccagcctgggaacacaaacctacatctgtaacgttaatcacaagccctctaacacgaaagtggacaagaaagtggaacctaagtcctgcgataagacacatacctgtcccccgtgccctgctcccgagcttctgggcgggcctagcgtcttcctctttcctcccaaacccaaggacacactgatgatttctcggaccccggaggtgacctgtgttgtggtcgatgtgtcccacgaagaccccgaggttaaattcaattggtatgtggatggagtcgaagtgcataacgccaagacaaaacctcgcgaggagcagtacaatagcacgtatagagtcgtgtccgttcttaccgtgctgcaccaggactggctcaacggcaaggaatacaaatgcaaggtctctaataaggctctgcccgcccctatcgagaaaacaattagcaaggcgaaagggcagccccgggaaccgcaagtgtataccctgcctccctcccgcgaggaaatgacaaagaaccaggtttctctcacctgtctggtgaaaggattttaccctagcgatatcgccgtcgagtgggagtccaatggccagcccgaaaacaattacaagacgacacctcccgtgcttgacagcgacggctctttctttctgtattccaagctcaccgtggataaaagcagatggcaacaggggaacgttttctcttgctccgtcatgcacgaggctctgcataatcactacacccagaagtctctttctctgagcccgggaaaa

SEQ ID NO: 43494 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggacacagatacgatttacagcccctcctttcagggacaagtcaccatctctgctgacaacagcatttccacagcctatcttcagtggagctctctgaaagcgtccgataccgctatctactattgtgccagcggccctggctactctgggtatcactacggatggttcgacacatggggccaggggaccctcgtgacagtttccagcgcctctaccaagggaccctccgtgtttcctctggctcccagctccaagtctacgagcggcgggaccgccgctcttggatgcctggtcaaagattacttccctgagccggtgacagtttcctggaatagcggcgccctcacctctggcgtgcatacatttcccgcggtcctgcagtccagcgggctgtattctctcagctccgtggtgaccgtcccttctagctccctgggaacgcaaacatacatctgtaacgttaatcacaagcccagcaacaccaaagtggacaagaaagtggaacctaagtcttgcgataagacacatacctgtcccccgtgccctgcccccgagcttctgggcgggccttccgtcttcctctttcctcccaaacccaaggacaccctgatgattagccggacaccggaggtgacgtgtgttgtggtcgatgtgtctcacgaagaccccgaggttaaattcaattggtatgtggatggagtcgaagtgcataacgctaagaccaaacctcgcgaggagcagtacaattccacatatagagtcgtgagcgttcttaccgtgctgcaccaggactggctcaacggcaaggaatacaaatgcaaggtctccaataaggccctgcccgctcctatcgagaaaacaatttctaaggccaaagggcagccccgggaaccgcaagtgtataccctgcctcccagccgcgaggaaatgacgaagaaccaggtttccctcacatgtctggtgaaaggattttacccttctgatatcgcggtcgagtgggagagcaatggccagcccgaaaacaattacaagaccacccctcccgtgcttgactccgacggcagcttctttctgtattctaagctcacagtggataaatccagatggcaacaggggaacgttttcagctgctctgtcatgcacgaggccctgcataatcactacacccagaagtcccttagcctgtctccgggaaaa

SEQ ID NO: 43495 - RNA, 1359 nt, synthetic construct
  misc_feature 1..1359: note = derived and/or modified sequence opt5 from anti-influenza_Chain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggagagcgacacaatttactccccctcttttcagggacaagtcacgatcagcgctgataactccattagcaccgcctatcttcagtggtcttccctgaaagcgagcgacacagctatctactattgtgcctctggccctggctactccgggtatcactacggatggttcgatacctggggccaggggacactcgtgaccgttagctctgcctccacaaagggacccagcgtgtttcctctggctccctcctctaagagcacctccggcgggacggccgctcttggatgcctggtcaaagactacttccctgaaccggtgaccgttagctggaactctggcgccctcacatccggcgtgcatacctttcccgcggtcctgcagagctctgggctgtatagcctctcctctgtggtgacagtccctagctccagcctgggaacccaaacgtacatctgtaatgttaatcacaagccctctaacacaaaagtggataagaaagtggagcctaagtcctgcgacaagacccatacatgtcccccgtgccctgcccccgagcttctgggcgggcctagcgtcttcctctttcctcccaaacccaaggataccctgatgatttctcggaccccggaagtgacatgtgttgtggtcgacgtgtcccacgaggatcccgaagttaaattcaattggtatgtggacggagtcgaggtgcataacgctaagacgaaacctcgcgaggaacagtacaatagcacctatagagtcgtgtccgttcttacagtgctgcaccaggattggctcaacggcaaggagtacaaatgcaaggtctctaataaggccctgcccgctcctatcgaaaagaccattagcaaggccaaagggcagccccgggagccgcaagtgtatacactgcctccctcccgcgaagagatgaccaagaaccaggtttctctcacgtgtctggtgaaaggattttaccctagcgacatcgcggtcgagtgggaatccaatggccagcccgagaacaattacaagacaacccctcccgtgcttgatagcgacggctctttctttctgtattccaagctcaccgtggacaaaagcagatggcaacaggggaacgttttctcttgctccgtcatgcacgaagccctgcataatcactacacacagaaaagcctttctctgagcccgggaaaa

SEQ ID NO: 43496 - RNA, 1359 nt, synthetic construct; identical to SEQ ID NO: 43484
  misc_feature 1..1359: note = derived and/or modified sequence opt5 from anti-influenza_Chain
  source 1..1359: mol_type = other RNA

SEQ ID NO: 43497 - RNA, 1359 nt, synthetic construct; identical to SEQ ID NO: 43485
  misc_feature 1..1359: note = derived and/or modified sequence opt5 from anti-influenza_Chain
  source 1..1359: mol_type = other RNA

SEQ ID NO: 43498 - RNA, 1359 nt, synthetic construct; identical to SEQ ID NO: 43486
  misc_feature 1..1359: note = derived and/or modified sequence opt5 from anti-influenza_Chain
  source 1..1359: mol_type = other RNA

SEQ ID NO: 43499 - RNA, 1359 nt, synthetic construct; identical to SEQ ID NO: 43487
  misc_feature 1..1359: note = derived and/or modified sequence opt5 from anti-influenza_Chain
  source 1..1359: mol_type = other RNA

SEQ ID NO: 43500 - RNA, 1359 nt, synthetic construct; identical to SEQ ID NO: 43488
  misc_feature 1..1359: note = derived and/or modified sequence opt5 from anti-influenza_Chain
  source 1..1359: mol_type = other RNA

SEQ ID NO: 43501 - RNA, 1359 nt, synthetic construct; identical to SEQ ID NO: 43489
  misc_feature 1..1359: note = derived and/or modified sequence opt5 from anti-influenza_Chain
  source 1..1359: mol_type = other RNA

SEQ ID NO: 43502 - RNA, 1359 nt, synthetic construct; identical to SEQ ID NO: 39233
  misc_feature 1..1359: note = derived and/or modified sequence opt5 from anti-influenza_Chain
  source 1..1359: mol_type = other RNA

SEQ ID NO: 43503 - RNA, 1359 nt, synthetic construct; identical to SEQ ID NO: 43491
  misc_feature 1..1359: note = derived and/or modified sequence opt5 from anti-influenza_Chain
  source 1..1359: mol_type = other RNA

SEQ ID NO: 43504 - RNA, 1359 nt, synthetic construct; identical to SEQ ID NO: 43492
  misc_feature 1..1359: note = derived and/or modified sequence opt5 from anti-influenza_Chain
  source 1..1359: mol_type = other RNA

SEQ ID NO: 43505 - RNA, 1359 nt, synthetic construct; identical to SEQ ID NO: 43493
  misc_feature 1..1359: note = derived and/or modified sequence opt5 from anti-influenza_Chain
  source 1..1359: mol_type = other RNA

SEQ ID NO: 43506 - RNA, 1359 nt, synthetic construct; identical to SEQ ID NO: 43494
  misc_feature 1..1359: note = derived and/or modified sequence opt5 from anti-influenza_Chain
  source 1..1359: mol_type = other RNA

SEQ ID NO: 43507 - RNA, 1359 nt, synthetic construct; identical to SEQ ID NO: 43495
  misc_feature 1..1359: note = derived and/or modified sequence opt5 from anti-influenza_Chain
  source 1..1359: mol_type = other RNA

SEQ ID NO: 43508 - RNA, 1365 nt, synthetic construct
  misc_feature 1..1365: note = derived and/or modified sequence opt5 from anti-influenza_Chain
  source 1..1365: mol_type = other RNA
caggtgcaactggtcgagagcggcgggggagttgtgcagcccggcagatccctccggctgtcttgcgccgctagcgggttcgcctttcacaaccgcgcgatgcattgggtgagacaggctcctggaaagggccttgaatgggtcgccctgatctacttcgacgggtccaaacagtattacgccgattctgtgaagggacggtttaccattagccgcgacaattccaaaaacacagttttcctccaaatgaatagcctgagaccggaggatacggctgtgtattactgtgccgtccccggccctatctttggcattttcccgccttggtcttattttgaccactgggggcagggaatccttgtgaccgtttccagcgcttctacaaagggcccctccgtgttccctctggccccgagctctaaatccaccagcgggggaacagcggccctcggctgcctggtcaaggattactttcccgaacctgtgaccgtgtcttggaactccggggctctgacaagcggagtccataccttccccgccgttctccagtcctctggcctgtatagcctttccagcgtggtgacggtcccttcttccagcctgggcacccagacatacatttgtaatgtgaaccacaagccctctaataccaaagttgacaagaaagtggagcccaagagctgcgataaaacacatacctgtcctccctgccctgctcccgaactccttgggggaccctccgtctttctgttccctccgaagcccaaggacacgctgatgatctctcggacacctgaggtgacctgtgttgtggtcgatgtgagccacgaggaccccgaagtcaaatttaactggtacgtggatggcgttgaggtgcacaatgccaagacaaaacctcgcgaggaacaatataactccacctacagagtcgtgagcgttctcaccgtgctgcatcaggactggctgaatgggaaggagtataaatgcaaggtctctaacaaagcgctccccgccccgatcgaaaagacaatttccaaggctaaaggacagcctcgggagccccaggtgtacacgctgcctcccagccgcgaagagatgaccaagaatcaagtgtctcttacatgtctggttaaaggcttctatccttccgatatcgccgtcgaatgggagagcaacgggcagcccgagaataactacaagaccacaccgcctgtgctcgactccgacggatctttctttctgtatagcaaacttaccgtggataagtccagatggcagcaaggcaacgtcttctcttgcagcgtgatgcacgaagctctgcataatcactacacgcagaagtccctcagcctgtctcccggcaaa

SEQ ID NO: 43509 - RNA, 1365 nt, synthetic construct
  misc_feature 1..1365: note = derived and/or modified sequence opt5 from anti-influenza_Chain
  source 1..1365: mol_type = other RNA
gaggtgcagctggtcgaaagcggcgggggagttgtgcaacccggcagatccctccggctgtcttgcgccgctagcgggttcgcctttcacaaccgcgcgatgcattgggtgagacaggctcctggaaagggccttgagtgggtcgccctgatctacttcgacgggtccaaacagtattacgccgattctgtgaagggacggtttaccattagccgcgacaattccaaaaacacagttttcctccagatgaatagcctgagaccggaagatacggctgtgtattactgtgccgtccccggccctatctttggcattttcccgccttggtcttattttgaccactgggggcaaggaatccttgtgaccgtttccagcgcttctacaaagggcccctccgtgttccctctggccccgagctctaaatccaccagcgggggaacagcggccctcggctgcctggtcaaggattactttcccgagcctgtgaccgtgtcttggaactccggggctctgacaagcggagtccataccttccccgccgttctccagtcctctggcctgtatagcctttccagcgtggtgacggtcccttcttccagcctgggcacccagacatacatttgtaatgtgaaccacaagccctctaataccaaagttgacaagaaagtggaacccaagagctgcgataaaacacatacctgtcctccctgccctgctcccgagctccttgggggaccctccgtctttctgttccctccgaagcccaaggacacgctgatgatctctcggacacctgaggtgacctgtgttgtggtcgatgtgagccacgaagaccccgaggtcaaatttaactggtacgtggatggcgttgaagtgcacaatgccaagacaaaacctcgcgaggagcagtataactccacctacagagtcgtgagcgttctcaccgtgctgcatcaagactggctgaatgggaaggaatataaatgcaaggtctctaacaaagcgctccccgccccgatcgagaagacaatttccaaggctaaaggacagcctcgggaaccccaggtgtacacgctgcctcccagccgcgaggaaatgaccaagaatcaggtgtctcttacatgtctggttaaaggcttctatccttccgatatcgccgtcgagtgggagagcaacgggcaacccgaaaataactacaagaccacaccgcctgtgctcgactccgacggatctttctttctgtatagcaaacttaccgtggataagtccagatggcagcagggcaacgtcttctcttgcagcgtgatgcacgaggctctgcataatcactacacgcaaaagtccctcagcctgtctcccggcaaa

SEQ ID NO: 43510 - RNA, 1365 nt, synthetic construct
  misc_feature 1..1365: note = derived and/or modified sequence opt5 from anti-influenza_Chain
  source 1..1365: mol_type = other RNA
gaggtgcagctggtccaaagcggcgggggagttgtgcagcccggcaagtccctcagactgtcttgcgccgctagcgggcttaccttctcctcttacgccgtgcactgggtccggcaggcgcctggaaaaggcctggaatgggtgacactcatcagctatgacggggctaaccagtactatgccgattccgttaagggacgctttacgatttctagagacaatagcaaaaacaccgtgtacctgcaaatgaactcccttcggccggaggatacagccgtctattactgtgctgtgcccggccctgttttcggcatctttcccccttggagctatttcgacaattgggggcagggcattctggtgaccgtctcttccgccagcacaaagggaccctctgtgtttcctctcgctccgtccagcaaatctacctccgggggaacagccgcgctgggctgcctggtgaaggattacttccccgaacctgtcaccgttagctggaactccggggccctcacgtctggagtgcatacctttcccgctgtgctgcagagctccggcctttacagcctgtcttccgtcgtgacagttcctagctctagcctcggcacccagacatatatctgtaatgtgaatcacaagccctccaacaccaaagtcgacaagaaagtggagccgaagtcttgcgataaaacgcatacatgtcctccctgccctgcccccgaactgcttgggggacccagcgttttcctgtttcctccgaagcccaaggacaccctcatgatttcccgcacacctgaggtgacctgtgtcgtggtcgatgtgagccacgaggaccccgaagttaaattcaattggtacgtggatggcgtcgaggtgcataacgctaagaccaaacctagagaggaacaatataattctacataccgggttgtgtccgtcctgacggtgctgcaccaggactggctcaacgggaaggagtataaatgcaaggtgagcaataaagccctgcccgcgccgatcgaaaagaccatctctaaggccaaaggacagcctcgcgagccccaggtttacacacttcctccctccagagaagagatgaccaagaaccaagtcagcctgacatgtctcgtgaaaggcttttatccttccgatattgctgtggaatgggagtctaatgggcagcccgagaacaactacaagaccacgccgcctgtcctggacagcgacggatccttctttctttactctaaactgacagtggataagagccggtggcagcaaggcaatgttttctcctgcagcgtgatgcacgaagccctccataaccactatacccagaagtctctgtccctgagccccggcaaa

SEQ ID NO: 43511 - RNA, 1365 nt, synthetic construct
  misc_feature 1..1365: note = derived and/or modified sequence opt5 from anti-influenza_Chain
  source 1..1365: mol_type = other RNA
caggtgcaactggtcgagagcggcgggggagttgtgcagcccggcaagtccctcagactgtcttgcgccgctagcgggcttaccttctcctcttacgccgtgcactgggtccggcaggcgcctggaaaaggcctggaatgggtgacactcatcagctatgacggggctaaccagtactatgccgattccgttaagggacgctttacgatttctagagacaatagcaaaaacaccgtgtacctgcaaatgaactcccttcggccggaggatacagccgtctattactgtgctgtgcccggccctgttttcggcatctttcccccttggagctatttcgacaattgggggcagggcattctggtgaccgtctcttccgccagcacaaagggaccctctgtgtttcctctcgctccgtccagcaaatctacctccgggggaacagccgcgctgggctgcctggtgaaggattacttccccgaacctgtcaccgttagctggaactccggggccctcacgtctggagtgcatacctttcccgctgtgctgcagagctccggcctttacagcctgtcttccgtcgtgacagttcctagctctagcctcggcacccagacatatatctgtaatgtgaatcacaagccctccaacaccaaagtcgacaagaaagtggagccgaagtcttgcgataaaacgcatacatgtcctccctgccctgcccccgaactgcttgggggacccagcgttttcctgtttcctccgaagcccaaggacaccctcatgatttcccgcacacctgaggtgacctgtgtcgtggtcgatgtgagccacgaggaccccgaagttaaattcaattggtacgtggatggcgtcgaggtgcataacgctaagaccaaacctagagaggaacaatataattctacataccgggttgtgtccgtcctgacggtgctgcaccaggactggctcaacgggaaggagtataaatgcaaggtgagcaataaagccctgcccgcgccgatcgaaaagaccatctctaaggccaaaggacagcctcgcgagccccaggtttacacacttcctccctccagagaagagatgaccaagaaccaagtcagcctgacatgtctcgtgaaaggcttttatccttccgatattgctgtggaatgggagtctaatgggcagcccgagaacaactacaagaccacgccgcctgtcctggacagcgacggatccttctttctttactctaaactgacagtggataagagccggtggcagcaaggcaatgttttctcctgcagcgtgatgcacgaagccctccataaccactatacccagaagtctctgtccctgagccccggcaaa

SEQ ID NO: 43512 - RNA, 1365 nt, synthetic construct
  misc_feature 1..1365: note = derived and/or modified sequence opt5 from anti-influenza_Chain
  source 1..1365: mol_type = other RNA
caggtgcaactggtcgagagcggcgggggagttgtgcagcccggcaagtcccctagactctcttgcgccgctagcgggccgaccttctcctcttacgccgtgcactgggtccggcaggcgcccggaaaaggcctggaatgggtgacacttatcagctatgacggggctaaccagtactatgccgattccgttaagggacgctttacgatttctagagacaatagcaaaaacaccgtgtacctgcaaatgaactccctccggcctgaggatacagccgtctattactgtgctgtgcccggccctgttttcggcatctttcccccttggagctatttcgacaattgggggcagggcattctggtgaccgtctcttccgccagcacaaagggaccgtctgtgtttccccttgctccttccagcaaatctacctccgggggaacagccgcgctgggctgcctcgtgaaggattacttccccgaacctgtcaccgttagctggaactccggggccctgacgtctggagtgcatacctttcccgctgtgctgcagagctccggcctctacagcctgtcttccgtcgtgacagttccgagctctagccttggcacccagacatatatctgtaatgtgaatcacaagccttccaacaccaaagtcgacaagaaagtggagcccaagtcttgcgataaaacgcatacatgtcctccctgccccgcccctgaactgctcgggggaccgagcgttttcctgtttccccctaagcccaaggacacccttatgatttcccgcacacctgaggtgacctgtgtcgtggtcgatgtgagccacgaggaccccgaagttaaattcaattggtacgtggatggcgtcgaggtgcataacgctaagaccaaaccgagagaggaacaatataattctacataccgggttgtgtccgtcctgacggtgctccaccaggactggctgaacgggaaggagtataaatgcaaggtgagcaataaagccctgcctgcgcccatcgaaaagaccatctctaaggccaaaggacagcctcgcgagccccaggtttacacactccctccctccagagaagagatgaccaagaaccaagtcagcctgacatgtcttgtgaaaggcttttatccgtccgatattgctgtggaatgggagtctaatgggcagcctgagaacaactacaagaccacgcctcccgtcctggacagcgacggatccttctttctctactctaaactgacagtggataagagccggtggcagcaaggcaatgttttctcctgcagcgtgatgcacgaagcccttcataaccactatacccagaagtctctgtccctcagccccggcaaa

SEQ ID NO: 43513 - RNA, 1365 nt, synthetic construct; identical to SEQ ID NO: 39217
  misc_feature 1..1365: note = derived and/or modified sequence opt5 from anti-influenza_Chain
  source 1..1365: mol_type = other RNA

SEQ ID NO: 43514 - RNA, 1365 nt, synthetic construct
  misc_feature 1..1365: note = derived and/or modified sequence opt5 from anti-influenza_Chain
  source 1..1365: mol_type = other RNA
caggtgcagctggtccagagcggcgccgagctcaagagacccggggcttccgttaaagtgtcttgcaagaccagcggatactccttcaacaattatggcatcaactgggtgcggcaggcccctgggcagggactggaatggatgggctggatttctgcgtacacagggaatacgcactatgctaaaaactttgagggacgcgtcacccttacaaccgacacaagcacctccacagcctacatggaagtgagatctctgcggagcgatgactccgccgtttatttctgtgctcgcgccatgatccaaggcgtggtcaccctctacctgagaccgggcgattattgggggcagggaacgcttgtgaccgttagctctgcttccacaaagggccccagcgtgtttcctctggccccctcttccaaaagcacctctgggggaacagcggccctcggctgcctggtcaaggactacttccctgagcccgtgaccgtgtcctggaatagcggggctctgacgtccggagtccatacatttcctgccgttctccagtctagcggcctgtactcccttagctctgtggtgaccgtcccgtccagctctctgggcacacagacctatatttgtaacgtgaatcacaagcccagcaacaccaaagttgataagaaagtggaacctaagtcctgcgacaaaacacatacgtgtcccccttgccccgctccggagctcctgggaggaccttctgtcttcctttttccccctaagcccaaggataccctgatgatcagccggacacccgaggtgacctgtgttgtggtcgacgtgtcccacgaagatcctgaggtcaaattcaattggtacgtggacggcgttgaagtgcataacgccaagacaaaaccgcgcgaggagcaatataatagcacctacagagtcgtgtctgttctcacggtgctgcaccaggattggctgaacgggaaggaatataaatgcaaggtctccaataaagcgctccccgcccctattgagaagacaatcagcaaggctaaaggacagccccgggaacctcaggtgtacaccctgcccccgtctcgcgaggaaatgaccaagaaccaagtgtcccttacatgtctggttaaaggcttttatcctagcgacatcgccgtcgagtgggagtccaatgggcagcccgaaaacaactacaagaccacacctcccgtgctcgattctgacgggagcttctttctgtactccaaacttacggtggacaagtctagatggcagcaaggcaatgtcttcagctgctccgtgatgcacgaggctctgcataaccactatacccaaaagagcctctctctgtcccctggcaaa

SEQ ID NO: 43515 - RNA, 1365 nt, synthetic construct; identical to SEQ ID NO: 43508
  misc_feature 1..1365: note = derived and/or modified sequence opt5 from anti-influenza_Chain
  source 1..1365: mol_type = other RNA

SEQ ID NO: 43516 - RNA, 1365 nt, synthetic construct; identical to SEQ ID NO: 43509
  misc_feature 1..1365: note = derived and/or modified sequence opt5 from anti-influenza_Chain
  source 1..1365: mol_type = other RNA

SEQ ID NO: 43517 - RNA, 1365 nt, synthetic construct; identical to SEQ ID NO: 43510
  misc_feature 1..1365: note = derived and/or modified sequence opt5 from anti-influenza_Chain
  source 1..1365: mol_type = other RNA

SEQ ID NO: 43518 - RNA, 1365 nt, synthetic construct; identical to SEQ ID NO: 43511
  misc_feature 1..1365: note = derived and/or modified sequence opt5 from anti-influenza_Chain
  source 1..1365: mol_type = other RNA

SEQ ID NO: 43519 - RNA, 1365 nt, synthetic construct; identical to SEQ ID NO: 43512
  misc_feature 1..1365: note = derived and/or modified sequence opt5 from anti-influenza_Chain
  source 1..1365: mol_type = other RNA

SEQ ID NO: 43520 - RNA, 1365 nt, synthetic construct; identical to SEQ ID NO: 39217
  misc_feature 1..1365: note = derived and/or modified sequence opt5 from anti-influenza_Chain
  source 1..1365: mol_type = other RNA

SEQ ID NO: 43521 - RNA, 1365 nt, synthetic construct; identical to SEQ ID NO: 43514
  misc_feature 1..1365: note = derived and/or modified sequence opt5 from anti-influenza_Chain
  source 1..1365: mol_type = other RNA

SEQ ID NO: 43522 - RNA, 1368 nt, synthetic construct
  misc_feature 1..1368: note = derived and/or modified sequence opt5 from anti-influenza_Chain
  source 1..1368: mol_type = other RNA
gaggtgcagctggtccaaagcggcgggggagttgtgcagcccagacggtccctccgcctgtcttgcgccgctagcggcttcaccttttcctcttacgccatgcactgggtgagacaggcgcctgggaagggacttgaatgggtcgctgtgatcagctatgacggccggaacaaatactatgccgattccgttaaggggcgcttcacagtgtctagagacaatagcaaaaacacgctgtacctccagatgaatagcctgcgggccgaggatacctccgtctattactgtgctcgcgaacttctgatggactattacgatcatattggatactctccgggccccacatggggccaagggaccctcgtgacagtttccagcgcctctaccaagggaccttccgtgtttcccctggctcctagctctaaatccacaagcggcgggaccgccgcgctgggatgcctcgtcaaggactatttccccgagcctgtgacggtgtcctggaactctggcgccctgaccagcggggtccacacatttccggctgttcttcagtccagcggactgtactctctctccagcgtggtgaccgtcccctctagctccctgggcacacagacctatatctgtaatgtgaaccataagccttctaatacgaaagttgataagagagtggaacccaaaagctgcgacaagacacacacctgtcctccctgcccggcccctgagcttctgggcgggccctccgtcttcctctttcctcccaaacccaaggatacactgatgattagccggacccctgaggtgacctgtgttgtggtcgacgtgtctcatgaagatccggaggtcaagttcaactggtacgtggacggagttgaagtgcacaatgctaaaacaaagccccgcgaggagcagtataactccacgtacagagtcgtgagcgttctgaccgtgctccaccaagattggctgaatggcaaagaatataagtgcaaagtctctaacaaggcccttcctgcgcccatcgagaaaacaatttccaaggccaaggggcagcctcgggaaccccaggtgtacaccctgccgcctagccgcgaggaaatgaccaaaaatcaggtgtccctcacatgtctggttaagggattttacccctctgacatcgctgtcgagtgggagagcaacggccaacctgaaaataactataaaacgacaccccctgtgcttgactccgatgggtctttctttctgtacagcaagctcaccgtggacaaatccagatggcagcagggaaacgtcttcagctgctctgtgatgcatgaggccctgcacaatcattatacccaaaagtccctgagcctctctcccggcaag

SEQ ID NO: 43523 - RNA, 1371 nt, synthetic construct
  misc_feature 1..1371: note = derived and/or modified sequence opt5 from anti-influenza_Chain
  source 1..1371: mol_type = other RNA
atggtgatccagagaaacagcattctgctcctgatcattatcttcgcctcctctatttctacctgccggtccaatgtcatcgacgataacctttttaagcaagtttacgacaatatcctggagcaggagttcgctcacgattttcaggcctatctctcttacctgagcaaaaacattgaatccaataacaatatcgacaaggtggataaaaacggcattaaggtgatcaatgtcctttctttcggggcgaaaggagacggcaagacctatgataacattgcttttgaacaggcctggaatgaggcctgtagctcccgcacgcccgtgcaattcgttgtgcctaagaacaaaaattacctgctcaagcagatcacctttagcgggccgtgcagatcttccattagcgtcaaaatcttcggatctctggaggcttccagcaagatctctgactataaagatcggcgcctgtggattgcctttgactccgtgcagaacctcgttgtgggcgggggaggcacaatcaatggcaacgggcaggtctggtggcccagctcctgtaagattaacaagtctctgccttgcagagatgctcccaccgcccttacattctggaattgtaaaaacctgaaggtgaataacctcaaaagcaagaatgcgcaacagatccatattaaatttgaatcctgcaccaacgtggtcgccagcaatctgatgatcaacgcttctgccaagtcccctaatacagacggagttcacgtgagcaacacccagtacatccagatttctgatacgatcattggcaccggggacgactgtatcagcattgtgtccggatctcaaaatgtccaggctacaaacattacctgcggccccgggcatggaatcagcatcggctcccttggcagcgggaatagcgaggcctatgtgtccaacgttacagtgaatgaagcgaaaatcattggagccgagaacggcgtccggatcaagacctggcaagggggaagcggccaggcttctaacattaagttcctgaatgtggaaatgcaggatgttaaataccctatcattatcgaccagaactactgtgatcgcgtggagccgtgcatccagcaattttccgccgtccaggtgaagaatgtcgtgtatgagaacattaaagggacgagcgctacaaaggttgccatcaaattcgactgttccaccaatttcccctgcgaaggaattatcatggagaacattaatctcgtgggcgaatctggcaagcctagcgaggccacatgcaagaacgtccactttaataacgctgaacatgtgacaccccactgtacctccctggagatctctgaggatgaagcgctgctctacaattat

SEQ ID NO: 43524 - RNA, 1371 nt, synthetic construct; identical to SEQ ID NO: 43523
  misc_feature 1..1371: note = derived and/or modified sequence opt5 from anti-influenza_Chain
  source 1..1371: mol_type = other RNA

SEQ ID NO: 43525 - RNA, 1380 nt, synthetic construct
  misc_feature 1..1380: note = derived and/or modified sequence opt5 from anti-influenza_Chain
  source 1..1380: mol_type = other RNA
atgaagctgtggctcaactggatcttcctggtgacccttctgaatgacattcagtgcgaggtcaaactcgttgaaagcggcgggggactggtgcaacccggcgggtcccttagactgtcttgtgccacaagcggatttacgttctccgattactatatgtcttgggtgcggcagagccctggcaaggctctcgagtggctggggtttacccgctccagagtcctgggatacacaaccgactattctgccagcgtgaaaggccggttcacaatctcccgcgataacagccagtctattctctacctgcagatgaactcccttagaggcgaagacagcgcgacctattactgcgctcgggatcgcccgatggactattgggggcaaggaacatctgttaccgtgtccagcgccaagacgacacccccttctgtctaccccctggcccctggctccgctgcccagaccaatagcatggtgaccctcgggtgtctggttaaaggatactttcccgagcctgtgacagtcacctggaactccggctctcttagctccggggtgcacacgttcccggctgtgctgcagagcgatctctatacactgtcttccagcgtcaccgttccctctagcacatggccttccgaaaccgtgacctgcaatgtggcccatcccgcgtctagcacaaaggtcgacaagaaaatcgtgcctagagattgtggatgcaagccctgtatttgcacggttccggaggtgtccagcgtctttatcttccctcccaaacctaaggacgtgctgaccatcacactcacccccaaagttacatgtgtggtcgtggatatttctaaggacgatcccgaggtccagttttcctggttcgtggacgacgttgaagtgcacaccgcccaaacgcagcctcgggaggaacagtttaatagcacattccgctctgtctccgagctgccgatcatgcatcaggattggcttaacggcaaggagtttaaatgcagagtgaatagcgctgccttccccgctcctattgaaaagaccatctccaaaaccaagggccggcccaaagcccctcaagtttacacaattcccccgcctaaggagcagatggcgaaagacaaggtgtctctgacctgtatgatcacagatttctttcccgaagacattacggtcgagtggcagtggaacgggcaacctgccgaaaattataagaacacccagcccatcatggatacagacggaagctacttcgtgtattccaaactcaatgtgcagaagtctaactgggaggctggcaatacctttacatgcagcgttctgcacgaggggcttcataaccaccacaccgaaaaatccctgagccattctcctggaaag

SEQ ID NO: 43526 - RNA, 1380 nt, synthetic construct; identical to SEQ ID NO: 43525
  misc_feature 1..1380: note = derived and/or modified sequence opt5 from anti-influenza_Chain
  source 1..1380: mol_type = other RNA

SEQ ID NO: 43527 - RNA, 1386 nt, synthetic construct
  misc_feature 1..1386: note = derived and/or modified sequence opt5 from anti-influenza_Chain
  source 1..1386: mol_type = other RNA
atggagtggagctggatcttcctgtttctcctgtccggcaccgccggggtgcactctgaagtccagcttcaacagagcggacccgagctggttaagcctggcgcttccgtgaaaatgtcttgcaaggccagcgggtacacattcacgtcctatgtgatgcattgggtcaaacagaagccgggacagggcctcgaatggattgggtacatcaacccctataatgacggaaccagatacaacgagaaatttcgggtgaaggcgacactgacctctgataagagctccagcacagcttatatggaactttcttccctgaccagcgaggactctgccgtttactattgtgcccgcagaggcctcattacaacccctacgctggattactggggccaagggaccacactgaccgtgtccagcgctaaaacaacgcccccttctgtctaccccctcgcccctggatccgctgcccagaccaatagcatggtgacactgggctgccttgttaaggggtatttcccggagcccgtgaccgtcacatggaactccggatctctgagctccggcgtgcacacctttcctgcggtgctccagagcgacctgtacaccctttcttccagcgtcacagttccctctagcacgtggccttccgaaaccgtgacatgtaatgtggcccatcccgcttctagcaccaaagtcgataagaaaatcgtgccgcgggactgcgggtgtaagccttgcatttgtacagttcccgaggtgtccagcgtcttcatctttcctcccaagcccaaagatgtgctgaccatcacgctcacacctaaggttacctgcgtggtcgtggacatttctaaagatgacccggaagtccagttctcctgggtggatgacgttgaggtgcacaccgcccaaacacagccccgcgaggaacagtttaacagcaccttcagatctgtctccgagctgcctatcatgcatcaggattggctgaatggaaaggaatttaaatgtcgggtgaacagcgctgccttccccgcgcctattgagaagacaatctccaaaacgaagggccgccccaaggccccgcaagtttataccattcctccccctaaagaacagatggctaaggacaaagtgtctctcacatgcatgatcaccgactttttccccgaggatattacagtcgagtggcagtggaatggccaacctgccgaaaactacaagaatacccagcccatcatggacacggatgggagctatttcgtgtactccaaactgaacgtgcagaagtctaattgggaggctggaaacacctttacatgtagcgttcttcacgaaggcctgcacaatcatcacaccgagaagtccctcagccattctccggggaaa

SEQ ID NO: 43528 - RNA, 1386 nt, synthetic construct
  misc_feature 1..1386: note = derived and/or modified sequence opt5 from anti-influenza_Chain
  source 1..1386: mol_type = other RNA
caggtgcaactggtccagagcggcgccgaggttaagaaacccggggcttccgtgaaggtgtcttgcaaaaccagcggatacacattcacggcctataccatccactgggtcagacaggcgcctggccagcggctcgaatggatggggtggattaacgctggaaatggccatacaaagtactcccaacgctttaaagggagagtgaccatcacacgggacacctctgcccgcacaacctatatggagctgagaagccttacgtccgaagataccgccctgtacttctgtgctcggggaccggagacatattactatgacaagaccaactggctcaattctcaccccgatgaatactttcagcattggggccacggcacacaggttaccgtgagctccgccagcacgaaggggccttctgtcttccccctggctccttccagcaaatctacatccggaggcaccgccgcgcttgggtgcctggtgaaggactactttcccgagcctgttacagtgagctggaactctggagccctcacctccggcgtccataccttcccggctgtgctgcagagctccgggctgtattctctcagctccgtggtcacagttccctctagctccctgggaacgcaaacctacatttgtaatgtgaaccacaaacctagcaatacaaaggtggataaaaaggtcgagcccaagtcttgcgacaaaacccacacatgtcctccctgcccggcccctgaacttctgggcggccccagcgtgtttctcttccctcccaagcccaaagataccctgatgatctcccgcacgcctgaggttacatgtgtggtcgtggacgtttctcatgaagatccggaggtgaagtttaactggtatgtcgacggggtggaggtccacaatgctaaaaccaagcccagagaggaacagtacaacagcacctatcgggtggtttccgtgcttacagtcctgcatcaggattggctcaatggaaaagaatacaagtgcaaggtgagcaacaaagccctgcctgcgcccattgagaagaccatctctaaagccaagggccagcctcgcgaaccccaagtttatacactgccgccttccagagacgagctcacgaaaaatcaggtgagcctgacctgtcttgtcaaggggttctacccctctgatatcgctgtggagtgggaatccaacggacagcctgagaataactacaagacaacaccccctgtgctggacagcgacggctcctttttcctctattctaaactgaccgttgataagagccggtggcaacaggggaacgtcttttcctgctctgtgatgcacgaagcccttcacaatcattacacccagaaaagcctgtccctcagccccggaaag

SEQ ID NO: 43529 - RNA, 1386 nt, synthetic construct; identical to SEQ ID NO: 43528
  misc_feature 1..1386: note = derived and/or modified sequence opt5 from anti-influenza_Chain
  source 1..1386: mol_type = other RNA

SEQ ID NO: 43530 - RNA, 1386 nt, synthetic construct; identical to SEQ ID NO: 43527
  misc_feature 1..1386: note = derived and/or modified sequence opt5 from anti-influenza_Chain
  source 1..1386: mol_type = other RNA

SEQ ID NO: 43531 - RNA, 1398 nt, synthetic construct
  misc_feature 1..1398: note = derived and/or modified sequence opt5 from anti-influenza_Chain
  source 1..1398: mol_type = other RNA
atgctgcccagcaccgtgcagacactcacgctgcttctgacctccggcggggtcctcctgtctctttacgttagcgcctccctgtcttatctcctgtacagcgacgtgctgctcaagttctcctctacaaaaaccacagctcctaccatgagcctggagtgcacaaacgcctccaatgcgcaaaccgtgaaccacagcgctacgaaggaaatgacctttccgccccctgagcccgaatggacatatcctagactttcttgtcagggatccaccttccagaaagccctgctcatcagcccccatcggtttggcgagattaagggaaattctgcccctctgatcattcgcgaaccgttcgtcgcttgcgggcccaaagagtgtagacactttgcccttacacattacgctgcccagcctggcgggtattacaacggaacccggaaggatcgcaataagctgagacacctcgtgtccgttaaactgggcaagatccccacggtggagaacagcattttccatatggcggcctggtctggctccgcttgccacgacgggcgggaatggacatatatcggagtcgatggccctgacaatgatgccctggtgaaaatcaagtacggggaggcttacaccgacacatatcacagctacgcccataacattctccgcacccaagaatccgcgtgtaattgcatcggaggcgattgttatctgatgattaccgacgggtctgccagcggaatctccaaatgcagatttcttaagattcgggagggccgcatcattaaggagatcctgcccacaggcagagttgaacacacggaggaatgtacctgcgggttcgctagcaacaaaacaatcgagtgtgcctgccgggataattcttacaccgctaagcgcccgtttgtgaaactcaacgtcgaaacagacaccgccgagattagactgatgtgcacgaagacatatcttgatacccctcggcccgacgatggatccatcgccggcccttgtgagagcaatggggacaaatggctgggaggcattaaagggggattcgtgcatcagcgcatggcttctaagatcggcagatggtacagccggaccatgtccaagacaaacagaatgggcatggaactctatgtgaagtacgacggggatccctggaccgactctgatgcgctgacactgagcggagtcatggtttccattgaggaacccggctggtacagctttgggttcgagatcaaagacaagaaatgcgatgtgccttgtatcggaattgaaatggtgcacgacggcgggaaggatacgtggcactctgccgctaccgccatctattgcctcatgggctccggacagctgctttgggacacagtcaccggcgtggatatggccctg

SEQ ID NO: 43532 - RNA, 1398 nt, synthetic construct; identical to SEQ ID NO: 43531
  misc_feature 1..1398: note = derived and/or modified sequence opt5 from anti-influenza_Chain
  source 1..1398: mol_type = other RNA

SEQ ID NO: 43533 - RNA, 1407 nt, synthetic construct
  misc_feature 1..1407: note = derived and/or modified sequence opt5 from anti-influenza_Chain
  source 1..1407: mol_type = other RNA
atggactggacctggagattcctgtttgtggtcgccgctgccacaggcgttcagagccaagtgcagctcgtgcagtccggggcggaggtcaagaaacccggatctagcgtgaaggtttcctgcaaggcttctggcgggacgctgaacaattacgccatcagctgggtgcggcaggcccctggacaaggccttgaatggatgggagggatttccccgatcttcggcaccctgaactatgctgagcgctttcagggcagagtcacaattaccgccgatgtgttcacaaataccgtttacatggaactctctagcctgcggtccgaggacacagctgtgtatttttgtgcccgcgggtgcggatacaactgttattacttcgatggctgggggcagggaacccttgtcacggtgagctctgcgtccaccaagggccccagcgtgtttcctctggccccctcttccaaaagcacatctgggggaaccgctgccctcggctgcctggtcaaggactatttccctgaacccgttacagtgtcctggaatagcggcgctctgacctccggggtgcacacgtttcctgccgtcctccagtctagcggactgtactcccttagctctgtggttacagtgccgtccagctctctgggcacccaaacatacatctgtaacgtcaatcataagcccagcaacaccaaagtggataagaaagttgagcctaagtcctgcgacaaaacccacacatgtcccccttgccccgcgccggagctccttgggggaccttctgtgttcctgtttccccctaagcccaaggatacgctgatgattagcagaacccccgaagtcacatgtgtggtcgtggacgtttcccatgaggatcctgaagtgaaattcaattggtatgtcgacggcgtggaggttcacaacgccaagaccaaaccgcgggaggaacagtacaatagcacatatcgcgtggtctctgtgctcaccgtgctgcatcaggattggctgaacgggaaggagtacaaatgcaaggtttccaataaagctctccccgcccctatcgaaaagacgatcagcaaggctaaaggacagcccagagagcctcaagtctatacactgcccccgtctcgggacgaacttaccaagaaccaggtgtccctgacctgtctcgtgaaaggcttttaccctagcgatattgccgtcgagtgggagtccaatggccagcccgaaaacaactataagacaacccctcccgtgctggactctgacgggagcttcttcctttactccaaactgacagttgataagtctcgctggcaacagggaaatgtgtttagctgctccgtcatgcacgagggcctccacaaccattacacgcagaaaagcctgtctctgtcccctgggaaa

SEQ ID NO: 43534 - RNA, 1407 nt, synthetic construct; identical to SEQ ID NO: 43533
  misc_feature 1..1407: note = derived and/or modified sequence opt5 from anti-influenza_Chain
  source 1..1407: mol_type = other RNA

SEQ ID NO: 43535 - RNA, 1407 nt, synthetic construct; identical to SEQ ID NO: 43533
  misc_feature 1..1407: note = derived and/or modified sequence opt5 from anti-influenza_Chain
  source 1..1407: mol_type = other RNA

SEQ ID NO: 43536 - RNA, 1413 nt, synthetic construct
  misc_feature 1..1413: note = derived and/or modified sequence opt5 from anti-influenza_Chain
  source 1..1413: mol_type = other RNA
gacggcgtgaagcccctgatcctcagagattgcagcgtcgccgggtggctgcttggaaaccctatgtgtgacgagttcattaatgttccggaatggtcctacatcgtggagaaagctaaccccgccaatgatctgtgctatcctggcaactttaatgactacgaagaactcaagcacctcctttctcggattaaccatttcgagaaaatccagattatccccaagagctcctggtctgatcacgaggcgagctccggggtgtctagcgcttgtccttatcaaggaaccccctcctttttccgcaatgtcgtgtggctgatcaaaaagaacaatacataccctacgattaagagaagctataacaataccaaccaggaggacctcctgatcctgtggggcattcatcactctaatgatgccgccgaacagacaaaactctaccagaacccgaccacatatatctccgttgggaccagcacactgaatcaacggcttgtgcccaagattgctacccgctctaaagtcaacggacagaacggcagaatggactttttctggacgatcctgaagcctaatgatgccattaactttgagtccaatggcaacttcatcgctcccgaatacgcctacaaaatcgtgaagaaggggtatattcctgaggcgccccgggacggacaggcctacgttcgcaaagatggcgagtgggtgctcctgagcacctttcttagatctgacaagacacatacctgcccgccttgtcccgctcctgaactgctcgggggaccctccgtcttcctgtttccccctaaaccgaaggatacactgatgatcagccggacccccgaggtgacgtgcgtggtcgttgacgtgtcccacgaagaccctgaggtgaaattcaattggtatgtcgatggcgtggaagttcacaacgccaagacaaaaccccgcgaggagcagtacaattctacctatagagtggtcagcgtgctcacagttctgcatcaagactggcttaacgggaaggaatacaagtgtaaagtgtccaataaggctctgcctgcccccattgagaaaaccatcagcaaggcgaaaggacagccgcgggaacctcaggtctataccctgcccccttctcgcgaggaaatgacaaagaaccaggtgtccctgacgtgccttgtcaagggcttttaccccagcgatattgccgtggagtgggagtctaatggccaacctgaaaacaattacaaaaccacacccccggttctggacagcgatgggtccttcttcctctattctaagctgaccgtggacaaaagcagatggcagcagggaaacgtcttttcctgtagcgtgatgcacgaggctctgcataatcactacacacaaaagtctctctccctgagccctggcaaa

SEQ ID NO: 43537 - RNA, 1413 nt, synthetic construct; identical to SEQ ID NO: 43536
  misc_feature 1..1413: note = derived and/or modified sequence opt5 from anti-influenza_Chain
  source 1..1413: mol_type = other RNA

SEQ ID NO: 43538 - RNA, 1416 nt, synthetic construct
  misc_feature 1..1416: note = derived and/or modified sequence opt5 from anti-influenza_Chain
  source 1..1416: mol_type = other RNA
atggactggacctggagattcctgtttgtggtcgccgctgccacaggcgttcagtgccaagtgcagctcgtgcagagcggggcggaggtcaagatgcccggatcctctgtgaaagttagctgtaagacgtccggcgtgttcttttctagccacgctatctcctgggtccggcaggcccctgggcaaggactggaatggatgggcgggatttctccgatgttcggaaccacacattacgcccagaaatttcagggccgcgtgaccatcacagctgatcagagcaccacaaccgcctatatggagcttacgtccctgaccagcgaagacacagctgtttactattgcgccagagatggcgcggggtcttactatcccctcaactggttcgacccttggggacaaggcaccctggtgacagtctccagcgcctctaccaaggggccctccgtgtttcctcttgctcccagctctaaatccacgagcggaggcacagccgctctggggtgtctcgtgaaggattacttccctgagccggtcaccgtttcctggaactctggagccctgacaagcggcgtgcacacctttcccgcggtgctgcagtccagcggcctctattctctgtccagcgtcgtgaccgttccttctagctcccttgggacacagacgtacatttgcaatgtgaatcataagccctctaacaccaaagtcgacaagcgggtggaacctaaaagctgtgataagacacacacctgtcccccgtgccctgcccccgagctgctcggaggcccttccgttttcctgtttcctcccaaacccaaggacacacttatgatcagccgcaccccggaggtgacgtgcgtcgtggtcgatgtgtctcatgaagaccccgaggttaagttcaattggtacgtggatggggtcgaagtgcacaacgctaaaacaaagcctagagaggagcagtataattccacctaccgggttgtgagcgtcctgaccgtgctccaccaagactggctgaacggaaaagaatataagtgtaaagtgtctaataaggccctgcccgctcctattgagaaaacaatctccaaggccaagggccagccccgcgaaccgcaggtttacaccctccctcccagcagagatgagctgacaaagaaccaagtctcccttacgtgcctggtgaaggggttttatccttctgacatcgccgtggaatgggagagcaatggacagcccgagaacaattacaaaaccacacctcccgtcctcgactccgatggctctttcttcctgtatagcaaacttaccgtggacaaatcccggtggcagcagggcaacgtttttagctgttctgtgatgcatgaagggctgcacaatcattacacacaaaagtccctcagcctgtctccgggaaag

SEQ ID NO: 43539 - RNA, 1416 nt, synthetic construct; identical to SEQ ID NO: 43538
  misc_feature 1..1416: note = derived and/or modified sequence opt5 from anti-influenza_Chain
  source 1..1416: mol_type = other RNA

SEQ ID NO: 43540 - RNA, 1416 nt, synthetic construct; identical to SEQ ID NO: 43538
  misc_feature 1..1416: note = derived and/or modified sequence opt5 from anti-influenza_Chain
  source 1..1416: mol_type = other RNA

SEQ ID NO: 43541 - RNA, 1419 nt, synthetic construct
  misc_feature 1..1419: note = derived and/or modified sequence opt5 from anti-influenza_Chain
  source 1..1419: mol_type = other RNA
atgaccgagagcgccatgacatccagagctggccgggggcgcggagccgacctggtggcggctgtcgttcagggccacgccgccgcttctgatgccgctggggacctcagcttccccgatggatttatctggggcgccgcgacggccgcttaccaaattgaaggggcctggagagaggacggacggggcctgtgggatgtgttctcccatacccctggcaaggtggcttctgggcacacaggagacatcgcctgcgatcattatcaccgctacgcggacgatgtcagacttatggccggcctgggggaccgggtgtatcgctttagcgttgcttggccgagaattgtgcccgatggatccggccctgtcaaccccgccgggctcgacttctacgatcggctggtggacgaacttctgggacatggcatcaccccttatcccacactctaccactgggacctgcctcagaccctggaggatcgcggcgggtgggctgccagagacacagcctatcggtttgctgaatacgcgctcgccgttcaccgcagactgggagatcgggtgcgctgttggattacccttaatgagccgtgggtcgctgccttcctggccacgcatagaggcgctcccggggccgcggacgtgcctcggtttagagctgtgcaccatctcctgcttggacacggcctggggctccgcctgcggtctgccggagccggccagctgggcctcaccctgagcctttcccccgtcatcgaggctagacctggggttcgcggaggcgggcggagagtggatgccctggctaaccgccagttcctcgaccccgccctgcggggaagatacccggaagaggtgcttaaaatcatggcgggccacgcccgcctggggcatcctggccgggatctcgaaacaattcaccaacccgtcgacctgctgggagtgaattattacagccatgttagactcgctgccgagggcgagcctgctaaccgcctgcccgggtctgaaggaatccggtttgagagacccaccgccgtgacagcgtggcctggcgatcggccggacgggcttcgcaccctgctcctgagactttcccgggattatcccggagtcggcctgattatcacggaaaatggggccgctttcgacgacagagccgatggcgaccgcgtgcacgatcctgagcggattagatacctcacagctaccctgcgcgccgttcatgacgccatcatggctggagcggatctgagaggctattttgtgtggagcgtcctcgacaacttcgaatgggcctacgggtatcacaagcggggaattgtgtacgtcgattacacaaccatgcgcagaatcccccgggagtctgctctgtggtatcgcgacgtggttagacggaatggccttcgcaacggggag

SEQ ID NO: 43542 - RNA, 1419 nt, synthetic construct; identical to SEQ ID NO: 43541
  misc_feature 1..1419: note = derived and/or modified sequence opt5 from anti-influenza_Chain
  source 1..1419: mol_type = other RNA

SEQ ID NO: 43543 - RNA, 1422 nt, synthetic construct
  misc_feature 1..1422: note = derived and/or modified sequence opt5 from anti-influenza_Chain
  source 1..1422: mol_type = other RNA
ctgagcagaatcaaccacttcgagaagattcagatcattcccaaatcctcttggagcgaccatgaagcctcctctggcgtgagctccgcttgcccttaccaagggaccccgtctttcttccggaatgtcgtttggctcatcaagaaaaacaatacatatcccacgattaagcgcagctacaacaataccaaccaggaggatctgcttatcctgtggggaatccaccattccaatgacgccgcggaacagacaaaactctatcagaaccctaccacatacattagcgtgggcacctctacactgaatcaaagacttgtgcccaagatcgctacccggtccaaggtcaacgggcagaatggacgcatggactttttctggacgattctgaaacctaacgatgccatcaattttgagagcaacggcaatttcattgcccccgaatatgcttacaagatcgtgaaaaagggggattctgccattgttaaatccgaggtggagtatggaaactgtaacaccaagtgccagacacctatcggcgctatcaatagctctatgccgtttcacaacattcatcccctcaccatcggcgaatgtcctaagtacgtcaaatccaataagctggtgctggccacagggctcagaaacagccccctgggatacattcctgaggcgccccgggacggccaggcctatgttcgcaaagatggggaatgggtgcttctgtccaccttcctcagatctgacaagacgcacacatgcccgccttgtcccgctcctgagctgcttggaggccccagcgtctttctgtttccccctaaaccgaaggataccctcatgatctcccggacacccgaggtgacctgcgtggtcgttgacgtgagccacgaagatcctgaggtgaaatttaattggtacgtcgacggggtggaagttcataacgccaagaccaagccccgcgaggaacaatataattctacatacagagtggtctccgtgctgacggttctgcaccaggattggctcaacggaaaagagtataagtgtaaagtgagcaataaggctctgcctgcccccattgagaaaaccatctctaaggcgaagggccagccgcgggaacctcaggtctacacacttccccctagccgcgaggaaatgaccaaaaaccaagtgtccctgacatgcctcgtcaagggcttctatccctctgacatcgccgtggagtgggaaagcaatgggcagcctgagaacaattacaaaaccacgcccccggttctggactccgatggcagctttttcctttactctaagctgacagtggacaaatccagatggcagcaaggaaacgtcttcagctgttctgtgatgcatgaggctctccacaatcactatacccagaagtccctgagcctgtcccctgggaag

SEQ ID NO: 43544 - RNA, 1422 nt, synthetic construct; identical to SEQ ID NO: 43543
  misc_feature 1..1422: note = derived and/or modified sequence opt5 from anti-influenza_Chain
  source 1..1422: mol_type = other RNA

SEQ ID NO: 43545 - RNA, 1428 nt, synthetic construct
  misc_feature 1..1428: note = derived and/or modified sequence opt5 from anti-influenza_Chain
  source 1..1428: mol_type = other RNA
atggagttcggcctgagctgggtgtttctcgtcgccctgcttagaggggttcagtgccaggtgcagctggtggaatccggaggcggggtcgtgcagcccggacggtctctccgcctgagctgtgctgcctccggcttcaccttttctagattcgggatccactgggttcggcaggcgcctggaaagggccttgagtggatggctgtgatttggtacgacggcagcaacaaattttatgccgattccgtcaaggggcgcttcacaatctctagagacaatagcaaaaacacggtgtacctgcaaatgaatagcctccgggccgaagataccgctgtttattactgcgccaaggacagccgcggatattgttcttccattatctgctttgagggcgggctggataactggggacagggcacactggtgaccgtcagctctgcttccacaaaagggccgagcgtgttccccctcgccccttcttccaagagcacctccggaggcacagcggccctgggctgtcttgtgaaggactactttcccgaacctgtcaccgtttcttggaatagcggggctctgacgtccggagtgcataccttccccgccgtgctccagagctctggcctgtattcccttagctctgtcgtgacagttcctagctcctctctggggacccagacatacatttgcaacgtgaatcacaaaccgagcaacaccaaggtcgataaaagagtggagcccaagtcctgtgacaaaacgcatacatgccctccctgtcctgctcccgagctcctgggaggcccgagcgtttttctgttccctcccaagcctaaggataccctcatgatctctcggacacccgaagtgacctgcgtcgtggtcgacgtgtcccacgaggatcccgaagttaaatttaattggtacgtggacggggtcgaggtgcataacgccaagaccaaacctcgcgaggaacaatataatagcacatacagagttgtgtctgtcctgacggtgcttcaccaggattggctgaacggaaaggagtataaatgtaaggtgtccaataaagcgctcccggcccccatcgaaaagaccattagcaaggctaaaggccagcctcgggagccccaggtttacacactgcctccctcccgcgacgaacttaccaagaaccaagtctctctgacatgcctcgtgaaaggcttctatccgagcgacatcgccgtggagtgggagtccaatgggcagcctgaaaacaactacaagaccacgccccctgtcctggattctgacggatccttctttctgtattccaaactcacagtggataagagcagatggcagcaaggcaatgttttctcttgctccgtgatgcacgaggggctgcataaccactacacccaaaagagcctttctctgtcccccggaaaa

SEQ ID NO: 43546 - RNA, 1428 nt, synthetic construct; identical to SEQ ID NO: 43545
  misc_feature 1..1428: note = derived and/or modified sequence opt5 from anti-influenza_Chain
  source 1..1428: mol_type = other RNA

SEQ ID NO: 43547 - RNA, 1428 nt, synthetic construct; identical to SEQ ID NO: 43545
  misc_feature 1..1428: note = derived and/or modified sequence opt5 from anti-influenza_Chain
  source 1..1428: mol_type = other RNA

SEQ ID NO: 43548 - RNA, 1440 nt, synthetic construct
  misc_feature 1..1440: note = derived and/or modified sequence opt5 from anti-influenza_Chain
  source 1..1440: mol_type = other RNA
atgcccagcgtgaagatcggcattatcggggccggatccgctgtcttctctctgagactcgttagcgacctgtgcaaaacccctggcctttccgggtctacagtgacgctgatggatattgacgaggaacggctcgatgccatcctgaccattgcgaagaaatacgtggaggaagtcggagctgaccttaagtttgagaaaacaatgaacctggatgacgtgatcatcgatgccgacttcgttattaataccgccatggtgggcgggcacacatatctcgaaaaggtccgccagatcggagagaagtacggctattacagaggcattgatgctcaagagtttaacatggtgagcgactattacaccttctccaattataaccagctgaaatactttgttgatatcgcccggaagattgaaaaactgtctccgaaggcttggtacctccaggccgcgaatcccatcttcgaggggacaaccctggtgacgcgcaccgtccctattaaagccgtgggattttgtcatggccactatggggtgatggaaatcgtcgagaaacttggactggaggaagagaaggttgactggcaagtggctggcgtgaaccatgggatctggctcaatagattccggtacaacggaggcaatgcctatcccctgcttgataagtggattgaagaaaagagcaaagactggaagcctgaaaacccctttaatgaccagctgtcccctgctgccatcgatatgtaccgcttctatggcgtcatgccgattggggacacagtgagaaacagctcttggcggtaccaccgcgatctcgagaccaaaaagaaatggtatggagagccctggggcggggcggactccgaaatcggatggaagtggtaccaggatacactgggcaaggttaccgagattacgaaaaaggtggccaaatttatcaaggaaaatcctagcgtcagactgtctgacctcgggtccgtgctgggaaaagatcttagcgagaagcagttcgttctggaagtggagaagatcctcgaccccgagcggaaatctggcgaacagcatattccttttatcgatgctctgcttaacgacaataaggcccgcttcgtcgtgaacattcccaacaaaggcatcattcacgggatcgatgacgacgtcgtggttgaggtgccggctctggtcgataagaatggaatccaccctgagaaaattgagccccctctccccgacagagtggttaagtactatctgcggccccgcatcatgagaatggaaatggccctggaggccttcctcacaggcgatattcggatcattaaggagctgctttacagagaccctcgcaccaaatccgatgaacaagtggagaaggtcatcgaagagattctggctctcccggagaacgaagagatgcggaaacattatctgaagaga

SEQ ID NO: 43549 - RNA, 1440 nt, synthetic construct; identical to SEQ ID NO: 43548
  misc_feature 1..1440: note = derived and/or modified sequence opt5 from anti-influenza_Chain
  source 1..1440: mol_type = other RNA

SEQ ID NO: 43550 - RNA, 1443 nt, synthetic construct
  misc_feature 1..1443: note = derived and/or modified sequence opt5 from anti-influenza_Chain
  source 1..1443: mol_type = other RNA
atgaagttccccaaagactttatgatcggctacagctcctctcctttccagtttgaggccgggattccgggaagcgaagatcccaactccgactggtgggtgtgggtccacgatcctgagaataccgctgccggcctggtttctggggacttccccgaaaacggacctggctattggaatctcaaccaaaatgatcatgacctggcggagaaacttggggtgaacacaatcagagtgggagtcgaatggagccggatttttcccaagcctacgttcaatgtgaaggttccggtggagcgcgatgagaacggctccatcgtccacgtggacgttgatgacaaagctgtggaaagactggatgagctcgccaataaggaagccgtcaaccattacgtggagatgtataaggactgggtggagcggggccgcaaactgattcttaatctgtaccactggcccctccctctgtggctgcataaccccatcatggtcagacggatggggcctgatcgcgctccctctggatggctcaatgaagagagcgttgtggaatttgccaagtatgctgcctacatcgcgtggaaaatgggcgagctgccggtgatgtggtccaccatgaacgaacctaatgtcgtgtatgagcaggggtacatgttcgttaagggaggctttccccctgggtaccttagcctggaggccgctgacaaagccagacggaacatgattcaggctcacgcccgcgcgtatgacaacatcaagagattctctaagaaacccgtgggactcatttacgcctttcagtggttcgaactgcttgagggccccgctgaagtctttgataagttcaaatccagcaagctgtattacttcacagacatcgtgtctaaaggctccagcattatcaatgttgagtatcggcgcgatctcgccaacagactggactggctgggggtgaattactattctcggctcgtctacaagattgtggatgacaaacctatcatcctgcacggatacggctttctttgcacccccgggggaatttccccggctgaaaacccttgtagcgatttcggctgggaggtctatcccgaggggctgtacctcctgcttaaggaactgtataatcgctacggagtggacctcatcgttacagagaacggcgtgtccgattctagagacgccctgcggcctgcctatctggtcagccatgtgtactccgtttggaaggctgcgaatgaaggcattcccgtgaaagggtatctccactggagcctgaccgataactacgagtgggcccaaggatttagacagaagttcggccttgtcatggtggactttaaaacaaagaaacgctacctgcggccgtctgctctcgtgttcagagaaatcgccacccataatgggattcctgacgagctgcagcaccttacgctgatccag

SEQ ID NO: 43551 - RNA, 1443 nt, synthetic construct; identical to SEQ ID NO: 43550
  misc_feature 1..1443: note = derived and/or modified sequence opt5 from anti-influenza_Chain
  source 1..1443: mol_type = other RNA

SEQ ID NO: 43552 - RNA, 1464 nt, synthetic construct
  misc_feature 1..1464: note = derived and/or modified sequence opt5 from anti-influenza_Chain
  source 1..1464: mol_type = other RNA
cacgcccaggacatcctggagaagacccataacggcaaactctgcgatctggacggggtgaagccccttattctgagagattgtagcgtcgctggatggctcctgggcaatcctatgtgcgacgagttcatcaacgttccggaatggtcctacattgtggaaaaagccaatcccgcgaacgatctttgttatcctgggaattttaacgactacgaggaactgaagcacctcctgtctcggatcaatcatttcgagaaaattcaaatcatccccaagagctcctggtctgatcacgaggctagctccggagtgtctagcgcctgcccttatcagggcacaccctcctttttccgcaacgtcgtgtggctgattaagaaaaataacacgtaccctaccatcaagagaagctataataacacaaatcaggaagacctcctgattctttgggggatccatcactctaacgatgccgctgagcagaccaaactgtaccaaaatccgacaacctatatttccgttggaacaagcaccctcaaccagcggctggtgcccaagatcgccacgcgctctaaagtcaacggccagaatggcagaatggactttttctggaccattcttaagcctaacgatgctatcaattttgaatccaacgggaatttcatcgcccccgagtacgcgtacaagattgtgaaaaagggatatatccctgaggctccccgggacggccaggcctacgttcgcaaagatggggaatgggtgctgctcagcacatttctgagatctgacaagacccacacatgtccgccttgccccgcccctgagctgctcggaggcccctccgtcttcctgtttccccctaaaccgaaggacacccttatgattagccggacgcccgaagtgacatgtgtggtcgttgatgtgtcccatgaggaccctgaagtgaaattcaactggtatgtcgatggggtggaggttcacaatgctaagaccaagccccgcgaggaacaatacaactctacatatagagtggtcagcgtgctgaccgttctccatcaggactggctgaatggaaaagagtacaagtgcaaagtgtccaacaaggcccttcctgcgcccatcgagaaaaccattagcaaggccaagggccagccgcgggaacctcaggtctatacactgcccccttctcgcgaagagatgacgaaaaatcaagtgtccctcacctgtctggtcaagggcttttaccccagcgatatcgctgtggagtgggaatctaacgggcagcctgagaataactacaaaacaacacccccggttctggacagcgatggatccttcttcctctattctaagctgaccgtggacaaaagcagatggcagcaaggcaatgtcttttcctgcagcgtgatgcacgaagcccttcacaaccattacacccagaagtctctgtccctcagccctgggaag

SEQ ID NO: 43553 - RNA, 1464 nt, synthetic construct; identical to SEQ ID NO: 43552
  misc_feature 1..1464: note = derived and/or modified sequence opt5 from anti-influenza_Chain
  source 1..1464: mol_type = other RNA

SEQ ID NO: 43554 - RNA, 1473 nt, synthetic construct
  misc_feature 1..1473: note = derived and/or modified sequence opt5 from anti-influenza_Chain
  source 1..1473: mol_type = other RNA
atgctgagcttccccaagggctttaaattcgggtggtcccagtctggatttcaaagcgagatgggcacccctgggtccgaagacccgaactctgattggcacgtgtgggtccatgacagagagaatatcgttagccaggtggtgtccggagatctccccgaaaacggccctgggtactggggaaattataagcggttccacgacgaggccgagaaaattggcctgaacgctgtccgcatcaatgtggagtggtctagaatttttccccggcctcttcccaagcctgagatgcagacaggcacggataaagaaaacagcccggttatctccgtggacctgaatgagagcaagctccgcgaaatggataactacgccaatcatgaggcgctgtctcactatagacagattcttgaggacctgcggaaccgcgggttccatatcgtcctcaatatgtaccactggaccctgcccatctggctgcacgatcctattagagtgcggcgcggagactttacaggccccaccgggtggctcaactccagaacagtttatgaatttgctcggtttagcgcctacgtggcctggaagctggatgaccttgcttctgagtatgccaccatgaatgaacctaacgtcgtgtggggagctggctacgccttcccccgcgcggggtttccgcctaattacctgtccttcagactcagcgagatcgccaaatggaacattatccaagctcatgcccgggcttatgatgccattaagtctgtgtccaaaaagagcgtcggaatcatttacgcgaacacatcctattaccccctgcgccctcaggacaatgaagccgttgagatcgctgagagacttaaccggtggtctttcttcgacagcatcattaaaggcgaaatcacctccgagggccagaatgtgagagaagatctgcgcaaccggctcgactggattggggtgaattattacacgagaaccgtcgtgacaaaggccgagagcggatatctgaccctgcccggctacggggatcgctgcgaacggaactctctctccctggctaatcttcccacaagcgacttcggatgggagtttttccctgagggcctgtacgatgttctcctgaagtattggaacagatacgggcttccgctgtatgtgatggaaaatggaatcgccgacgatgccgactaccagcgcccctattacctcgtctctcacatttatcaagtgcatcgggctctgaacgagggcgttgatgtgagaggctacctgcactggagcctcgcggacaattacgaatggtcctctgggtttagcatgcgcttcggactgcttaaagtcgattatctgaccaagcggctctactggagaccttccgccctggtgtatcgcgagatcacgcggagcaacggcatccccgaagaacttgagcacctgaatagagtccctcccattaaaccgctccggcat

SEQ ID NO: 43555 - RNA, 1473 nt, synthetic construct; identical to SEQ ID NO: 43554
  misc_feature 1..1473: note = derived and/or modified sequence opt5 from anti-influenza_Chain
  source 1..1473: mol_type = other RNA

SEQ ID NO: 43556 - RNA, 1494 nt, synthetic construct
  misc_feature 1..1494: note = derived and/or modified sequence opt5 from anti-influenza_Chain
  source 1..1494: mol_type = other RNA
atggccagccagggcaccaagagatcctacgagcaaatggaaacagacggggagcggcagaacgctacggaaatccgcgcctctgtgggaaaaatgattggcgggatcggaagattctatattcagatgtgcaccgagctgaagctcagcgattacgaaggccggctgatccaaaattcccttacaattgagcgcatggtcctgtctgcgtttgacgagagacggaacaaatatctcgaagaacaccccagcgctgggaaggatcctaaaaagaccggaggcccgatctaccgcagagttaatggcaagtggatgcgggaactgatcctttatgacaaagaggagattcgcagaatctggcggcaggccaacaatggggatgacgccacagctggactgacccatatgatgatttggcactccaacctcaatgatgccacataccagcgcaccagagctctggtgcggacgggcatggacccccgcatgtgttctctgatgcaggggagcaccctccctagacggtccggagccgcgggcgccgctgtgaagggggtcggaacaatggtgatggaactggttagaatgatcaaacgcggcattaacgatcggaatttctggagaggcgagaacgggcgcaagacccggatcgcctatgaaagaatgtgcaatattcttaaaggaaagtttcagacagctgcccaaaaggcgatgatggaccaggtgcgcgagagccgggatcccggcaacgccgagttcgaggacctgacctttctcgctagatctgccctgatccttcgcgggtccgtcgctcataaaagctgtctgcctgcctgcgtgtacggacccgccgttgcttctggctacgatttcgagcgggaagggtattccctcgtgggaatcgacccttttagactgctgcagaatagccaggtctactctctcattcgcccgaacgagaatcccgcgcacaagtcccaactggtgtggatggcctgtcatagcgctgccttcgaagaccttcgggtgctgtcctttatcaaaggcacgaaggtcgttcctagaggcaaactctctacacgcggggtgcagattgccagcaacgagaacatggaaaccatggagtccagcacactggagcttcggtctagatattgggctatccggaccagatccggaggcaataccaaccagcaacgcgccagcgcggggcagatttctatccagcccacattcagcgtgcagcggaatctgccttttgatagaacgaccgtcatggctgccttcacaggaaacaccgaaggccgcacatccgacatgagaaccgagatcattcggatgatggaatctgcccgccccgaggatgtgagctttcaagggagaggcgttttcgaactctccgacgagaaggctgccagcccgatcgtgccttctttcgatatgtccaatgagggaagctactttttcggcgacaacgctgaagagtatgataat

SEQ ID NO: 43557 - RNA, 1494 nt, synthetic construct
  misc_feature 1..1494: note = derived and/or modified sequence opt5 from anti-influenza_Chain
  source 1..1494: mol_type = other RNA
atggccagccagggcaccaagagatcctacgagcaaatggaaacagacggggagcggcagaacgctacggaaatccgcgcctctgtgggaaaaatgattgatggcatcgggagattctatattcagatgtgcaccgagctgaagctcagcgactacgaaggacggctgatccaaaattcccttacaattgagcgcatggtcctgtctgcgtttgatgagagacggaacaaatatctcgaggaacaccccagcgctggcaaggaccctaaaaagaccgggggaccgatctacaagcgcgttgatggcaaatggatgagagaactggtgctttatgacaaggaggagatccggcgcatttggagacaggccaataacggcgatgacgccacagctgggctgacccatatgatgatctggcactccaatctcaacgatacaacctaccagcggacgcgcgccctggtgagaaccggaatggacccccggatgtgttctctgatgcagggcagcacactccctcgcagatccggggctgccggagcggccgtcaaaggcgtggggaccatggttatggaactgattcggatgatcaagagaggaattaatgatcgcaacttctggcggggcgagaatggcagaaaaacacgcagcgcttatgaacggatgtgcaacatccttaaggggaagtttcagaccgccgctcaaagagccatgatggaccaggtgcgcgagtctcggaatcccggaaacgcggaaattgaggatctgatcttcctcgccagatccgctctgatccttcgcggcagcgtcgcccataaatcttgtctgcctgcttgcgtgtacgggcccgccattgcctccggatacaattttgagaaggaaggctatagcctcgttgggatcgaccctttcaaactgctgcagaactctcaggtgtactccctcattcggccgaatgagaaccccgctcacaagagccaactggtctggatggcgtgtaactccgccgcttttgaagaccttagagtgctgtctttcatccgcggaacgaaagtgagccctcggggcaagctctccacaagaggcgtccagattgccagcaatgagaacatggataccatggaatcttccacactggagcttcggagccgctattgggccatcagaacccggtctgggggaaataccaaccagcaaagagctagcgccggccagatctccgttcagcccgcgttttctgtgcagcgcaatctgcctttcgacaaacccacaattatggctgcctttacggggaacaccgagggacggacaagcgatatgagagccgaaatcattcgcatgatggagggcgctaagccggaagagatgtccttccaagggagaggcgtgtttgaactcagcgacgagaaggccaccaatcctatcgtcccctctttcgatatgtccaacgagggaagctacttctttggcgacaatgctgaagagtatgataac

SEQ ID NO: 43558 - RNA, 1494 nt, synthetic construct
  misc_feature 1..1494: note = derived and/or modified sequence opt5 from anti-influenza_Chain
  source 1..1494: mol_type = other RNA
atggccagccagggcaccaagagatcctacgagcaaatggaaacagggggagagcggcagaacgctacggaaatccgcgcctctgtgggcagaatggtcgggggaattggccggttctatgttcagatgtgcaccgagctgaaactcagcgaccaggaagggcgcctgatccaaaattccattacaatcgagagaatggtgctttctgcgtttgatgagcggcgcaacagatacctggaggaacaccccagcgctggaaaggaccctaaaaagaccggcggcccgatttatcggcgcagagatgggaaatgggtgcgggaactcatcctgtacgacaaggaggagatccgcagaatttggcggcaggccaataacggagaagatgccacagctggccttacccatatgatgatctggcactccaatctgaacgacgccacatatcagcgcaccagagctctcgtccggacggggatggatcccagaatgtgttctctgatgcagggaagcaccctgcctcgccggtccggcgccgcgggggccgctattaagggagtgggcacaatggttatggagctcatcagaatgattaaacgcggcatcaatgaccggaacttctggagaggggataatggacgccggaccagaattgcctacgaacgcatgtgcaacatcctgaagggcaaatttcaaacagctgcccagcgggcgatgatggaccaggtgagagagagccgcaatcccgggaacgccgaaatcgaggatcttattttcctggctcggtctgccctcatcctgagaggatccgtcgctcataagagctgtcttcctgcctgcgtgtatggcctggccgttgcttctgggtacgactttgagcgggaaggatactccctcgtgggcattgatcccttccgcctgctgcagaatagccaagtcttttctctcatcagacctaacgagaatccggcgcacaaatcccagctggtgtggatggcctgtcatagcgctgccttcgaagaccttcgggtgtcctcttttattagaggcacccgcgtcatcccccgggggcagctgagcacgagaggagttcaaatcgcctccaacgagaacgtggaagctatggacagctctacactcgagctgcgctccagatattgggccattcggacccgcagcggcgggaatacaaaccagcagagagcgtctgctggacagatcagcgtgcaacctaccttctccgtccagcggaatcttccctttgagcgccctaccattatggccgccttcaagggcaacacagaagggagaacgtctgatatgcggaccgagatcattcgcatgatggaaagcgctagacccgaggacgtgtcctttcagggccggggagttttcgaactgagcgatgagaaggccacaaatccgatcgtgccttctttcgacatgtccaacgagggcagctactttttcggggataatgctgaagagtatgacaac

SEQ ID NO: 43559 - RNA, 1494 nt, synthetic construct; identical to SEQ ID NO: 43556
  misc_feature 1..1494: note = derived and/or modified sequence opt5 from anti-influenza_Chain
  source 1..1494: mol_type = other RNA

SEQ ID NO: 43560 - RNA, 1494 nt, synthetic construct; identical to SEQ ID NO: 43557
  misc_feature 1..1494: note = derived and/or modified sequence opt5 from anti-influenza_Chain
  source 1..1494: mol_type = other RNA

SEQ ID NO: 43561 - RNA, 1494 nt, synthetic construct; identical to SEQ ID NO: 43558
  misc_feature 1..1494: note = derived and/or modified sequence opt5 from anti-influenza_Chain
  source 1..1494: mol_type = other RNA

SEQ ID NO: 43562 - RNA, 1530 nt, synthetic construct
  misc_feature 1..1530: note = derived and/or modified sequence opt5 from anti-influenza_Chain
  source 1..1530: mol_type = other RNA
atgttccccgagaagtttctgtggggcgtggcccagagcgggttccaatttgaaatgggagacaaactcagacggaacatcgataccaatacagactggtggcactgggtccgcgataagacgaacattgagaaaggcctggtttccggggaccttcctgaagagggaatcaataactacgaactgtatgagaaggatcatgagattgctagaaaactcggcctgaatgcctaccggatcgggattgaatggtctcgcatcttcccgtggcccaccacatttatcgacgtggattatagctacaacgagtcctataatcttattgaagacgtgaagatcaccaaggatacactggaggagctcgacgaaattgcgaacaaaagagaggtcgcttactatcggtctgtgatcaatagcctgcgctccaagggattcaaagttattgtgaacctgaatcactttaccctcccttactggctgcatgatcccatcgaagccagagagcgggcccttacaaacaagcgcaatggctgggtcaaccctagaaccgtgattgaatttgctaaatacgccgcttatatcgcctacaagtttggcgacatcgttgatatgtggtctacgttcaatgagcccatggtggtcgtggagctggggtatctcgcgccttacagcggatttccgcccggcgtgctgaaccctgaagccgctaaacttgccattctgcacatgatcaacgctcatgccctcgcgtatcggcagattaagaagttcgacaccgagaaagccgacaaggattccaaagaacccgctgaggtcgggatcatttacaataacatcggagttgcctatcctaaggaccccaatgatagcaaagacgtgaaggctgccgaaaacgataatttcttccactctggcctgttctttgaggccatccacaaggggaaactgaacattgagttcgacggagaaacatttatcgatgctccgtacctcaagggcaatgactggattggcgtgaactactatacccgcgaggtcgtgacataccaggaacctatgttcccctccatccctctgattacctttaaaggggttcagggatatggctacgcgtgcagacccgggacgcttagcaaggatgaccggcccgtgtctgatatcggatgggagctgtatcctgaaggcatgtacgactccatcgtcgaggcccataaatatggggtgccggtttacgtgacagagaatggaattgctgacagcaaggatatcctccgcccctactatattgcctctcacatcaagatgaccgaaaaagccttcgaggacggctacgaagtcaagggctattttcattgggctctgacagataacttcgagtgggcccttgggtttagaatgcggttcggactgtacgaggtgaatctcattaccaaagaaagaatccctcgcgagaagtccgtcagcatttttcgggaaatcgtggcgaacaatggcgttaccaaaaagatcgaggaggaactgctgagaggg

SEQ ID NO: 43563 - RNA, 1530 nt, synthetic construct; identical to SEQ ID NO: 43562
  misc_feature 1..1530: note = derived and/or modified sequence opt5 from anti-influenza_Chain
  source 1..1530: mol_type = other RNA

SEQ ID NO: 43564 - RNA, 1536 nt, synthetic construct
  misc_feature 1..1536: note = derived and/or modified sequence opt5 from anti-influenza_Chain
  source 1..1536: mol_type = other RNA
atgaagagaaaagtgaagaaaatggccgctatggccaccagcatcattatggcgatcatgattatcctgcactccattcccgtcctcgctggccggatcatctacgacaacgagacagggacgcatggaggctatgattacgaactgtggaaggactatgggaataccattatggagcttaacgatggaggcacattctcttgccagtggagcaatatcgggaacgccctgtttcgcaaaggaagaaagttcaattccgacaagacctaccaagaactcggcgatattgttgtggagtatggctgtgactacaaccctaatgggaactcttatctgtgcgtgtacggatggacacggaatccgcttgtcgaatactatatcgtggagagctggggctcctggagaccccctggggccacccccaaaggaacaattacccagtggatggctggcacgtacgagatctatgaaaccacacgcgttaaccagccttctattgatgggaccgccacatttcagcaatactggagcgtgcggacctccaagcgcacgagcggaacaatctctgtcaccgagcacttcaaacagtgggaaagaatgggcatgcggatgggcaagatgtatgaggtggctctgacagttgaggggtaccagtccagcggatatgccaatgtgtacaaaaacgaaatccgcattggcgcgaatcccacccctgccccgtctcagtcccccatcagacgggacgcttttagcattatcgaggccgaagagtacaactctaccaattccagcacactccaagtcattgggacgcctaacaacggacgcggcatcgggtatatcgaaaatggaaacaccgtgacatactccaatattgatttcggctctggcgctaccgggtttagcgccacagtggcgaccgaggtcaacacgtccatccagattagaagcgactctcccacaggaaccctgctgggcaccctctatgtttccagcacagggtcttggaatacctaccagacagtgagcacgaacatctccaagattaccggagtgcatgatatcgtcctggtgttctctggccctgttaatgtggacaactttatcttcagccggtccagccccgtcccggcccctggggataatacacgcgacgcttattctattatccaggccgaggactacgattccagctatggccccaaccttcaaatcttttctctgcctggaggcgggtccgctattggatacattgaaaatggctacagcaccacatataagaacatcgacttcggggatggagccacctccgtgacggccagagttgctacccagaatgcgacaaccattcaggtgcggctcggctctcccagcgggacactgcttggcaccatctacgtcggatccacgggctcttttgacacatatagagatgtgagcgccaccatctccaacacagctggggtcaaagacattgtgctggttttcagcggacccgtgaatgtcgattggttcgtgttttctaagtccggcacc

SEQ ID NO: 43565 - RNA, 1536 nt, synthetic construct; identical to SEQ ID NO: 43564
  misc_feature 1..1536: note = derived and/or modified sequence opt5 from anti-influenza_Chain
  source 1..1536: mol_type = other RNA

SEQ ID NO: 43566 - RNA, 1539 nt, synthetic construct
  misc_feature 1..1539: note = derived and/or modified sequence opt5 from anti-influenza_Chain
  source 1..1539: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgagttcattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttggggcattcaccactccaacgacgctgccgagcaaaccaagctgtatcagaatccgacgacctacatcagcgtgggaacatctaccctcaaccagcggctggttcccaaaatcgctacacgctccaaggtgaatggccagaacgggagaatggactttttctggaccattcttaagcctaatgatgccatcaactttgagagcaatggaaacttcattgcgcccgaatacgcctataaaatcgtcaagaaaggctacattcctgaggctccccgggatgggcaagcctatgtgcgcaaggacggagaatgggtgctgctctctacgtttctgagatccgacaaaacacatacctgcccgccttgtcccgctcctgagctgctcggcgggcccagcgtcttcctgtttccccctaagccgaaagatacacttatgatctcccggacccccgaagttacctgcgtggtggtcgacgtgtctcacgaggatcctgaggttaagttcaattggtacgtggacggagtcgaagtgcataacgccaagacaaaaccccgcgaggaacagtataatagcacgtacagagttgtgtccgtcctgaccgtgctccaccaggattggctgaacggcaaggagtataaatgtaaggtcagcaataaagcgcttcctgcccccatcgaaaagacaatttctaaggctaaaggccagccgcgggagcctcaagtgtacaccctgcccccttcccgcgaggaaatgacaaagaaccaggttagccttacctgcctggtgaaagggttttacccctctgacatcgccgtcgagtgggaaagcaatggacagcctgagaacaactataagacgacacccccggtgctggattccgacggctctttcttcctctacagcaaactgaccgttgataagtccagatggcaacaggggaatgtgtttagctgttctgtcatgcacgaagctctccataaccactatacccagaagtccctgagcctctctcctggaaaa

SEQ ID NO: 43567 - RNA, 1539 nt, synthetic construct; identical to SEQ ID NO: 43566
  misc_feature 1..1539: note = derived and/or modified sequence opt5 from anti-influenza_Chain
  source 1..1539: mol_type = other RNA

SEQ ID NO: 43568 - RNA, 1593 nt, synthetic construct
  misc_feature 1..1593: note = derived and/or modified sequence opt5 from anti-influenza_Chain
  source 1..1593: mol_type = other RNA
accctgtgcatcggctaccacgccaacaatagcacagacacggtggataccgtcctcgagaagaacgttacagtgacccattccgtgaatctgcttgaagacaaacacaacgggaagctgtgtaaactcagaggagtcgctcccctgcatcttggcaagtgcaatattgccgggtggatcctgggaaaccctgagtgtgaatctctcagcacagcgtcctcttggagctatattgtggagacctcctctagcgataatggcacatgctacccgggggacttcatcgattatgaggaactgcgggagcagctgtccagcgtttcttcctttgaacgcttcgagatttttcccaaaaccagctcttggcctaaccacgactccaataagggagtgacggctgcctgtccccatgccggcgctaagagcttctacaaaaacctcatctggctggtcaagaaaggcaattcttatcctaaactttccaagagctacatcaacgataaggggaaggaagtgctggttctctggggcattcaccacccctccacctctgccgaccaacagagcctgtatcagaatgctgatgcctacgtgtttgtcggaacatccagatacagcaaaaagttcaaacctgagatcgcgattcggccgaaggtgcgcgaccaggaggggagaatgaactattactggacccttgtggaacccggagataaaatcacatttgaggccaccggcaatctggtcgttcctcggtatgctttcgccatggaacgcgacgctgggtctggaattatcatttccgatacgcccgtgcatgactgcaacacaacctgtcaaacacctaagggcgccatcaacaccagcctcccctttcagaatatccacccgattaccatcggcaaatgccctaagtacgtgaagtctacaaaactgagactggcgacggggctccggaacgtccccagcattcagtcccgcggactgttcggcgccatcgctgggtttattgagggaggctggaccgggatggtggacggatggtatggctaccatcaccagaatgaacaaggctctgggtatgccgctgatcttaagagcacacagaacgccatcgacgagatcaccaataaagttaactccgtgattgagaagatgaatacacagttcaccgccgtcggaaaagaatttaaccacctggagaagagaatcgaaaatctcaacaagaaaattgatgacggcttcctggatatctggacgtacaatgctgagcttctggtgctcctggaaaacgagcggacactggactaccatgatagcaatgttaagaacctctatgagaaagtgcgctctcagctgaagaataacgcgaaagaaattgggaacggatgtttcgagttttaccacaagtgcgacaatacctgtatggaatccgtcaagaacggcacctatgattaccctaaatatagcgaggaagccaaacttaatagagaggagatcgacggggtgaagctggaatctacacggatctaccaaattctcgctatctattccaccgtcgccagctccctggtgcttgttgtgtctctgggcgcc

SEQ ID NO: 43569 - RNA, 1593 nt, synthetic construct
  misc_feature 1..1593: note = derived and/or modified sequence opt5 from anti-influenza_Chain
  source 1..1593: mol_type = other RNA
accctgtgcatcggctaccacgccaacaatagcacagacacggtggataccgtcctcgagaagaacgttacagtgacccattccgtgaatctgcttgaagacaaacacaacgggaagctgtgtaaactcagaggagtcgctcccctgcatcttggcaagtgcaatattgccgggtggatcctgggaaaccctgagtgtgaatctctcagcacagcgtcctcttggagctgcattgtggagacctcctctagcgataatggcacatgttatccgggggacttcatcgattacgaggaactgcgggagcagctgtccagcgtttcttcctttgaacgcttcgagatttttcccaaaaccagctcttggcctaaccacgactccaataagggagtgacggctgcctgcccccatgccggcgctaagagcttctataaaaacctcatctggctggtcaagaaaggcaattcttaccctaaactttccaagagctatatcaacgataaggggaaggaagtgctggttctctggggcattcaccacccctccacctctgccgaccaacagagcctgtaccagaatgctgatgcctatgtgtttgtcggaacatccagatacagcaaaaagttcaaacctgagatcgcgattcggccgaaggtgcgcgaccaggaggggagaatgaactactattggacccttgtggaacccggagataaaatcacatttgaggccaccggcaatctggtcgttcctcggtacgctttcgccatggaacgcgacgctgggtctggaattatcatttccgatacgcccgtgcatgactgtaacacaacctgccaaacacctaagggcgccatcaacaccagcctcccctttcagaatatccacccgattaccatcggcaaatgtcctaagtatgtgaagtctacaaaactgagactggcgacggggctccggaacgtccccagcattcagtcccgcggactgttcggcgccatcgctgggtttattgagggaggctggaccgggatggtggacggatggtacggctatcatcaccagaatgaacaaggctctgggtacgccgctgatcttaagagcacacagaacgccatcgacgagatcaccaataaagttaactccgtgattgagaagatgaatacacagttcaccgccgtcggaaaagaatttaaccacctggagaagagaatcgaaaatctcaacaagaaaattgatgacggcttcctggatatctggacgtataatgctgagcttctggtgctcctggaaaacgagcggacactggactaccatgatagcaatgttaagaacctctacgagaaagtgcgctctcagctgaagaataacgcgaaagaaattgggaacggatgcttcgagttttatcacaagtgtgacaatacctgcatggaatccgtcaagaacggcacctacgattatcctaaatacagcgaggaagccaaacttaatagagaggagatcgacggggtgaagctggaatctacacggatctatcaaattctcgctatctactccaccgtcgccagctccctggtgcttgttgtgtctctgggcgcc

SEQ ID NO: 43570 - RNA, 1593 nt, synthetic construct
  misc_feature 1..1593: note = derived and/or modified sequence opt5 from anti-influenza_Chain
  source 1..1593: mol_type = other RNA
accctgtgcatcggctaccacgccaacaatagcacagacacggtggataccgtcctcgagaagaacgttacagtgacccattccgtgaatctgcttgaagacaaacacaacgggaagctgtgtaaactcagaggagtcgctcccctgcatcttggcaagtgcaatattgccgggtggatcctgggaaaccctgagtgtgaatctctcagcacagcgtcctcttggagctatattgtggagacctcctctagcgataatggcacatgctacccgggggacttcatcgattatgaggaactgcgggagcagctgtccagcgtttcttcctttgaacgcttcgagatttttcccaacaccagctcttggcctaatcacgactccaacaaaggagtgacggctgcctgtccccatgccggcgctaagagcttctacaagaatctcatctggctggtcaaaaagggcaactcttatcctaaactttccaagagctacatcaatgataaagggaaggaagtgctggttctctggggcattcaccacccctccacctctgccgaccaacagagcctgtatcagaacgctgatgcctacgtgtttgtcggaacatccagatacagcaagaaattcaagcctgagatcgcgattcggccgaaagtgcgcgaccaggaggggagaatgaattattactggacccttgtggaacccggagataagatcacatttgaggccaccggcaacctggtcgttcctcggtatgctttcgccatggaacgcgacgctgggtctggaattatcatttccgatacgcccgtgcatgactgcaacacaacctgtcaaacacctaaaggcgccatcaataccagcctcccctttcagaacatccacccgattaccatcggcaagtgccctaaatacgtgaagtctacaaagctgagactggcgacggggctccggaatgtccccagcattcagtcccgcggactgttcggcgccatcgctgggtttattgagggaggctggaccgggatggtggacggatggtatggctaccatcaccagaacgaacaaggctctgggtatgccgctgatcttaaaagcacacagaatgccatcgacgagatcaccaacaaggttaattccgtgattgagaaaatgaacacacagttcaccgccgtcggaaaggaatttaatcacctggagaaaagaatcgaaaacctcaataagaagattgatgacggcttcctggatatctggacgtacaacgctgagcttctggtgctcctggaaaatgagcggacactggactaccatgatagcaacgttaaaaatctctatgagaaggtgcgctctcagctgaaaaacaacgcgaaggaaattgggaatggatgtttcgagttttaccacaaatgcgacaacacctgtatggaatccgtcaagaatggcacctatgattaccctaagtatagcgaggaagccaaacttaacagagaggagatcgacggggtgaagctggaatctacacggatctaccaaattctcgctatctattccaccgtcgccagctccctggtgcttgttgtgtctctgggcgcc

SEQ ID NO: 43571 - RNA, 1593 nt, synthetic construct
  misc_feature 1..1593: note = derived and/or modified sequence opt5 from anti-influenza_Chain
  source 1..1593: mol_type = other RNA
accctgtgcatcggctaccacgccaacaatagcacagacacggtggataccgtcctcgagaagaacgttacagtgacccattccgtgaatctgcttgaagacaaacacaacgggaagctgtgtaaactcagaggagtcgctcccctgcatcttggcaagtgcaatattgccgggtggatcctgggaaaccctgagtgtgaatctctcagcacagcgtcctcttggagctatattgtggagacctcctctagcgataatggcacatgctacccgggggacttcatcgattatgaggaactgcgggagcagctgtccagcgtttcttcctttgaacgcttcgagatttttcccaaaaccagctcttggcctaaccacgactccaataagggagtgacggctgcctgtccccatgccggcgctaagagcttctacaaaaacctcatctggctggtcaagaaaggcaattcttatcctaaactttccaagagctacatcaacgataaggggaaggaagtgctggttctctggggcattcaccacccctccacctctgccgaccaacagagcctgtatcagaatgctgatgcctacgtgtttgtcggaacatccagatacagcaaaaagttcgggcctgagatcgcgattcggccgaaagtgcgcgaccaggagggaagaatgaactattactggacccttgtggaacccggcgataagatcacatttgaggccaccgggaatctggtcgttcctcggtatgctttcgccatggaacgcgacgctggatctggcattatcatttccgatacgcccgtgcatgactgcaacacaacctgtcaaacacctaaaggcgccatcaacaccagcctcccctttcagaatatccacccgattaccatcgggaagtgccctaaatacgtgaagtctacaaagctgagactggcgacgggactccggaacgtccccagcattcagtcccgcggcctgttcggggccatcgctggatttattgagggcgggtggaccggaatggtggacggctggtatggctaccatcaccagaatgaacaagggtctggatatgccgctgatcttaaaagcacacagaacgccatcgacgagatcaccaataaggttaactccgtgattgagaaaatgaatacacagttcaccgccgtcggcaaggaatttaaccacctggagaaaagaatcgaaaatctcaacaagaagattgatgacgggttcctggatatctggacgtacaatgctgagcttctggtgctcctggaaaacgagcggacactggactaccatgatagcaatgttaaaaacctctatgagaaggtgcgctctcagctgaaaaataacgcgaaggaaattggaaacggctgtttcgagttttaccacaaatgcgacaatacctgtatggaatccgtcaagaacgggacctatgattaccctaagtatagcgaggaagccaaacttaatagagaggagatcgacggcgtgaagctggaatctacacggatctaccaaattctcgctatctattccaccgtcgccagctccctggtgcttgttgtgtctctgggagcc

SEQ ID NO: 43572 - RNA, 1593 nt, synthetic construct; identical to SEQ ID NO: 43568
  misc_feature 1..1593: note = derived and/or modified sequence opt5 from anti-influenza_Chain
  source 1..1593: mol_type = other RNA

SEQ ID NO: 43573 - RNA, 1593 nt, synthetic construct; identical to SEQ ID NO: 43569
  misc_feature 1..1593: note = derived and/or modified sequence opt5 from anti-influenza_Chain
  source 1..1593: mol_type = other RNA

SEQ ID NO: 43574 - RNA, 1593 nt, synthetic construct; identical to SEQ ID NO: 43570
  misc_feature 1..1593: note = derived and/or modified sequence opt5 from anti-influenza_Chain
  source 1..1593: mol_type = other RNA

SEQ ID NO: 43575 - RNA, 1593 nt, synthetic construct; identical to SEQ ID NO: 43571
  misc_feature 1..1593: note = derived and/or modified sequence opt5 from anti-influenza_Chain
  source 1..1593: mol_type = other RNA

SEQ ID NO: 43576 - RNA, 1605 nt, synthetic construct
  misc_feature 1..1605: note = derived and/or modified sequence opt5 from anti-influenza_Chain
  source 1..1605: mol_type = other RNA
gccaacgctgacaccctgtgcatcggctaccacgccaataacagcacagatacggtggacaccgtcctcgagaagaatgttacagtgacccattccgtgaacctgcttgaagataaacacaatgggaagctgtgtaaactcagaggagtcgcgcccctgcatcttggcaagtgcaacattgctgggtggatcctgggaaatcctgagtgtgaatctctcagcacagcctcctcttggagctatattgtggagacctcctctagcgacaacggcacatgctacccgggggatttcatcgactatgaggaactgcgggagcagctgtccagcgtttcttcctttgaacgcttcgagatttttcccaaaaccagctcttggcctgatcacgactccaataagggagtgacggccgcttgtccccatgccggcgctaagagcttctacaaaaacctcatctggctggtcaagaaaggcaattcttatcctaaactttccaagagctacatcaacgataaggggaaggaagtgctggttctctggggcattcaccacccctccacctctgccgaccaacagagcctgtatcagaatgcggatgcctacgtgtttgtcggaacatccagatacagcaaaaagttcaaacctgagatcgctattcggccgaaggtgcgcgaccaggaggggagaatgaactattactggacccttgtggaacccggagataaaatcacatttgaggccaccggcaatctggtcgttcctcggtatgctttcgccatggaacgcaacgcggggtctggaattatcatttccgacacgcccgtgcatgactgcaacacaacctgtcaaacacctaagggcgccatcaataccagcctcccctttcagaacatccacccgattaccatcggcaaatgccctaagtacgtgaagtctacaaaactgagactggctacggggctccggaatgtccccagcattcagtcccgcggactgttcggcgccatcgctgggtttattgagggaggctggaccgggatggtggatggatggtatggctaccatcaccagaacgaacaaggctctgggtatgccgccgaccttaagagcacacagaatgctatcgataaaatcaccaacaaggttaattccgtgattgagaaaatgaacacacagttcaccgcggtcggaaaggagtttaatcacctggaaaagagaatcgagaacctcaataaaaaggtggacgatggcttcctggacatttggacgtacaacgccgaacttctggttctcctggagaatgaacggacactggattaccatgacagcaacgtgaaaaatctctatgagaaggtccgctctcagctgaaaaacaacgctaaggagatcgggaatggatgtttcgaattttaccacaagtgcgataacacctgtatggagtccgtgaaaaatggcacctatgactaccctaagtatagcgaagaggccaaacttaacagagaagagattgatggggtcaagctggagtctacacggatctaccaaatcctcgccatttattccaccgtggctagctccctggttcttgtggtctctctgggcgcc

SEQ ID NO: 43577 - RNA, 1605 nt, synthetic construct
  misc_feature 1..1605: note = derived and/or modified sequence opt5 from anti-influenza_Chain
  source 1..1605: mol_type = other RNA
gccaacgctgacaccctgtgcatcggctaccacgccaataacagcacagatacggtggacaccgtcctcgagaagaatgttacagtgacccattccgtgaacctgcttgaagataaacacaatgggaagctgtgtaaactcagaggagtcgcgcccctgcatcttggcaagtgcaacattgctgggtggatcctgggaaatcctgagtgtgaatctctcagcacagcctcctcttggagctatattgtggagacctcctctagcgacaacggcacatgctacccgggggatttcatcgactatgaggaactgcgggagcagctgtccagcgtttcttcctttgaacgcttcgagatttttcccaaaaccagctcttggcctaatcacgattccaacaagggagtgacggccgcttgtcccagagccggcgctaagggcttctacaaaaatctcatctggctggtcaagaaagggaacagctatcctaaacttaataagtcttacatcaacgacaagggaaaggaagtgctggttctctggggcattcatcacccctccaccacagccgatcaacagagcctgtatcagaatgcggacacctacgtgtttgtcgggacatcccggtactctaaaaagttcaaacctgagatcgagattcgcccgaaggtgagagatcaggaaggacggatgaactattactggacccttgtggagcccggcgacaaaatcacgtttgaagccacagggaacctggtcgttcctcgctatgctttcgccatggagagaaatgctggaagcggcattatcatttccgatacccccgtgcacgactgcaacacaacctgtcaaacccctaagggcgccatcaatacaagcctcccctttcagaacatccatccgattacgatcgggaaatgccctaagtacgtgaagtctaccaaactgcggctggcgacaggactccgcaatgtcccctccattcagagcagaggcctgttcggggccatcgctggatttattgaaggcgggtggaccggaatggtggacggctggtatggctaccaccatcagaacgagcaagggtctggatatgccgctgatcttaagagcacacagaatgccatcgacaaaatcaccaacaaggttaattccgtgattgagaaaatgaacacgcagttcacagccgtcgataaggaatttaatcacctggagaagcggatcgaaaacctcaataaaaaggtggacgatggcttcctggacatttggacctacaacgctgagcttctggttctcctggaaaatgagcgcaccctggattaccacgactctaacgtgaaaaacctctatgagaaggtcagaaatcagctgaaaaacaatgcgaaggaaatcgggaacggatgtttcgagttttaccataagtgcgataatacatgtatggaaagcgtgaaaaacggcacctatgactaccctaagtattccgaggaagccaaacttaatcgggaggagattgatggggtcaagctggaaagcacacgcatctaccaaatcctcgctatttattctacggtggcctccagcctggttcttgtggtctctctgggcgcc

SEQ ID NO: 43578 - RNA, 1605 nt, synthetic construct; identical to SEQ ID NO: 43576
  misc_feature 1..1605: note = derived and/or modified sequence opt5 from anti-influenza_Chain
  source 1..1605: mol_type = other RNA

SEQ ID NO: 43579 - RNA, 1605 nt, synthetic construct; identical to SEQ ID NO: 43577
  misc_feature 1..1605: note = derived and/or modified sequence opt5 from anti-influenza_Chain
  source 1..1605: mol_type = other RNA

SEQ ID NO: 43580 - RNA, 1644 nt, synthetic construct
  misc_feature 1..1644: note = derived and/or modified sequence opt5 from anti-influenza_Chain
  source 1..1644: mol_type = other RNA
cagaagctgcccggcaacgacaatagcaccgccacactctgcctggggcaccatgctgtgcctaacggaacgatcgtcaaaaccattacaaatgatcaaatcgaggttaccaacgccacagaacttgtgcagtcctctagcaccggcgagatttgtgactccccgcaccagatcctggatggggaaaattgcacactcattgacgcgctgcttggagatccccagtgtgacggcttccaaaacaagaaatgggatctgtttgtggagagatctaaggcttacagcaattgctatccttacgacgtccccgattatgcctccctccggtctctggtggccagctccgggaccctggaatttaacaatgagagcttcaactggacgggagttacccagaatggcacatcttccgcttgtatccgcagaagcaacaattctttcttttcccggctcaactggctgacccatcttaaattcaagtaccctgccctgaatgtgacaatgcccaacaacgagaagtttgacaaactctatatctggggcgtccaccatcctgggaccgataatgaccagattttcccgtacgctcaggccagcggacgcatcacggtgtctacaaagagatcccaacagaccgttattcccaacatcggcagccggcctcgcgtgagaaatattccctcccggatctctatttattggacaatcgtcaaacctggggatatcctgcttattaacagcaccggaaatctgatcgcgccccgcggctactttaagattagatccgggaaaagctctatcatgcggtccgacgccccgattggaaagtgcaacagcgaatgtatcacccctaatggctctatccccaacgacaagcctttccagaatgtgaaccgcattacatacggcgcttgccccagatatgtgaaacagaatacgctcaagctggccaccgggatgcggaacgtccccgagaaacaaacacgcggaatctttggcgctattgccgggttcatcgaaaatggatgggagggcatggttgatgggtggtacggatttagacaccagaacagcgagggcattggccaggcggccgacctgaagtccacccaagctgccatcgatcagatcaatgggaaactcaaccggctgattggaaagacaaacgaaaaattccaccagatcgagaaggagttctctgaagtggaaggccgcattcaggaccttgagaagtatgtggaggataccaaaatcgacctgtggagctacaatgctgaactcctggtcgcccttgagaaccaacatacgattgatctgacagactccgaaatgaataagctctttgagaaaaccaagaaacagctgagagaaaacgccgaggatatggggaatggatgtttcaagatctatcacaagtgcgacaacgcttgtattggcagcatccggaatgggacctacgatcatgacgtgtatagagacgaggcgctgaacaatcgctttcagatcaaaggcgttgaactcaagtctggatacaaagattggattctgtggatctccttcgccattagctgctttcttctgtgcgtggctctcctgggcttcatcatgtgggcctgtcagaaggggaacattcggtgcaatatc

SEQ ID NO: 43581 - RNA, 1644 nt, synthetic construct; identical to SEQ ID NO: 43580
  misc_feature 1..1644: note = derived and/or modified sequence opt5 from anti-influenza_Chain
  source 1..1644: mol_type = other RNA

SEQ ID NO: 43582 - RNA, 1647 nt, synthetic construct
  misc_feature 1..1647: note = derived and/or modified sequence opt5 from anti-influenza_Chain
  source 1..1647: mol_type = other RNA
atgctgaccttccacagaatcattcggaagggctggatgtttctcctggccttccttctgacagctctcctgttttgccccacggggcagcctgccaaagcggctgccccgttcaacggaaccatgatgcaatactttgagtggtatcttcccgacgatggcacactgtggaccaaggtggccaatgaagctaacaatctcagctccctggggatcacagccctgtggctccctcccgcttacaaaggaacctctcgcagcgacgtcggctatggggtttacgatctgtatgaccttggagagttcaaccagaagggcgccgtgagaacaaaatacggcaccaaggcgcagtatctgcaggccattcaagctgcccatgctgccgggatgcaagtgtacgcggatgtcgtgtttgaccacaagggaggcgccgatgggacggaatgggttgacgctgtggaggtcaatccttccgatcggaaccaggaaatctctggaacctaccagattcaggcctggacaaaattcgactttcccggccgcgggaatacctatagctccttcaagtggagatggtaccattttgatggagtggactgggatgagtctcggaaactcagccgcatctataagttcagaggcatcggcaaggcttgggactgggaggttgacacagaaaacgggaattacgattatctgatgtacgccgaccttgatatggaccaccctgaggtggtcaccgaactgaaatcctggggaaagtggtatgtgaacacgacaaatattgatggctttcggctcgacgccgtgaaacatatcaagttcagcttctttccggattggctgtctgacgtccgctcccagaccgggaaacccctgttcacagttggagagtactggagctacgatattaacaagctccacaattatatcatgaaaaccaacggcaccatgtctctgtttgacgctcctcttcacaataagttctacacagcgtccaaaagcgggggaacgtttgatatgagaaccctgatgacaaacaccctcatgaaggaccagcccacactggccgtgaccttcgtggacaaccatgatacggagcctggccaggcccttcaatcttgggtcgacccctggtttaagccgctggcttatgccttcattctcacacggcaggaaggctacccttgtgtgttttatggggattactatggaatcccccagtacaatattccttccctgaaaagcaagatcgaccccctgctcatcgctcgcagagattacgcctatggcacccaacacgactacctggatcattccgacattatcgggtggacccgggagggagttacagaaaaacccggctctgggcttgcggctctgattaccgatggccctggaggcagcaagtggatgtatgtggggaaacagcacgccggaaaggtcttctacgacctcacaggcaaccgctccgatacggtgaccatcaatagcgacgggtggggagagtttaaggttaacggcgggtctgtgtccgtctgggtgccgagaaaaacaaccgtcagcacaattgcctggtctatcaccacgcggccctggaccgatgagttcgtgagatggacagaacctcgcctggttgcttggccc

SEQ ID NO: 43583 - RNA, 1647 nt, synthetic construct
  misc_feature 1..1647: note = derived and/or modified sequence opt5 from anti-influenza_Chain
  source 1..1647: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgaatttattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttggggcattcaccactccaacgacgctgccgagcaaaccaagctgtatcagaatccgacgacctacatcagcgtgggaacatctaccctcaaccagcggctggttcccaaaatcgctacacgctccaaggtgaatggccagaacgggagaatggatttcttctggaccattcttaagcctaatgacgccatcaactttgagagcaatggaaacttcattgcgcccgaatacgcctataaaatcgtcaagaaaggcgattctgctattgtgaagtccgaggtggaatacgggaattgcaacacgaaatgtcaaacacctatcggagccatcaatagctccatgccctttcataacattcacccgctgaccatcggcgagtgccctaagtatgtcaaatctaataagctcgttctggctacagggctgcggaacagccccctccgctccgacaagacccatacctgtcctccctgccccgcccctgaactgcttggaggcccgagcgtgttcctgtttccccctaaacccaaggacacactcatgatttctagaacgcctgaggtgacctgtgtcgtggttgatgtgtcccacgaggaccccgaagtcaaattcaattggtacgtggatggcgttgaggtgcacaacgcgaagacaaaaccgcgggaggagcagtataacagcacctaccgcgtcgtgtctgtcctgacagtgcttcatcaggactggctgaatgggaaggaatataagtgcaaagttagcaacaaggccctccctgctcccatcgagaaaaccatttccaaggccaaaggacagcctagagagccccaagtgtacacgctgcctccctctcgggaagagatgacaaagaatcaggtcagcctgacctgcctcgtgaagggcttttacccgtccgatatcgctgttgaatgggagagcaacgggcagcctgaaaataactataaaaccacacctcccgtgctggactctgatggatccttcttcctttacagcaagctgaccgtcgacaaatctcgctggcaacagggcaatgtgttttcctgtagcgtgatgcacgaggccctccataaccactatacacagaagtccctgtctcttagccccgggaaa

SEQ ID NO: 43584 - RNA, 1647 nt, synthetic construct; identical to SEQ ID NO: 43583
  misc_feature 1..1647: note = derived and/or modified sequence opt5 from anti-influenza_Chain
  source 1..1647: mol_type = other RNA

SEQ ID NO: 43585 - RNA, 1647 nt, synthetic construct; identical to SEQ ID NO: 43582
  misc_feature 1..1647: note = derived and/or modified sequence opt5 from anti-influenza_Chain
  source 1..1647: mol_type = other RNA

SEQ ID NO: 43586 - RNA, 1650 nt, synthetic construct
  misc_feature 1..1650: note = derived and/or modified sequence opt5 from anti-influenza_Chain
  source 1..1650: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtgatctggacggagtgaaaccccttatcctgagagattgctccgtggccggctggctcctggggaaccctatgtgtgacgagttcattaatgtcccggagtggtcttatatcgtggaaaaggcgaaccccaccaatgatctttgctaccctggcagctttaacgactatgaggagctgaaacatctcctgtcccggatcaatcacttcgaaaagattcagatcattcccaagtctagctggtccgatcatgaggcttctagcggagtttccagcgcctgtccttacctggggtctccctcctttttccgcaacgtggtctggctcatcaaaaagaatagcacatatcctaccattaaaaagtcttacaacaatacaaaccaggaagacctgcttgtgctgtggggaatccaccacccgaatgatgccgctgagcaaaccagactctatcagaaccccacgacctacatttccatcggcacaagcaccctgaaccagcggcttgttcctaaaatcgccacacgctctaaggtgaatggccagtccgggagaatggagtttttctgggctattctgaagcccaacgacgccatcaattttgaaagcaacggaaatttcattgcgcctgagtacgcctataaaatcgtcaagaaaggcgattccgctattatgaagtctgaactcgagtacgggaactgcaataccaaatgtcaaacgcccatgggagccatcaacagctccatgccgtttcataatatccaccctctgacaattggcgaatgccccaagtatgtgaaaagcaaccggctggtgctcgctaccgggctgcgcaattctcctcagagagagtcccggcgcaagaagagaggacttttcggcgccatcgcgggctttattgaagggggatggcagggcatggtcgacgggtggtacggatatcatcacagcaacgaacagggctctgggtacgccgctgacaaagagagcacacaaaaggccatcggagttaccaataaagtgaactccattatcgataagatgaatacccagttcgaagctgtgggccgggagtttaacaacctggaacgcagaatcgagaatctcaacaaaaagatggaggacggcttcctggatgtctggacatataatgccgaacttctggtgctcatggagaacgaacggacgctggacttccacgattctaatgttaagaacctgtacgacaaagtgcgcctccagctgagagataatgccaaggagcttgggaacggatgttttgagttctaccataaatgcgacaatgaatgtatggagagcattcggaacggcacctataatccccaatactccgaagaggctagactgaagcgcgaagagatcagcggggtcaaactcgagtctattggaacatatcagatcctgtccatttacagcaccgtggcgtcttcccttgccctggctatcatgattgccggcctcagcctgtggatgtgctccaacgggtctctgcagtgccggatctgtatc

SEQ ID NO: 43587 - RNA, 1650 nt, synthetic construct; identical to SEQ ID NO: 43586
  misc_feature 1..1650: note = derived and/or modified sequence opt5 from anti-influenza_Chain
  source 1..1650: mol_type = other RNA

SEQ ID NO: 43588 - RNA, 1656 nt, synthetic construct
  misc_feature 1..1656: note = derived and/or modified sequence opt5 from anti-influenza_Chain
  source 1..1656: mol_type = other RNA
atgaacatccagattctggccttcatcgcttgcgtgctcaccggcgccaagggggacaaaatttgtctgggacaccatgcggtcgctaatggcacaaaggttaacacgcttaccgagaaagggatcgaagtggtgaatgccacagagaccgtcgaaacagccgatgtgaagaaaatttgcacccaaggaaagagagctacagacctgggccggtgtgggctcctgggaacccttatcgggccccctcagtgcgatcagtttctggagttcagctccgacctcatcattgaacgcagagagggcacggatgtttgttacccggggcggtttaccaacgaggaatctctgcgccagatcctgagacggagcggaggcattgggaaggagtccatgggattcacatattctggcatccgcaccaatggggccgctagcgcctgcacaagatccggatctagcttttacgcggaaatgaaatggctcctgtccaacagcgacaattctgccttcccccaaatgaccaaggcttatcggaaccctcgcaataaacccgcccttattatctggggcgtgcaccattccgagagcgcttctgagcagacgaagctgtacggctccgggaacaaactcattacagtcagaagctctaagtatcagcagtcctttacccctagccccggaacacggcgcatcgatttccactggctgcttctggaccctaatgataccgtgacctttacattcaacggcgcctttatcgcgccggacagagcctccttctttcggggcgaatctctcggagttcaaagcgatgctcccctggactccagctgtcgcggcgattgcttccattctgggggaacgattgtgtccagcctgcctttccagaatatcaactctagaaccgtcggccggtgtcccagatacgtgaagcagaaaagcctcctgcttgccacaggcatgcgcaatgtgcctgagaagcccaaaccgcgggggctgtttggagctattgccggcttcatcgaaaacgggtgggagggactcattaacggctggtatgggtttagacaccagaatgcccaaggcgaaggaaccgctgcggactacaagtccacacagtctgccatcgaccagatcaccggcaaactgaaccgccttattgggaagacgaatcaacagttcgagctgatcgataacgagtttaatgaaattgagcagcagatcggaaacgtcattaattggacacgggacgctatgaccgaaatctggagctacaacgccgagctcctggttgccatggaaaatcaacacaccatcgatctggctgactccgagatgagcaaactctatgagagagtgaagaagcagctgcgcgaaaacgccgaggaagatggcacagggtgcttcgagatttttcataaatgtgacgatcagtgcatggaatctatccggaataacacctacgaccacacacagtatagaacggagtcccttcaaaatcgcattcagatcgatcctgtgaagctgagctctggatacaaagacattatcctctggttctcctttggcgcgagctgcttcattctgcttgctatcgccatggggctggtctttatctgtattaagaacggcaatatgcagtgcaccatctgtatt

SEQ ID NO: 43589 - RNA, 1656 nt, synthetic construct
  misc_feature 1..1656: note = derived and/or modified sequence opt5 from anti-influenza_Chain
  source 1..1656: mol_type = other RNA
atgaacacccagatcctggccttcattgcttgcgtgctcacaggcgtcaagggggacaaaatctgtctgggacaccatgccgttgcgaatggcacgaaggtgaacacccttacagagaaagggattgaagtggtcaatgctaccgagacagtggaaaccgccgatgttaagaaaatctgcacacaaggaaagagagccaccgacctgggccggtgtgggctcctgggaacgcttattgggccccctcagtgcgatcagtttctggagttcagctccgacctcatcatcgaacgcagagagggcaccgatgtgtgttacccggggcggtttacaaacgaggaatctctgcgccagattctgagacggagcggaggcatcgggaaggagtccatgggattcacctattctggcattcgcacaaatggggctaccagcgcctgcacgagatccggatctagcttttacgctgaaatgaaatggctcctgtccaacagcgacaattctgccttcccccaaatgacaaaggcgtatcggaaccctcgcaataaacccgcccttatcatttggggcgtccaccattccgagagcgtgtctgagcagaccaagctgtacggctccgggaacaaactcatcacagttagaagctctaagtatcagcagtcctttacccctagccccggagctcggcgcattgatttccactggctgcttctggaccctaatgataccgtgacatttacgttcaacggcgcctttatcgctccggacagagcctccttctttcggggcgaatctctcggagtccaaagcgatgtgcccctggactccagctgtcgcggcgattgcttccattctgggggaaccatcgtgtccagcctgcctttccagaatattaactctagaacagtcggcaagtgtccccggtacgttaaacaaaagagcctcctgcttgcgaccggcatgagaaatgtgcctgagaaacccaagccgcgcgggctgtttggagccatcgctggcttcattgaaaacgggtgggagggactcatcaacggctggtatgggtttcggcaccagaatgcccagggcgaaggaacagctgccgactacaaatccacccagtctgccattgaccagatcacgggcaagctgaacagacttatcgggaaaacaaatcaacagttcgagctgattgataacgagtttaatgaaatcgagcagcagattggaaacgtgatcaattggacccgcgacgctatgaccgaaatttggagctacaacgcggagctcctggtcgccatggaaaatcaacacacaatcgatctggctgactccgagatgagcaagctctatgagcgggtgaagaaacagctgagagaaaacgccgaggaagatggcaccgggtgcttcgagatctttcataagtgtgacgatcagtgcatggaatctattcgcaataacacatacgaccacacgcagtatcggaccgagtcccttcaaaatagaatccagattgatcctgttaaactgagctctggatacaaggacatcattctctggttctcctttggcgccagctgcttcctgcttctggctatcgccatggggctcgtgtttatttgtatcaaaaacggcaatatgcagtgcacaatctgtatt

SEQ ID NO: 43590 - RNA, 1656 nt, synthetic construct
  misc_feature 1..1656: note = derived and/or modified sequence opt5 from anti-influenza_Chain
  source 1..1656: mol_type = other RNA
atgaacatccagattctggccttcatcgcttgcgtgctcaccggcgccaagggggacaaaatttgtctgggacaccatgcggtcgctaatggcacaaaggttaacacgcttaccgagaaagggatcgaagtggtgaatgccacagagaccgtcgaaacagccaacattaagaaaatctgcacccaaggaaagagacccacagatctgggccagtgtgggctcctgggaacccttatcggccctccgcagtgcgaccagtttctggagttcagctccgatctcattatcgaaagacgcgagggcacggacgtgtgttaccccgggaagtttaccaatgaggaatctctgagacaaattctgcggcgcagcggaggcatcgggaaagagtccatgggattcacatattctggcattagaaccaacggggctacaagcgcctgcacccggtccggatctagcttttacgctgaaatgaagtggctcctgtccaatagcgataacgccgcgttccctcagatgacgaaatcttatcgcaatcccagaaacaagcctgcccttatcatttggggcgttcaccattccgagagcgtgtctgagcagacaaaactgtacggctccgggaataagctcatcaaggtccggagctctaaatatcagcaatcctttacccccaaccctggagctcgcagaatcgacttccactggctgcttctggatccgaatgacacagtgacctttaccttcaacggcgcctttattgctcccgatcgggccagcttctttcgcggggaatccatcggagttcagtctgacgcgcctctcgatagctcctgtggcgggaattgcttccataacggaggcacaattgtgagctctctgcccttccagaacatcaatcctagaacggtcggcaagtgtccccggtacgtgaaacagaagtccctgctcctggccaccgggatgcgcaacgtgccggagaaacctaagaaaagaggactttttggcgctattgccgggttcatcgaaaatggatgggagggcctgatcaacgggtggtatggctttcggcaccaaaatgctcagggagaaggcacagccgccgactacaagagcacccagtctgctattgatcaaatcacagggaagctcaacagactgattggaaaaaccaatcagcagttcgagcttatcaacaatgagtttaacgaagtcgagcagcaaattggcaatgttatcaactggacgcaggacgcgatgacagaagtgtggagctacaatgccgagctgctcgtggctatggaaaaccagcacaccatcgacctgaccgattccgagatgtctaagctgtatgagcgcgtccggaaacagctcagagaaaatgccgaggaagacgggacaggatgcttcgagatttttcataagtgtgatgaccactgcatggaaagcatccgcaacaacacctacgatcatacacaatatcggacggagtccctgcagaatcggattcagatcgaccccgtgaaacttagcggcgggtacaaggatattatcctgtggttctcttttggcgcctcctgcttcctcctgcttgctattgccatgggactggtttttatctgtatcaagaacggcaatatgcagtgcaccatttgtatc

SEQ ID NO: 43591 - RNA, 1656 nt, synthetic construct
  misc_feature 1..1656: note = derived and/or modified sequence opt5 from anti-influenza_Chain
  source 1..1656: mol_type = other RNA
gaccagatctgcattggctaccacgccaacaatagcaccgagcaagtggatacaatcatggaaaagaacgtcacggttacccatgctcagaatattctggagaaaacacacaacgggaagctctgtgacctggatggagtgaaaccccttatcctgagagactgctccgtggccggctggctcctggggaatcctatgtgtgatgaatttcttaacgtcccggagtggtcttatattgtggaaaagatcaatcccgcgaacgacctgtgctaccctggaaattttaacgattatgaggagctcaaacatctgctgagccggatcaatcacttcgaaaagattcagatcattcccaagtcctcttggagcgaccatgaggcttcctctggcgttagctccgcctgtccttaccaggggcgcagctctttcttcagaaacgtggtctggctcatcaaaaaggataatgcctatcccaccattaaacggtcctacaacaatacaaaccaagaagacctgcttgtgctgtggggaatccaccaccctaacgatgctgccgagcagacccgcctctatcagaatccgacaacctacattagcgttggcacgtctaccctgaaccagagacttgtgcccaagatcgctacacggtccaaagtcaatggccaaagcgggcgcatggagtttttctggaccatcctgaagcctaacgacgccattaattttgaatctaacggaaatttcatcgcgcccgagaacgcctacaagattgtgaaaaagggcgattccacaatcatgaaaagcgaactcgagtatgggaattgcaacaccaagtgtcagacgcctattggagctatcaattcctctatgccctttcataacatccacccgctgacaattggcgaatgccctaaatacgtgaagtccaataaactggtcctcgccaccgggctgagaaacagcccccagggagagcggcgcagaaagaagcggggccttttcggcgctatcgccgggtttattgagggaggctggcaggggatggttgacggatggtatggctaccatcacagcaatgaacaagggtctggatatgcggccgacaaagagtccacacagaaggctatcgatggcgtgaccaacaaagtgaacagcattatcgacaagatgaatacccagttcgaagccgtcggccgcgagtttaacaatctggaaagacggatcgagaacctcaataaaaagatggaggatgggttcctggacgtgtggacatacaacgctgaacttctggttctcatggagaatgaacgcacgctggatttccacgactctaacgtgaagaatctgtatgataaaattagactccaactgcgggacaacgccaaggagcttggaaatggctgttttgagttctaccatagatgcgataacgaatgtatggagagcgtccgcaatgggacctacgactatcctcagtactccgaagaggcccggctgaaaagagaagagatctctggagtgaagctcgagagcattggcacatatcagatcctgtccatttacagcaccgttgcttcttcccttacactggcgatcatggtggccgggctcagcctgtggatgtgctctaacggctccctgcagtgccgcatttgtatc

SEQ ID NO: 43592 - RNA, 1656 nt, synthetic construct
  misc_feature 1..1656: note = derived and/or modified sequence opt5 from anti-influenza_Chain
  source 1..1656: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtgatctggacggagtgaaaccccttatcctgagagattgctccgtggccggctggctcctggggaaccctatgtgtgacgagttcattaatgtcccggagtggtcttatatcgtggaaaaggcgaaccccaccaatgatctttgctaccctggatcctttaacgactatgaggagctgaaacatctcctgtcccggatcaatcacttcgaaaagattcagatcattcccaagtctagctggtccgatcatgaggcttctagcggcgtttccagcgcctgtccttacctggggtctccctcctttttccgcaacgtggtctggctcatcaaaaagaatagcacatatcctaccattaaaaagtcttacaacaatacaaaccaggaagacctgcttgtgctgtggggaatccaccacccgaatgatgccgctgagcaaaccagactctatcagaaccccacgacctacatttccatcggcacaagcaccctgaaccagcggcttgttcctaaaatcgccacacgctctaaggtgaatggccagtccgggagaatggagtttttctggaccattctgaaccccaatgacgctatcaactttgaaagcaatggaaacttcattgcccctgagtacgcgtataagatcgtcaaaaagggcgattccgccattatgaaatctgaactcgagtacgggaattgcaacacgaagtgtcaaacacccatgggagctatcaatagctccatgccgtttcataacatccaccctctgaccattggcgaatgccccaaatatgtcaagagcaatcggctggtgctcgccacagggctgcgcaactctcctcagagagagtcccggcgcaaaaagagaggacttttcggcgctatcgccggctttattgaagggggatggcagggcatggtggacgggtggtacggatatcatcacagcaatgaacagggctctgggtacgcggccgacaaggagagcacccaaaaagctatcgatggagttaccaacaaggtgaatagcattatcgacaaaatgaacacacagttcgaagccgtgggccgggagtttaacaatctggaacgcagaatcgagaacctcaataagaaaatggaggatggcttcctggacgtctggacgtataacgctgaacttctggtgctcatggagaatgaacggaccctggatttccacgactctaacgttaagaatctgtacgataaggtgcgcctccagctgagagacaacgccaaagagcttgggaatggatgttttgagttctaccataagtgcgataacgaatgtatggagagcattcggaatggcacatataactacccccaatattccgaagaggccagactgaaacgcgaagagatcagcggggtcaagctcgagtctattggaacctaccagatcctgtccatttatagcacagtggcttcttcccttgcgctggccatcatgatggctggcctcagcctgtggatgtgctccaatgggtctctgcagtgccggatttgtatc

SEQ ID NO: 43593 - RNA, 1656 nt, synthetic construct; identical to SEQ ID NO: 43588
  misc_feature 1..1656: note = derived and/or modified sequence opt5 from anti-influenza_Chain
  source 1..1656: mol_type = other RNA

SEQ ID NO: 43594 - RNA, 1656 nt, synthetic construct; identical to SEQ ID NO: 43589
  misc_feature 1..1656: note = derived and/or modified sequence opt5 from anti-influenza_Chain
  source 1..1656: mol_type = other RNA

SEQ ID NO: 43595 - RNA, 1656 nt, synthetic construct; identical to SEQ ID NO: 43590
  misc_feature 1..1656: note = derived and/or modified sequence opt5 from anti-influenza_Chain
  source 1..1656: mol_type = other RNA

SEQ ID NO: 43596 - RNA, 1656 nt, synthetic construct; identical to SEQ ID NO: 43591
  misc_feature 1..1656: note = derived and/or modified sequence opt5 from anti-influenza_Chain
  source 1..1656: mol_type = other RNA

SEQ ID NO: 43597 - RNA, 1656 nt, synthetic construct; identical to SEQ ID NO: 43592
  misc_feature 1..1656: note = derived and/or modified sequence opt5 from anti-influenza_Chain
  source 1..1656: mol_type = other RNA

SEQ ID NO: 43598 - RNA, 1680 nt, synthetic construct
  misc_feature 1..1680: note = derived and/or modified sequence opt5 from anti-influenza_Chain
  source 1..1680: mol_type = other RNA
atgagcaacatggacatcgattccattaataccggcacaatcgacaagacgcccgaggaactgacccctgggacatctggagccaccagaccgattatcaaacccgctacactcgcccctcccagcaacaagcggacccgcaatccttcccccgagagaacaaccacgtctagcgaaaccgatattggccggaaaatccagaagaaacaaacacctaccgagatcaagaagtccgtgtacaaaatggtcgttaagctgggggaattttataaccagatgatggtgaaagcgggacttaatgacgatatggagcgcaacctgattcagaatgctcaggccgtggagagaatcctcctggccgctacagacgataagaaaaccgaataccaaaagaagcggaacgcccgcgacgtcaaagagggcaaggaagagattgatcacaataaaacgggaggaacattttataagatggtgagagacgataaaaccatctacttctctccgattaagatcacatttcttaaagaggaagttaagaccatgtataagaccacaatgggcagcgacggcttctccgggctgaaccatattatgatcggacacagccagatgaatgatgtgtgctttcagcggtctaaaggcctcaagcgcgtcgggctggacccctccctgatcagcacgttcgctggatctaccctccctagacggtccggcacaaccggggtggccattaaaggaggcggcacactggttgacgaggcgatccgctttattgggagagccatggctgatcggggacttctgcgcgacatcaaggccaaaaccgcttacgaaaagattctcctgaaccttaagaataaatgtagcgcgccccagcaaaaggccctggtggatcaggtcatcggctctagaaaccctgggatcgccgacattgaggatctcacgctgctggctcggtccatggtggtggtcagacccagcgttgcctccaaagtggtgctcccgatctctatttatgctaagatccctcagctgggattcaatacagaagagtacagcatggtcggctacgaggccatggccctttataacatggctacccccgtgtccattctgcgcatgggggacgatgcgaaagacaagagccagctctttttcatgtcttgctttggagccgcttacgaagatctgcgggttctttccgccctgaccggcacagagttcaagcctagaagcgccctcaaatgtaagggctttcatgtgcccgctaaagaacaagtcgaggggatgggagccgcgctgatgtctatcaagctgcagttctgggctcccatgacccgcagcggcgggaacgaagtgtccggagagggcgggtctggccagatcagctgctcccctgttttcgccgtggagcggccgattgccctcagcaaacaagctgtcagacgcatgctgtctatgaatgtggaaggacgggacgccgatgtcaagggcaaccttctgaagatgatgaatgactccatggctaaaaagacaagcgggaacgcctttatcgggaaaaagatgttccagatttctgacaaaaataaggtgaaccccatcgagattcctatcaaacagacgattcccaatttcttctttggcagagataccgcggaagactatgatgacctcgattac

SEQ ID NO: 43599 - RNA, 1680 nt, synthetic construct
  misc_feature 1..1680: note = derived and/or modified sequence opt5 from anti-influenza_Chain
  source 1..1680: mol_type = other RNA
atgaacacccagatcctggccctcattgcttacatgctgatcggcgccaagggggacaaaatttgccttggacaccatgcggtggctaatggcacaaaggtcaacacgctgaccgagagagggatcgaagttgtgaatgccacagagaccgtggaaacagtcaacattaaaaagatctgtacccaaggaaaacggcccacagatctcggccagtgcgggctgcttggaaccctgatcggccctccgcagtgtgaccagttcctcgagtttgatgccgacctgattatcgaacgcagagagggcacggatgtgtgctatcccgggaagttcaccaatgaggaaagcctgcggcaaattctccgcggatccggcgggatcgacaaggagtctatgggatttacatacagcggcattagaaccaacggggttacatccgcttgtcggcgctctggaagctccttctatgccgaaatgaaatggctgctttctaatagcgataacgctgcctttcctcagatgaccaagtcctacagaaatccccggaacaaacctgcgctgatcatttggggcgtgcaccatagcggctctgccacggagcagacaaagctctatgggtccggaaataaactgatcaccgtcggcagctctaagtaccagcaatccttcacacccagccctggggctcgcccccaggtgaacggacagtctggcagaatcgactttcactggcttctgctcgatccgaatgacaccgttaccttcacatttaacggggccttcattgctcctgatcgggcctcctttttccgcggagagagcctgggcgtgcagtccgacgtccccctggattctggctgcgaaggggactgttttcatagcagaggaacgatcgtgtccagcctccctttccaaaatattaacccccggaccgtgggcaagtgcccgcgctatgtcaaacagacatctctgcttctggcgaccgggatgagaaacgttcctgagaatcccaagacacggggactcttcggcgccatcgctgggtttattgaaaacggctgggagggactgatcgacggctggtacgggttcagacaccagaatgcccaaggagaaggcaccgctgccgattacaaatccacgcagagcgccatcgaccagattacagggaaacttaaccgcctgatcgataagaccaatcagcaatttgagctcattgacaacgagttctctgaaatcgagcagcagattggaaatgtgatcaactggacccgggatagcatgacagaagtgtggtcctataatgctgagctgctggtcgcgatggaaaaccagcacaccatcgacctcgccgattctgagatgaataagctgtacgagagagtgcgcaaacaacttcgggaaaacgctgaggaagacggcacagggtgttttgagattttccataagtgcgatgaccagtgtatggaaagcatcagaaataacacgtatgatcacacccagtaccgcacagagtccctgcagaatcggattcaaatcgaccctgttaagctcagctctggctataaagacattatcctgtggttttccttcggagccagctgctttcttctgctcgccattgctatgggcctggtgttcatctgcatcaagaacgggaacatgagatgtaccatttgcatc

SEQ ID NO: 43600 - RNA, 1680 nt, synthetic construct
  misc_feature 1..1680: note = derived and/or modified sequence opt5 from anti-influenza_Chain
  source 1..1680: mol_type = other RNA
atgaacacccagatcctggccctcattgcttgcatgctgatcggcgccaagggggacaaaatttgtcttggacaccatgcggtggctaatggcacaaaggtcaacacgctgaccgagagagggatcgaagttgtgaatgccacagagaccgtggaaacagccaacattaaaaagatctgcacccaaggaaaacggcccacagatctcggccagtgtgggctgcttggaaccctgatcggccctccgcagtgcgaccagttcctcgagtttgatgctgacctgattatcgaacgcagagagggcacggatgtctgttaccccgggaagttcaccaatgaggaaagcctgcggcaaattctccgcggatccggcgggatcgacaaggagtctatgggatttacatatagcggcattagaaccaacggggccacatccgcttgccggcgctctggaagctccttctacgccgaaatgaaatggctgctttctaatagcgataacgcggcctttcctcagatgaccaagtcctatagaaatccccggaacaaacctgctctgatcatttggggcgtgcaccatagcggctctgccacggagcagacaaagctctacgggtccggaaataaactgatcaccgttggcagctctaagtatcagcaatccttcacacccagccctggggctcgcccccaggtgaacggacagtctggcagaatcgactttcactggcttctgctcgatccgaatgacaccgtcaccttcacatttaacggggccttcattgcgcctgatcgggcctcctttttccgcggaggcagcctgggcgtgcagtccgacgttcccctggattctgggtgtgagggagactgctttcatagcggcgggacgatcgtgtccagcctccctttccaaaatattaaccccagaaccgtcggaaagtgtccgcggtacgtgaaacagacatctctgcttctggctaccggcatgcgcaacgtgcctgaaaatcccaagacaagagggcttttcggcgccatcgctggatttattgagaacggctgggaagggctgatcgacggatggtatggcttccggcaccagaatgcccaaggggagggaaccgccgctgattacaaatccacgcagagcgcgatcgaccagattacaggcaagctcaacagactgatcgataaaaccaatcagcaatttgaactcattgacaacgagttcaatgagatcgaacagcagattgggaacgtcatcaattggacccgcgattctatgacagaggtttggagctacaacgccgaactgctggtggctatggagaatcagcacaccatcgacctcgccgattccgaaatgaacaagctgtatgagcgggtgagaaaacaacttcgcgagaatgccgaagaggacggcacaggatgctttgaaattttccataagtgtgatgaccagtgcatggagtctatccggaacaatacgtacgatcacacccagtatagaacagaaagcctgcagaaccgcattcaaatcaaccctgtcaagctctccagcggctacaaagacattatcctgtggttttctttcggggcttcctgctttcttctgctcgccattgcgatgggactggtgttcatctgtatcaagaatggcaacatgcggtgcaccatttgtatc

SEQ ID NO: 43601 - RNA, 1680 nt, synthetic construct
  misc_feature 1..1680: note = derived and/or modified sequence opt5 from anti-influenza_Chain
  source 1..1680: mol_type = other RNA
atggagagaatcgtgctgctcctggccattgtcagccttgttaagtccgaccagatctgcattggctaccacgctaacaattctaccgaacaagtggatacaatcatggagaaaaacgtgacggtcacccatgcccaggacattctggaaaagacacacaatgggaaactctgtgatctggacggagtgaagccccttatcctgcgggattgcagcgttgcgggctggctcctggggaaccctatgtgtgacgagttcctgaatgtgccggaatggtcctatatcgtcgagaaaattaaccccgctaatgatctctgctaccctggaaactttaatgactatgaggaactgaagcatcttctgtctcgcatcaaccacttcgagcggattcagatcattcccaagagctcctggtctgatcatgaagccagctccggcgtgagctctgcctgtccttaccaggggagatccagctttttccgcaatgttgtgtggctcatcaaaaagaacaatgcttatcccaccattaaaagatcttacaacaatacaaaccaagaggacctgcttgtcctgtggggaatccaccaccctaacgatgccgctgagcagacccggctctatcagaatccgacaacctacatctccgtgggcacgagcaccctgaaccagcgcctggtgcccaagattgccacaagatctaaagtcaatggccaatccgggcggatggaatttttctggaccatcctcaagcctaacgacgcgattaattttgagagcaacggaaatttcatcgcccccgaaaacgcttacaagaattgccagaaaggcgattccacaattatgaagtctgagctggaatatgggaactgtaataccaaatgccagacgcctatcggagccatcaacagctccatgccctttcataatattcacccgcttacaatcggcgagtgtcctaagtacgttaaaagcaaccgcctggtgctcgctaccgggctgagaaattctccccagggagagcggcgcagaaagaaacggggccttttcggcgccattgcggggtttatcgaaggaggctggcaagggatggtggacggatggtatggctaccatcactccaacgagcaggggagcggatatgccgctgacaaggaatctacacagaaggccattgatggcgtcaccaacaaagtgaatagcatcatcgacaagatgaacacccaattcgaggctgttggccgcgaatttaataacctggagagacggattgagaatctcaacaaaaagatggaagatgggttcctggacgtgtggacatacaatgccgagctgctcgtcctgatggaaaacgagagaacgcttgatttccacgactccaatgtgaaaaacctgtatgataaggttcgcctccagctgcgggacaatgccaaggaacttggaaacggctgctttgagttctaccatagatgtgataatgagtgcatggaatctgtgcgcaacgggacctacgactatcctcagtacagcgaggaagctcggctgaaaagagaggagatctccggagtcaagctcgaaagcattggcacatatcagatcctgtctatttactccaccgtggcgagctctctggccctcgctatcatggtcgccgggctgtccctttggatgtgcagcaatggc

SEQ ID NO: 43602 - RNA, 1680 nt, synthetic construct; identical to SEQ ID NO: 43598
  misc_feature 1..1680: note = derived and/or modified sequence opt5 from anti-influenza_Chain
  source 1..1680: mol_type = other RNA

SEQ ID NO: 43603 - RNA, 1680 nt, synthetic construct; identical to SEQ ID NO: 43599
  misc_feature 1..1680: note = derived and/or modified sequence opt5 from anti-influenza_Chain
  source 1..1680: mol_type = other RNA

SEQ ID NO: 43604 - RNA, 1680 nt, synthetic construct; identical to SEQ ID NO: 43600
  misc_feature 1..1680: note = derived and/or modified sequence opt5 from anti-influenza_Chain
  source 1..1680: mol_type = other RNA

SEQ ID NO: 43605 - RNA, 1680 nt, synthetic construct; identical to SEQ ID NO: 43601
  misc_feature 1..1680: note = derived and/or modified sequence opt5 from anti-influenza_Chain
  source 1..1680: mol_type = other RNA

SEQ ID NO: 43606 - RNA, 1686 nt, synthetic construct
  misc_feature 1..1686: note = derived and/or modified sequence opt5 from anti-influenza_Chain
  source 1..1686: mol_type = other RNA
atgcccagagccctgcggcgcgtgcctggcagcagagtcatgctccgggttggggtggtggtcgctgtgctggcccttgttgcggctctggccaacctcgccgtgccgcgccccgctagagccgctggaggcgggtactggcacacctccggacgggagatcctggacgccaataacgtccctgtgcgcattgcgggcatcaattggttcgggtttgaaacatgcaactatgttgtgcatggactttggtctagagattaccggagcatgctggaccagattaagtccctcggctataatacgatccgcctgccctactctgatgacattctgaaacctggcaccatgcccaacagcatcaatttctatcaaatgaaccaggatctccaggggctgacatcccttcaggtcatggacaagatcgtggcctacgctggacaaattggcctgagaatcattctcgatcggcaccgccctgactgttctgggcagagcgccctgtggtatacctccagcgtgtctgaggctacatggatctccgatcttcaggccctggcgcagagatacaaaggaaatccgaccgtcgttggctttgacctccataacgaaccccacgatcctgcctgctgggggtgtggagaccccagcattgattggcggctggctgccgagcgcgctggcaatgccgtgctgtctgtgaaccctaatctcctgatcttcgtcgaaggcgtgcaatcctacaacggggacagctattggtggggaggcaatcttcagggggccggacagtaccccgttgtgctgaacgtcccgaacagactcgtgtattctgctcatgactacgcgacatccgtttatcctcagacctggtttagcgatcccacgttccctaataacatgcccggcatttggaataagaactgggggtacctgtttaatcaaaacatcgcccccgtgtggcttggagagttcggcaccacactgcagtccaccacagaccagacctggctcaaaacgctggtccaatatctgcggcctacagctcagtacggcgccgattcttttcagtggaccttctggagctggaatccggactccggggatacaggaggcatcctcaaggacgattggcagaccgtggacaccgtcaaggatgggtacctggcccccattaaaagctctatctttgaccctgtgggagcttccgccagcccctctagccaaccttccccctctgttagcccgtcccctagcccctctccttccgcgagcagaacacccacgcctacccccacaccgaccgcttctcctacacccacccttacgcccacagccacccctaccccgacagcctcccccacccctagccccacagctgcctccggcgctcgctgcacggcctcttatcaggtgaacagcgattgggggaatggcttcaccgtcacagtggcggttaccaactccggatctgtggccacaaagacctggacggtcagctggacctttggcgggaatcagacaattaccaactcctggaatgctgccgtgacacagaacggacaaagcgtgaccgctcggaatatgtcttacaacaacgttatccagcctggccagaatacgacattcgggttccaggcctcctataccggaagcaacgcggcccccacagtcgcttgtgccgcttct

SEQ ID NO: 43607 - RNA, 1686 nt, synthetic construct
  misc_feature 1..1686: note = derived and/or modified sequence opt5 from anti-influenza_Chain
  source 1..1686: mol_type = other RNA
atggagagagtgtggtggaaggaagccgtcgtttaccagatctatccccggagcttctacgactccaacggcgatgggattggagacatccgcggcattatcgctaaactggattatctcaaggagctgggggtggacgtggtctggctttctcctgtgtacaaaagcccgaatgatgacaacggatatgatatttccgactacagagatatcatggacgaatttggcaccatggccgattggaagacaatgctggaggaaatgcacaaacgggggatcaagctcgttatggacctggtggtcaatcatacgtctgatgagcacccctggttcattgagagccgcaagtccaaagacaacccttatagagactactacatctggcggcccggaaagaatggcaaagaacctaacaattgggagtctgtgtttagcggctccgcgtgggaatatgatgagatgaccggggagtactatcttcatctgttcagcaagaaacaacccgacctcaactgggaaaatcctaaggttcgcagagaggtgtacgaaatgatgaagttttggctggataaaggagtcgacggcttccggatggatgtgattaacatgatctctaaggtgccggagctgcccgacggggaacctcagtccggcaaaaagtatgctagcggatctcgctactatatgaatgggcccagagtccacgagtttctccaggagatgaaccgggaagttctgtccaaatacgatattatgacagtgggagagacccctggcgtgacacccaaggaaggcatcctttacaccgacccgagccgcagagagctgaatatggtcttccagtttgaacatatggatctcgactctgggcctggaggcaaatgggatattcggccctggtccctggccgaccttaagaagacaatgaccaaatggcaaaaggagctggaggggaaaggatggaacagcctctatctgaataaccacgaccagcctcgcgccgtgtccagattcggcgatgacgggaagtaccgggttgaatctgctaaaatgctggccacgtttctccacatgatgcagggaaccccctatatctaccagggcgaggaaatcggcatgacaaacgtgagattccccagcattgaggattatcgcgacatcgaaaccctgaatatgtacaaggagcgggtcgaggaatatggggaggatcctcaagaagtgatggagaagatttactacaaaggaagagacaacgctcgcacaccgatgcagtgggatgactccgagaatgccggctttaccgcggggacgccctggatccctgttaaccccaattataaggaaattaacgtgaaagccgctcttgaggatcctaatagcgtcttccattactataagaaactgatccagctccggaagcagcacgacatcattgtgtacggaacatatgatctgatccttgaagacgatccctacatttatagatacacccgcacactgggcaacgagcaactcatcgtcattaccaatttctctgaaaagaccccggtgtttcggctgcctgaccatatcatctacaaaacaaaggagctgctcatttccaactatgacgttgatgaggccgaggaactgaaagaaatcagacttcgcccctgggaggctcgggtgtacaagattagactgcct

SEQ ID NO: 43608 - RNA, 1686 nt, synthetic construct; identical to SEQ ID NO: 43606
  misc_feature 1..1686: note = derived and/or modified sequence opt5 from anti-influenza_Chain
  source 1..1686: mol_type = other RNA

SEQ ID NO: 43609 - RNA, 1686 nt, synthetic construct; identical to SEQ ID NO: 43607
  misc_feature 1..1686: note = derived and/or modified sequence opt5 from anti-influenza_Chain
  source 1..1686: mol_type = other RNA

SEQ ID NO: 43610 - RNA, 1689 nt, synthetic construct
  misc_feature 1..1689: note = derived and/or modified sequence opt5 from anti-influenza_Chain
  source 1..1689: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgagaaaaagcacaatgggaaactgtgtgatctcgacggagtgaagcccctgatccttagagattgcagcgttgcgggctggctgctcgggaaccctatgtgtgacgaatttatcaatgtgccggaatggtcctatattgtcgagaaggctaaccccgtgaatgatctgtgctaccctggagacttcaacgattatgaggaactgaaacatctcctgtctcggatcaatcactttgagaagattcagatcattcccaaaagctcctggtctagccatgaagcctcccttggcgttagctctgcctgtccttaccaggggaagacatccttctttcgcaacgtggtctggctgatcaaaaagaatagcacctatcccacaattaagagatcttacaacaataccaaccaagaggacctcctggtgctttggggaatccaccaccctaatgatgctgccgagcagacaaaactgtatcagaacccgaccacgtacatctccgtgggcaccagcacactcaaccagcggctggtcccccgcattgctaccagatctaaggttaatggccaatccgggcggatggagttcttttggacaatcctgaaacctaacgacgccattaatttcgaaagcaacggaaattttatcgcgcccgaatacgcctataagattgtgaaaaagggcgattccaccatcatgaaatctgagctcgaatacgggaactgcaatacgaagtgtcagacacctatgggagctatcaacagctccatgcccttccataatattcacccgctgaccatcggcgagtgccctaagtatgtgaaaagcaaccgccttgtcctggccacagggctcagaaattctccccagcgggagacccgcggactgtttggcgctattgccggcttcatcgaagggggatggcagggcatggtggacgggtggtacggatatcatcactccaacgagcaaggcagcgggtacgcggccgacaaggaatctacccagaaagctattgatggagttacaaataaggtgaacagcatcatcgacaaaatgaatacgcagtttgaggccgtcggcagagagttcaacaaccttgaacggcgcattgagaatctgaacaagaagatggaagatggcttcctcgacgtgtggacctataatgctgagctgctggttctcatggaaaacgagagaacactggattttcacgactccaatgtgaaaaacctttacgataaggtccggctgcaactccgcgacaatgccaaagaactggggaacggatgtttcgagttttaccataagtgcgataatgagtgtatggaatctgtgagaaacggcacctatgactaccctcagtatagcgaggaagcccggcttaaaagagaggagatctccggggtcaagctggaaagcattggaatctaccagattctctctatctattccacagtggctagctctctggcgctggccattatggttgctggcctctccctgtggatgtgcagcaatgggtcccttcagtgccgcatctgt

SEQ ID NO: 43611 - RNA, 1689 nt, synthetic construct; identical to SEQ ID NO: 43610
  misc_feature 1..1689: note = derived and/or modified sequence opt5 from anti-influenza_Chain
  source 1..1689: mol_type = other RNA

SEQ ID NO: 43612 - RNA, 1692 nt, synthetic construct
  misc_feature 1..1692: note = derived and/or modified sequence opt5 from anti-influenza_Chain
  source 1..1692: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgaaaagacacacaatgggaagctgtgtagcctcaacggagtgaaacccctgatccttagagattgctccgttgcgggctggctgctcgggaatcctatgtgtgacgagtttctgaacgtgccggaatggtcttatatcgtcgagaaggatagccccattaatggactgtgctaccctggcgacttcaacgattatgaggaactcaagcatctgctttcctctaccaatcactttgagaaaatccagattatcccccggagctcctggagcgaccatgatgcttcttccggggtgagctctgcctgtccttacaacggacgctccagcttctttagaaatgttgtgtggctgattaagaaaaacaatgcctatcccacaatcaagcggaactacaataacaccaaccaggaagacctcctggtcctttggggcattcaccaccctaatgatgctacagagcaaaccaaactgtatcagaacccgacgacctacgtgtctgtgggcacatccaccctcaatcagcgcagcgtccccgagatcgccacaagacctaaggttaacgggcagtccggacggatcgagttcttttggaccattctgaagcccaatgacgctatcaacttcgaatctaatggcaactttattgcccctgaatacgcgtataaaatcgccaagaaaggggatagcgctattatgaagtccggactggagtacggcaattgcaacacgaaatgtcaaacacccatgggggccatcaatagctctatgccgttccataacatccaccctctcaccattggagaatgcccccgctatgtgaagtccgacagactggtgcttgctacaggcctgcggaatgtccctcagcgcgagaccagaggcctctttggggccatcgcgggattcattgagggcgggtggcagggaatggtggacggctggtacgggtatcatcacagcaacgaacagggatctggctacgccgctgataaagagagcacccaaaaggccatcgacggcattacaaataaggttaactccatcatcgataaaatgaacacgcagtttgaagctgtggggaaggagttcaataacctggaacggcgcattgagaatcttaacaaaaagatggaggacggattcctggatgtctggacctataatgccgaactcctggtgctgatggagaacgaaagaacactcgactttcacgattctaatgttaaaaacctgtacgacaaggtgcggcttcagctgcgcgataatgccaaggagctcggcaacgggtgtttcgaattttaccataaatgcgacgatgagtgtatggagagcgtcagaaatggaacctatgactacccccaatattccgaagaggctcggctgaacagagaagagatcagcggcgtgaaacttgagtctattgggacataccagatcctgtccatttatagcaccgtcgcgtcttccctcgccctggctatcatggtggccggcctgagcttctggatgtgctccaatggatctctccagtgccgcatttgtatc

SEQ ID NO: 43613 - RNA, 1692 nt, synthetic construct; identical to SEQ ID NO: 43612
  misc_feature 1..1692: note = derived and/or modified sequence opt5 from anti-influenza_Chain
  source 1..1692: mol_type = other RNA

SEQ ID NO: 43614 - RNA, 1695 nt, synthetic construct
  misc_feature 1..1695: note = derived and/or modified sequence opt5 from anti-influenza_Chain
  source 1..1695: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgagaaaaagcacaatgggaaactgtgtgatctcgacggagtgaagcccctgatccttagagattgcagcgttgcgggctggctgctcgggaaccctatgtgtgacgaatttatcaatgtgccggaatggtcctatattgtcgagaaggctaaccccgtgaatgatctgtgctaccctggagacttcaacgattatgaggaactgaaacatctcctgtctcggatcaatcactttgagaagattcagatcattcccaaaagctcctggtctagccatgaagcctcccttggcgttagctctgcctgtccttaccaggggaagtccagcttctttcgcaacgtggtctggctgatcaaaaagaactctacatatcccaccattaagagatcctacaataatacaaaccaagaggacctcctggtgctttggggaatccaccaccctaatgatgctgccgagcagaccaaactgtatcagaacccgacaacctacatcagcgtgggcacgtctaccctcaaccagcggctggtcccccgcattgctacaagatccaaggttaatggccaaagcgggcggatggagttcttttggaccatcctgaaacctaacgacgccattaatttcgaatccaacggaaattttatcgcgcccgaatacgcctataagattgtgaaaaagggcgattctacaatcatgaaaagcgagctcgaatacgggaactgcaataccaagtgtcagacgcctatgggagctatcaactccagcatgcccttccataatattcacccgctgacaatcggcgagtgccctaagtatgtgaaatctaaccgccttgtcctggccaccgggctcagaaatagcccccagcgggagcgcagacggaagaaacgcggactgtttggcgctattgccggcttcatcgaagggggatggcagggcatggtggacgggtggtacggatatcatcactccaacgagcaaggctctgggtacgcggccgacaaggaaagcacacagaaagctattgatggagttaccaataaggtgaactccatcatcgacaagatgaatacccagtttgaggccgtcggcagagagttcaacaaccttgaacggcgcattgagaatctgaacaaaaagatggaagatggcttcctcgacgtgtggacatataatgctgagctgctggttctcatggaaaacgagagaacgctggattttcacgactctaatgtgaaaaacctttacgataaggtccggctgcaactcagagacaatgccaaagaactggggaacggatgtttcgagttttaccataagtgcgataatgagtgtatggaaagcgtgcgcaacggcacctatgactaccctcagtattccgaggaagcccggcttaagagagaggagatcagcggggtcaaactggaatctattggaatctaccagattctctccatctatagcacagtggcttcttccctggcgctggccattatggttgctggcctcagcctgtggatgtgctccaatgggtctcttcagtgccgc

SEQ ID NO: 43615 - RNA, 1695 nt, synthetic construct
  misc_feature 1..1695: note = derived and/or modified sequence opt5 from anti-influenza_Chain
  source 1..1695: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgaaaagacacacaatgggaagctgtgtgatctcgacggagtgaaacccctgatccttagagattgcagcgttgcgggctggctgctcgggaaccctatgtgtgacgagtttatcaatgtgccggaatggtcctatattgtcgagaaggctaaccccgtgaatgatctgtgctaccctggagacttcaacgattatgaggaactgaagcatctcctgtctcggatcaatcactttgagaaaattcagatcattcccaagagctcctggtctagccatgaagcctcccttggcgttagctctgcctgtccttaccaggggaaatccagcttctttcgcaacgtggtctggctgatcaagaaaaattctacctatcccacaattaagagatcctacaacaataccaaccaagaggacctcctggtgctttggggaatccaccaccctaatgatgctgccgagcagacaaagctgtatcagaacccgaccacgtacatcagcgtgggcacctctacactcaaccagcggctggtcccccgcattgctaccagatccaaagttaatggccaaagcgggcggatggagttcttttggacaatcctgaagcctaacgacgccattaatttcgaatccaacggaaattttatcgcgcccgaatacgcctataaaattgtgaagaaaggcgattctaccatcatgaaaagcgagctcgaatacgggaactgcaatacgaaatgtcagacacctatgggagctatcaactccagcatgcccttccataatattcacccgctgaccatcggcgagtgccctaagtatgtgaagtctaaccgccttgtcctggccacagggctcagaaatagcccccagcgggagcgcagacggaaaaagcgcggactgtttggcgctattgccggcttcatcgaagggggatggcagggcatggtggacgggtggtacggatatcatcactccaacgagcaaggctctgggtacgcggccgacaaagaaagcacccagaaggctattgatggagttaccaataaagtgaactccatcatcgacaagatgaatacacagtttgaggccgtcggcagagagttcaacaaccttgaacggcgcattgagaatctgaacaagaaaatggaagatggcttcctcgacgtgtggacgtataatgctgagctgctggttctcatggaaaacgagagaaccctggattttcacgactctaatgtgaagaacctttacgataaagtccggctgcaactcagagacaatgccaaggaactggggaacggatgtttcgagttttaccataaatgcgataatgagtgtatggaaagcgtgcgcaacggcacatatgactaccctcagtattccgaggaagcccggcttaagagagaggagatcagcggggtcaagctggaatctattggaatctaccagattctctccatctatagcaccgtggcttcttccctggcgctggccattatggttgctggcctcagcctgtggatgtgctccaatgggtctcttcagtgccgc

SEQ ID NO: 43616 - RNA, 1695 nt, synthetic construct
  misc_feature 1..1695: note = derived and/or modified sequence opt5 from anti-influenza_Chain
  source 1..1695: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaaactctgtgatctggacggagtgaaaccccttatcctgagagattgcagcgttgcgggctggctcctggggaaccctatgtgtgacgagttcatcaatgtgccggaatggtcctatattgtcgagaaggctaaccccgccaatgatctgtgctaccctggaaactttaatgactatgaggaactcaagcatctgctttctcggatcaaccacttcgagaaaattcagatcattcccaagagctcctggtctgatcatgaagccagctccggcgtgagctctgcttgtccttaccaggggaaatccagctttttccgcaatgttgtgtggctgatcaagaaaaactcttcctatcccaccattaagagaagctacaataacacaaatcaagaggacctcctggtcctttggggaatccaccaccctaacgatgccgctgagcagacccggctgtatcagaacccgacaacctacatctctgtgggcacgtccaccctcaatcagcgcctggtgcccaagattgccacaagaagcaaagtcaacggccaatccgggcggatggaatttttctggaccatcctgaagcctaatgacgcgattaactttgagtctaatggaaacttcatcgcccccgaatacgcttataaaattgttaagaaaggcgatagcgccatcatgaagtccgagctcgaatacgggaattgcaacacaaaatgtcagacccctatgggagctatcaatagctctatgccctttcataacattcacccgctgacgatcggcgagtgccctaagtatgtgaagtccaatcgccttgtgctggccacagggctcagaaacagcccccagcgggagcgcagacggaaaaagcgcggactgttcggcgcgattgccggctttatcgaagggggatggcagggcatggtcgacgggtggtacggatatcatcactctaatgagcaaggcagcgggtacgctgccgacaaagaatccacccagaaggctattgatggagtgacaaacaaagttaattctatcatcgacaagatgaacacccagttcgaggccgtgggcagagaatttaacaatcttgagcggcgcattgagaacctgaataagaaaatggaagatggcttcctcgacgtctggacctataacgccgagctgctggtgctcatggaaaatgagagaacactggatttccacgacagcaacgttaagaatctttacgataaagtgcggctgcaactcagagacaacgctaaggaactggggaatggatgttttgagttctaccataaatgcgataacgagtgtatggaatccgtccgcaatggcacgtatgactaccctcagtatagcgaggaagcgcggcttaagagagaggagatctctggggtgaagctggaatccattggaatctaccagattctcagcatctattctaccgtcgcctccagcctggctctggccattatggtggccggcctctccctgtggatgtgctctaacgggagccttcagtgccgc

SEQ ID NO: 43617 - RNA, 1695 nt, synthetic construct
  misc_feature 1..1695: note = derived and/or modified sequence opt5 from anti-influenza_Chain
  source 1..1695: mol_type = other RNA
atgagcgacagacggcagaaccgcaagacccccgatgagcaaagaaaagccaatgctctgatcattaacgaaaatatcgaggcctacattgcgatctgcaaggaagtgggcctcaacggggacgagatgctgattcttgaaaatggaatcgctatcgagaaagccattcggatctgttgcgatggcaagtatcaggagaaacgcgaaaagaaggccagagaggctcagcgggccgactccaacttcaatgctgattctattgggatccgcctggtcaaaagagccggaagcggcacaaacattacgtaccacgcggttgtggaactcacctcccggtctcgcatcgtgcagattcttaagagccattgggggaatgagctgaacagagccaaaatcgctggaaagcggctgggcttttccgccctcttcgcttctaatctggaggccatcatttatcaacgcggcagaaacgcggcccggcgcaatgggagcgctgaactgtttacactcacccagggagccggcatcgagacaagatacaaatggattatggaaaagcacatcgggattggagtcctgatcgctgacgccaagggccttatcaacgggaaacgggagggaaagagaggcgtggatgccaatgttaaactgcgcgctggcaccacagggtcccctctcgaacgggcgatgcagggaattgagaagaaagccttcccgggccccctgagagctcttgcccgccgggtggtcaaggccaactataacgacgctagagaggccctgaatgtgatcgcggaagctagcctcctgctgaaacctcagattaccaacaagatgacgatgccctggtgtatgtggctcgccgcccgcctgacccttaaggatgagtttgctaatttctgcgcctacgctgggcggagagcctttgaagttttcaacatcgcgatggagaaaattggaatctgttcttttcaaggcacaatcatgaatgacgatgaaattgagtccatcgaggacaaggcccaggtgctgatgatggcttgcttcgggctcgcctatgaagattttagcctggtctctgctatggtgtcccatcctcttaaactgcgcaaccggatgaagattggaaatttcagagtgggcgagaaagtcagcaccgttctctctcccctgctgcgctttacacggtgggccgagttcgcgcagagattcgccctccaggctaacacctcccgggagggcgcccaaatcagcaattccgctgtgtttgccgtggaacgcaagattacgacagacgtccagagagtggaggagctgcttaacaaggttcaggcccacgaagacgagcctctgcaaaccctctacaaaaaggtgcgggaacagatctctattatcgggagaaataaaagcgagatcaaggagttcctgggatccagcatgtacgatcttaacgaccaggaaaaacagaatccgattaactttcgctctggcgctcatcccttctttttcgagtttgatcctgactataatcccatccgggtcaagagacctaagaaacccattgcgaagcgcaactccaacatcagcagactggaagaggaagggatggatgaaaattctgagattggacaagccaaaaagatgaaaccgctcgaccagctgacaagcacctcctctaacatccctggcaagaat

SEQ ID NO: 43618 - RNA, 1695 nt, synthetic construct
  misc_feature 1..1695: note = derived and/or modified sequence opt5 from anti-influenza_Chain
  source 1..1695: mol_type = other RNA
atgaaggtgaaactgctcgtcctgctttgcaccttcacagccacgtacgctgacaccatctgtattggctatcacgccaacaatagcacagataccgttgacacagtgctggagaagaacgtgaccgtcacacattccgtgaatctcctggaaaactctcacaatgggaaactttgcctgctcaagggaatcgcgcccctgcagctgggcaactgtagcgttgctgggtggattctcggaaatcctgagtgcgaactgcttatctccaaagagtcttggagctacattgtggaaaagccgaaccccgagaatggcacctgttatcctgggcattttgccgattacgaggaactgagagagcaactctcctctgtcagctccttcgaacggtttgagatcttccccaaggagagctcttggcctaaccacacggtgaccggagtttccgccagctgctctcataatggcgaatccagcttttatcgcaacctgctttggctgacaggcaaaaatgggctctaccccaacctgtctaagtcctatgctaataacaaagagaaggaagtgctggtcctctggggagtgcaccaccctccgaacatcggcgaccagaaagccctgtaccataccgagaatgcttacgtgagcgtcgtttcctctcactatagcagaaagttcacacccgaaattgccaagcggcctaaagtgcgcgatcaggaggggagaatcaactaccattggacccttctggagcccggagacacgattatctttgaagcgaatggcaacctcattgcccctcggtatgctttcacactgtcccgcgggtttggaagcggcatcattaattctaacgcccccatggataagtgtgacgctaaatgccagaccccgcaaggcgccatcaattccagccttcctttccagaacgtgcaccccgtcacaatcggggagtgtcctaagtacgtgagatctgcgaaactgcggatggttaccggactccgcaatattcccagcatccagtccagaggcctgtttggggccattgctggattcatcgaaggcgggtggaccggaatggtggatggctggtatggctaccaccatcagaacgagcaagggtctggatatgccgctgaccaaaagagcacacagaatgccattaacggcatcacgaataaagtcaactccgtgatcgaaaagatgaatacccagtttacagccgttgggaaggagttcaacaaactggagcggcgcatggaaaacctcaataagaaagtggatgacggattcattgatatctggacctacaacgctgagctgcttgtcctgctcgaaaatgagagaacactggactttcacgacagcaacgtgaagaatctttacgaaaaagtcaagtctcagctgaagaacaatgcgaaagagattggcaacgggtgcttcgagttttatcataagtgtaatgatgaatgcatggagtccgtgaaaaacggcacctacgactatcccaagtacagcgaagagtctaaactcaatcgggagaagatcgatggagttaagctggaatccatgggcgtgtatcagattctggccatctacagcacggtcgcttcctctctcgtgctgcttgttagcctgggggccatctccttctggatgtgctctaacggaagcctccagtgtcgcatttgcatc

SEQ ID NO: 43619 - RNA, 1695 nt, synthetic construct
  misc_feature 1..1695: note = derived and/or modified sequence opt5 from anti-influenza_Chain
  source 1..1695: mol_type = other RNA
atgaaggtgaaactgctcgtcctgctttgcaccttcacagccacgtacgctgacaccatctgtattggctatcacgccaacaatagcacagataccgttgacacagtgctggagaagaacgtgaccgtcacacattccgtgaatctcctggaaaactctcacaatgggaaactttgcctgctcaagggaatcgcgcccctgcagctgggcaactgtagcgttgctgggtggattctcggaaatcctgagtgcgaactgcttatctccaaagagtcttggagctacattgtggaaaagccgaaccccgagaatggcacctgttatcctgggcattttgccgattacgaggaactgagagagcaactctcctctgtcagctccttcgaacggtttgagatcttccccaaggagagctcttggcctaaccacacggtgaccggagtttccgccagctgctctcataatggcgaatccagcttttatcgcaacctgctttggctgacaggcaaaaatgggctctaccccaacctgtctaagtcctatgctaataacaaagagaaggaagtgctggtcctctggggagtgcaccaccctccgaacatcggcgaccagaaaaccctgtaccatacagagaatgcctacgtgagcgtcgtttcctctcactatagcagaaagttcacccccgaaattgctaagcggcctaaagtgcgcgatcaggaggggagaatcaactactattggacgcttctggagcccggagacacaattatctttgaagccaatggcaacctcattgcgcctcggtacgccttcgctctgtcccgcgggtttggaagcggcatcattaattctaacgcccccatggataagtgtgacgctaaatgccagaccccgcaaggcgccatcaattccagccttcctttccagaacgtgcatcccgtcacaatcggggagtgtcctaagtatgtgagatctgcgaaactgcggatggttaccggactccgcaatattcccagcatccagtccagaggcctgtttggggccattgctggattcatcgaaggcgggtggaccggaatggtggatggctggtacggctatcaccaccagaacgagcaagggtctggatacgccgctgaccaaaagagcacacagaatgccattaacggcatcacgaataaagtcaactccgtgatcgaaaagatgaatacccagtttacagccgttgggaaggagttcaacaaactggagcggcgcatggaaaacctcaataagaaagtggatgacggattcattgatatctggacctacaacgctgagctgcttgtcctgctcgaaaatgagagaacactggactttcatgacagcaacgtgaagaatctttatgaaaaagtcaagtctcagctgaagaacaatgcgaaagagattggcaacgggtgcttcgagttttaccacaagtgtaatgatgaatgcatggagtccgtgaaaaacggcacctatgactaccccaagtatagcgaagagtctaaactcaatcgggagaagatcgatggagttaagctggaatccatgggcgtgtaccagattctggccatctatagcacggtcgcttcctctctcgtgctgcttgttagcctgggggccatctccttctggatgtgctctaacggaagcctccagtgtcgcatttgcatc

SEQ ID NO: 43620 - RNA, 1695 nt, synthetic construct
  misc_feature 1..1695: note = derived and/or modified sequence opt5 from anti-influenza_Chain
  source 1..1695: mol_type = other RNA
atgaaggtgaaactgctcgtcctgctttgcaccttcacagccacgtacgctgacaccatctgtattggctatcacgccaacaatagcacagataccgttgacacagtgctggagaagaacgtgaccgtcacacattccgtgaatctcctggaaaactctcacaatgggaaactttgcctgctcaagggaatcgcgcccctgcagctgggcaactgtagcgttgctgggtggattctcggaaatcctgagtgcgaactgcttatctccaaagagtcttggagctacattgtggaaaagccgaaccccgagaatggcacctgttatcctgggcattttgccgattacgaggaactgagagagcaactctcctctgtcagctccttcgaacggtttgagatcttccccaaggagagctcttggcctaaccacacggtgaccggagtttccgccagctgctctcataatggcgaatccagcttttatcgcaacctgctttggctgacaggcaaaaatgggctctaccccaacctgtctaagtcctatgctaataacaaagagaaggaagtgctggtcctctggggagtgcaccaccctccggacatcggcgatcagaaaaccctgtaccatacagagaacgcctacgtgagcgtcgtttcctctcactatagcagaaagttcacccccgaaattgctaagcggcctaaagtgcgcgaccaggaggggagaatcaattactattggacgcttctggagcccggagatacaattatctttgaagccaacggcaatctcattgcgcctcggtacgccttcgctctgtcccgcgggtttggaagcggcatcattaactctaatgcccccatggacaagtgtgatgctaaatgccagaccccgcaaggcgccatcaactccagccttcctttccagaatgtgcatcccgtcacaatcggggagtgtcctaagtatgtgagatctgcgaaactgcggatggttaccggactccgcaacattcccagcatccagtccagaggcctgtttggggccattgctggattcatcgaaggcgggtggaccggaatggtggacggctggtacggctatcaccaccagaatgagcaagggtctggatacgccgctgatcaaaagagcacacagaacgccattaatggcatcacgaacaaagtcaattccgtgatcgaaaagatgaacacccagtttacagccgttgggaaggagttcaataaactggagcggcgcatggaaaacctcaacaagaaagtggacgatggattcattgacatctggacctacaatgctgagctgcttgtcctgctcgaaaacgagagaacactggactttcatgatagcaatgtgaagaacctttatgaaaaagtcaagtctcagctgaagaataacgcgaaagagattggcaatgggtgcttcgagttttaccacaagtgtaacgacgaatgcatggagtccgtgaaaaatggcacctatgattaccccaagtatagcgaagagtctaaactcaaccgggagaagatcgacggagttaagctggaatccatgggcgtgtaccagattctggccatctatagcacggtcgcttcctctctcgtgctgcttgttagcctgggggccatctccttctggatgtgctctaatggaagcctccagtgtcgcatttgcatc

SEQ ID NO: 43621 - RNA, 1695 nt, synthetic construct
  misc_feature 1..1695: note = derived and/or modified sequence opt5 from anti-influenza_Chain
  source 1..1695: mol_type = other RNA
atgaaggtgaaactgctcgtcctgctttgcaccttcacagccacgtacgctgacaccatctgtattggctatcacgccaacaatagcacagataccgttgacacagtgctggagaagaacgtgaccgtcacacattccgtgaatctcctggaaaactctcacaatgggaaactttgcctgctcaagggaatcgcgcccctgcagctgggcaactgtagcgttgctgggtggattctcggaaatcctgagtgcgaactgcttatctccaaagagtcttggagctacattgtggaaaagccgaaccccgagaatggcacctgttatcctgggcattttgccgattacgaggaactgagagagcaactctcctctgtcagctccttcgaacggtttgagatcttccccaaggagagctcttggcctaaccacacggtgaccggagtttccgccagctgctctcataatggcgaatccagcttttatcgcaacctgctttggctgacaggcaaaaatgggctctaccccaacctgtctaagtcctatgctaataacaaagagaaggaagtgctggtcctctggggagtgcaccaccctccgaacatcggcgaccagaaagccctgtaccataccgagaatgcttacgtgagcgtcgtttcctctcactatagcagaaagttcacacccgaaattgccaagcggcctaaagtgcgcgatcaggaggggagaatcaactactattggacccttctggagcccggagacacgattatctttgaagcgaatggcaacctcattgcccctcggtacgctttcgccctgtcccgcgggtttggaagcggcatcattaattctaacgctcccatggataagtgtgacgccaaatgccagacaccgcaaggcgcgatcaattccagccttcctttccagaacgtgcatcccgtcaccatcggggagtgtcctaagtatgtgagatctgccaaactgcggatggttacaggactccgcaatattcccagcatccagtccagaggcctgtttggggctattgccggattcatcgaaggcgggtggaccggaatggtggatggctggtacggctatcaccaccagaacgagcaagggtctggatacgctgccgaccaaaagagcacccagaatgccattaacggcatcacaaataaagtcaactccgtgatcgaaaagatgaatacgcagtttaccgctgttgggaaggagttcaacaaactggagcggcgcatggaaaacctcaataagaaagtggatgacggattcattgatatctggacatacaacgcggagctgcttgtcctgctcgaaaatgagagaaccctggactttcatgacagcaacgtgaagaatctttatgaaaaagtcaagtctcagctgaagaacaatgccaaagagattggcaacgggtgcttcgagttttaccacaagtgtaatgatgaatgcatggagtccgtgaaaaacggcacatatgactaccccaagtatagcgaagagtctaaactcaatcgggagaagatcgatggagttaagctggaatccatgggcgtgtaccagattctggctatctatagcaccgtcgcctcctctctcgtgctgcttgttagcctgggggccatctccttctggatgtgctctaacggaagcctccagtgtcgcatttgcatc

SEQ ID NO: 43622 - RNA, 1695 nt, synthetic construct
  misc_feature 1..1695: note = derived and/or modified sequence opt5 from anti-influenza_Chain
  source 1..1695: mol_type = other RNA
atgaaggccaaactgctcgtgctgctttgcaccttcacagctacgtacgccgacaccatctgtattggctatcacgcgaacaatagcacagataccgtcgacacagttctggagaagaacgtgaccgtgacacattccgtcaatctcctggaagattctcacaacgggaaactttgcctgctcaagggaatcgctcccctgcagctgggcaattgtagcgtggccgggtggattctcggaaaccctgagtgcgaactgcttatctccaaagagtcttggagctacattgttgaaaccccgaatcccgagaacggcacgtgttatcctgggtactttgccgactatgaggaactgagagagcaactctcctctgtgagctccttcgaacggtttgagatcttccccaaggagagctcttggcctaatcataccgtcacaggagtgtccgctagctgctctcacaacggcaagtccagcttttaccgcaatctgctttggctgaccggcaaaaacgggctctatcccaatctgtctaagtcctacgttaacaataaagaaaaggaggtgctggtcctctggggagtgcatcaccctccgaacatcggcaaccagagagccctgtaccacacagaaaatgcttatgtgagcgtcgtttcctctcattacagccggcgcttcacccccgagattgccaaaagacctaaggtgcgggatcaggaagggcgcatcaactattactggacgcttctggagcccggagacacaattatctttgaggcgaatggcaacctcattgccccttggtatgctttcgccctgtccagagggtttggaagcggcatcattacctctaatgctcccatggatgaatgtgacgccaagtgccagacaccgcaaggcgcgatcaactccagccttcctttccagaatgtgcaccccgtcaccatcggggagtgtcctaaatacgtgcggtctgccaagctgcgcatggttaccggactcagaaacattcccagcatccagtcccggggcctgtttggggctattgccggattcatcgaaggcgggtggacaggaatggtggatggctggtatggctaccatcaccagaatgagcaagggtctggatacgctgccgaccagaaaagcacgcagaacgccattaatggcatcaccaacaaggtcaattccgtgatcgaaaagatgaacacacagtttaccgctgttgggaaagagttcaataaactggagcgcagaatggaaaacctcaacaagaaggtggatgacggattcctggatatttggacatataatgcggagcttctggtcctcctggaaaacgagcggacccttgactttcacgacagcaatgtgaaaaacctgtacgaaaaggtcaaatctcaactcaagaataacgccaaagagatcggcaatgggtgcttcgagttttatcataagtgtaacaatgaatgcatggagtccgtgaagaacggcacgtacgattatcccaaatacagcgaagagtctaagctgaatcgcgagaaaattgacggagttaagctggaatccatgggcgtgtatcagatcctcgctatttacagcacagtcgcctcctctctggtgcttctggttagcctcggggccatctccttctggatgtgctctaacggaagcctgcagtgtagaatctgcatt

SEQ ID NO: 43623 - RNA, 1695 nt, synthetic construct
  misc_feature 1..1695: note = derived and/or modified sequence opt5 from anti-influenza_Chain
  source 1..1695: mol_type = other RNA
atgaaggtgaaactgctcgtcctgctttgcaccttcacagccacgtacgctgacaccatctgtattggctatcacgccaacaatagcacagataccgttgacacagtgctggagaagaacgtgaccgtcacacattccgtgaatctcctggaagattctcacaacgggaaactttgcctgctcaagggaatcgcgcccctgcagctgggcaattgtagcgttgctgggtggattctcggaaaccctgagtgcgaactgcttatctccagagagtcttggagctacattgtggaaaaaccgaatcccgagaacggcacctgttatcctgggcattttgccgactacgaggaactgcgggagcaactctcctctgtcagctccttcgaacgctttgagatcttccccaaggagagctcttggcctaatcacacgaccacaggagtgtccgccagctgctctcataacggcgaatccagcttttataagaatctgctttggctgaccggcaaaaacgggctctaccccaatctgtctaagtcctatgctaacaataaagagaaggaagttctggtgctctggggagtccaccaccctccgaacatcggcgatcagagagccctgtaccataaagagaacgcttacgtgagcgtggtctcctctcactatagccggaagttcacacccgaaattgccaagcgccctaaagttagagaccaggaggggcggatcaattactattggacccttctggagcccggagatacgattatctttgaagcgaacggcaatctcattgcccctcgctacgctttcgccctgtccagagggtttggaagcggcatcattaactctaatgctcccatggacgagtgtgatgccaagtgccagacaccgcaaggcgcgatcaactccagccttcctttccagaatgtgcatcccgtgaccatcggggaatgtcctaaatatgtccggtctgccaagctgcgcatggtgacaggactcagaaacattcccagcatccagtcccggggcctgtttggggctattgccggattcatcgagggcgggtggaccggaatggttgacggctggtacggctatcaccaccagaatgaacaagggtctggatacgctgccgatcagaaaagcacccagaacgccattaatggcatcacaaacaaggtcaattccgtgatcgagaaaatgaacacgcagtttaccgctgtggggaaggagttcaataagctggaacgcagaatggagaacctcaacaaaaaggttgacgatggattcattgacatctggacatacaatgcggaactgcttgtgctgctcgagaacgaacggaccctggactttcatgatagcaatgtcaaaaacctttatgagaaggtgaaatctcaactgaagaataacgccaaggagattggcaatgggtgcttcgaattttaccacaaatgtaacgacgagtgcatggaatccgtcaagaatggcacatatgattaccccaaatatagcgaggagtctaagctcaaccgcgagaaaatcgacggagtgaagctggaatccatgggcgtttaccagattctggctatctatagcaccgtggcctcctctctcgtcctgcttgtgagcctgggggccatctccttctggatgtgctctaatggaagcctccagtgtagaatttgcatc

SEQ ID NO: 43624 - RNA, 1677 nt, synthetic construct
  misc_feature 1..1677: note = derived and/or modified sequence opt5 from anti-influenza_Chain
  source 1..1677: mol_type = other RNA
gacaagatctgcattggctaccagagcaccaactccacagagacggtggataccctgacaaaaaccaatgtccccgttacacaagccaaggaactcctgcacaccgagcataacgggatgctttgtgctacaaatctgggacaccctctcatcctggatacctgcacgattgaaggccttatctatgggaacccgtcttgtgacctgctcctgggaggcagagagtggagctacattgtggaacggccctccgccgtgaatgggatgtgctatcctggaaacgtcgagaatctggaggaactccgcctgcttttctctagcgcgtcctcttaccagagagtgcagatctttcccgacaccatctggaacgttacatatagcggcacctccagcgcttgttctaattccttctaccggagcatgcgctggctgacacagaaagataacacctatcctgtgcaagacgcccagtacacgaataacagaggcaagtctattctctttatgtgggggatcaatcatccccctacagataccgtccagacaaacctgtacacccggaccgacacaacgacctccgtgacaaccgaggatattaatcgcgccttcaaaccggttatcggacccagacctcttgtgaacggcctgcaggggcggattgactattactggagcgtcctcaagcccggacaaacactgcgcgtgagatctaacggcaatctgatcgctccttggtatgggcacattctctccggagaaagccatggccggatcctgaagtccgatcttaactctggcaattgcgtggtccagtgtcagaccgagcgcgggggactgaacacgacactcccctttcacaatgttagcaaatacgccttcggcaactgcccgaagtatgtgggggtgaaatccctgaaacttgctgtcggaatgagaaatgtgcctgcccggagctctcgcggcctgtttggggcgatcgccggattcattgagggcggctggcccgggctcgttgctggatggtacggctttcagcactccaacgaccaaggggtgggaatggccgctgatagagacagcacccagaaggccatcgacaagattacctctaaggtcaataacatcgtggataaaatgaataagcagtatgaaattatcgaccatgagttcagcgaaatcgagacacggctgaacatgattaataacaaaatcgatgaccaaattcaggatatctgggcgtacaatgccgaactgctcgttctgcttgagaaccagaagaccctggacgagcacgatgctaacgtgaataacctctacaataaagtcaagagagccctgggctccaacgctatggaagacgggaaaggctgttttgagctttatcataagtgcgatgaccgctgtatggaaacaattcggaatggaacgtacaacagaggcaagtataaagaggaatctcgcctggagcggcagaagatcgagggggtgaaactcgaaagcgagggaacctacaagtccggcagactggtccctcgcgggagccccggatctggctatatccccgaagcccctcgggatgggcaagcctacgtgagaaaagacggcgagtgggttctgctctccacattcctgggaaagccgattcccaatcctcttctgggcctcgacagcaccggg

SEQ ID NO: 43625 - RNA, 1677 nt, synthetic construct; identical to SEQ ID NO: 43624
  misc_feature 1..1677: note = derived and/or modified sequence opt5 from anti-influenza_Chain
  source 1..1677: mol_type = other RNA

SEQ ID NO: 43626 - RNA, 1695 nt, synthetic construct; identical to SEQ ID NO: 43617
  misc_feature 1..1695: note = derived and/or modified sequence opt5 from anti-influenza_Chain
  source 1..1695: mol_type = other RNA

SEQ ID NO: 43627 - RNA, 1695 nt, synthetic construct; identical to SEQ ID NO: 43614
  misc_feature 1..1695: note = derived and/or modified sequence opt5 from anti-influenza_Chain
  source 1..1695: mol_type = other RNA

SEQ ID NO: 43628 - RNA, 1695 nt, synthetic construct; identical to SEQ ID NO: 43615
  misc_feature 1..1695: note = derived and/or modified sequence opt5 from anti-influenza_Chain
  source 1..1695: mol_type = other RNA

SEQ ID NO: 43629 - RNA, 1695 nt, synthetic construct; identical to SEQ ID NO: 43616
  misc_feature 1..1695: note = derived and/or modified sequence opt5 from anti-influenza_Chain
  source 1..1695: mol_type = other RNA

SEQ ID NO: 43630 - RNA, 1695 nt, synthetic construct; identical to SEQ ID NO: 43618
  misc_feature 1..1695: note = derived and/or modified sequence opt5 from anti-influenza_Chain
  source 1..1695: mol_type = other RNA

SEQ ID NO: 43631 - RNA, 1695 nt, synthetic construct; identical to SEQ ID NO: 43619
  misc_feature 1..1695: note = derived and/or modified sequence opt5 from anti-influenza_Chain
  source 1..1695: mol_type = other RNA

SEQ ID NO: 43632 - RNA, 1695 nt, synthetic construct; identical to SEQ ID NO: 43620
  misc_feature 1..1695: note = derived and/or modified sequence opt5 from anti-influenza_Chain
  source 1..1695: mol_type = other RNA

SEQ ID NO: 43633 - RNA, 1695 nt, synthetic construct; identical to SEQ ID NO: 43621
  misc_feature 1..1695: note = derived and/or modified sequence opt5 from anti-influenza_Chain
  source 1..1695: mol_type = other RNA

SEQ ID NO: 43634 - RNA, 1695 nt, synthetic construct; identical to SEQ ID NO: 43622
  misc_feature 1..1695: note = derived and/or modified sequence opt5 from anti-influenza_Chain
  source 1..1695: mol_type = other RNA

SEQ ID NO: 43635 - RNA, 1695 nt, synthetic construct; identical to SEQ ID NO: 43623
  misc_feature 1..1695: note = derived and/or modified sequence opt5 from anti-influenza_Chain
  source 1..1695: mol_type = other RNA

SEQ ID NO: 43636 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttcgctcagaaacttcccggcaacgacaattccacagccacgctgtgtctcgggcaccatgcggtccctaacggaaccattgttaagacaatcaccaatgatcaaattgaggtgacaaacgctaccgaactggtgcagtctagctccacaggcgggatctgcgactctccgcaccagatccttgatggagagaattgtaccctgattgacgccctcctgggcgatccccagtgcgacgggtttcaaaacaaaaagtgggatctgttcgtcgaaagaagcaaagcctattccaattgttacccttatgacgtgcccgattacgcttctctccggagcctggttgcctccagcggaacgcttgagtttaacaatgaatctttcaactggaccggcgtgacacagaatggcacctccagcgcttgcaagcgcagatctaacaattcctttttcagccggctgaactggctcacacatctgaagtttaaatatcctgcccttaatgtcaccatgcccaacaacgagaagttcgacaaactgtacatctggggagtgcaccatcctgggacggataatgaccagatttctctctatgcgcaggcctccggccgcatcacagttagcaccaagagatcccaacagacagtgattccgtctatcgggagccggccccgcattagagatgtcccttcccggatcagcatctactggaccattgtgaaacccggagacatcctgctgattaactctaccggcaatctcatcgctcctcgcgggtactttaagattagatccggaaagagctctatcatgcggagcgacgcccccatcggcaaatgtaactccgagtgcattacaccgaatggctctatccctaacgataagcccttccagaatgtgaaccgcattacgtatggggcttgtcctagatacgtcaaacagaataccctgaaacttgccacaggaatgcggaacgttcccgaaaaacaaacccgcggcatctttggggcgattgccggattcatcgagaatggctgggaagggatggtggacggatggtatggctttagacaccagaacagcgagggcacagggcaggctgccgatctgaagtccacccaagctgccatcaatcagattaacggaaaactcaatcggctgatcggcaagacgaacgagaagttccaccagattgaaaaagagttcagcgaagtggaggggagaatccaggaccttgaaaagtacgtcgaggatacaaaaattgacctgtggtcttataacgccgagctcctggtggctctggaaaatcaacataccatcgatctcaccgactccgagatgaacaagctgtttgaacgcacaaagaagcagcttcgggagaatgcggaagatatgggaaacggctgcttcaagatttaccacaaatgtgacaatgcctgcatcgggagcatcagaaacggcacctatgatcatgacgtttaccgcgacgaggctctgaataaccggtttcagattaagggagtggagctcaaatctggctacaaggattggatcctgtggatttccttcgccatcagctgctttcttctgtgtgtcgccctcctggggttcattatgtgggcttgccagaaaggaaatatcagatgtaacatctgcatt

SEQ ID NO: 43637 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgtccgctcagaaattccccggcaacgacaattctacagccacgctttgtctggggcaccatgcggtccctaacggaaccattgttaagacaatcaccaatgatcaaattgaggtgacaaacgctaccgaactcgtgcagagctcctctacaggcgagatctgcgacagcccgcaccagatcctggatggggaaaattgtacccttattgacgccctgctcggagatccccagtgcgacggctttcaaaacaaaaagtgggatctgttcgtcgagagatccaaagcctattctaattgttacccttatgacgtgcccgattacgctagcctgcggtccctcgttgccagctctgggacgctggaatttaacaatgagtccttcaactggaccggagtgacacagaatggcaccagctctgcttgcatccgcagatccaacaatagctttttctctcggcttaactggctgacacatctcaagtttaagtatcctgccctgaatgtcaccatgcccaacaacgaggagttcgacaaactttacatttggggcgtgcaccatcctgggacggataatgaccagatctttctgtatgcgcaggcctccggacgcattacagttagcaccaagagatcccaacagacagtgatcccgaacattcggtctcgccccagagtccggaatatccctagccgcatctccatttactggaccatcgtgaaacccggcgatattctcctgatcaacagcaccgggaatctgattgctcctagaggatacttcaagatccggtctggcaaatccagcatcatgcgctctgacgcccccattgggaagtgtaacagcgaatgcatcacaccgaatggatccattcctaacgacaagccctttcagaatgtgaacagaatcacgtatggcgcttgtcctcggtacgtcaaacagaataccctcaagctggccacaggcatgcgcaacgttcccgaaaaacaaaccagagggattttcggagcgatcgccggctttatcgagaatgggtgggagggaatggtggatggctggtatgggttccggcaccagaactctgaaggaattggccaggctgccgaccttaagagcacacaagctgccatcgatcagattaatggcaaactgaacagactcatcgggaagaccaacgagaaattccaccagattgaaaaggagttttccgaagtggagggacgcatccaggacctggagaagtacgtcgaagatacgaaaattgacctttggagctataatgccgagctgctcgtggctctggaaaaccaacatacaatcgatctgaccgactctgagatgaataaactcttcgaaaagaccaagaaacagctgcgggagaacgcggaggatatgggcaatgggtgctttaagatctaccacaagtgtgacaacgcctgcattggatccatcagaaatggcacatatgatcatgacgtttaccgcgacgaagctcttaacaatcggttccagattaaaggggtggagctcaagagcggctacaaagattggatcctgtggatttcttttgccatctcctgcttcctgctttgtgtcgccctgctcggatttatcatgtgggcttgccagaagggcaacattagatgtaatatctgcatt

SEQ ID NO: 43638 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttcgctcagaaacttcccggcaacgacaattccacagccacgctgtgtctcgggcaccatgcggtccctaacggaaccattgttaagacaatcaccaatgatcaaattgaggtgacaaacgctaccgaactggtgcagtctagctccacaggcgagatctgcgactctccgcaccagatccttgatggggaaaattgtaccctgattgacgccctcctgggagatccccagtgcgacggctttcaaaacaaaaagtgggatctgttcgtcgagagaagcaaagcctattccaattgttacccttatgacgtgcccgattacgcttctctccggagcctggttgcctccagcgggacgcttgaatttaagaacgagtctttcaattggaccggagtgacacagaacggcacctccagcgcttgcatccgcagatctaataactcctttttcagccggctgaattggctcacacatctgaagtttaaatatcctgcccttaacgtcaccatgcccaataaggagaaattcgacaagctgtacatttggggcgtgcaccatcctgggacggataacgaccagatctttctctatgcgcaggcctctggacgcattacagtttccaccaaaagaagccaacagacagtgatcccgaacattggctcccggctgcgcgtcagagatatcccctctcggatcagcatttactggaccatcgtgaagcctggggacattctgctcatcaattccaccggaaacctgattgctccccgcggctacttcaagatcagaagcgggaaatcttccatcatgcggagcgacgcccctattggaaagtgtaattctgaatgcatcacacccaacggcagcattccgaatgataaaccttttcagaacgtgaatcgcatcacgtatggcgcttgtcccagatacgtcaagcagaacacccttaaactggccacagggatgcggaatgttcctgagaagcaaacccgcggaattttcggcgcgatcgccgggtttatcgaaaacggatgggagggcatggtggacgggtggtatggattcagacaccaaaattccgagggcacaggccaggctgccgatctcaaatctacccaggctgccattgaccagatcaacgggaagctgaatcggcttattggaaagacgaacgaaaaattccaccagatcgagaaggaatttagcgaggtggaaggccgcattcaggatctggagaaatacgtcgaggacacaaagatcgatctctggtcctataatgccgaactgctggtggctctcgagaaccaacataccattgacctgaccgatagcgaaatgaacaaacttttcgagaagacaaagaaacagctgagagaaaatgcggaggacatggggaacggatgctttaagatctaccacaaatgtgataatgcctgcatcggctctattcggaacgggacctatgaccatgacgtttacagagatgaggctctcaataaccgcttccagatcaagggcgtggaactgaaatccggatacaaggactggattctttggatcagctttgccatttcttgcttcctgctctgtgtcgccctgctgggctttatcatgtgggcttgccagaaggggaatatccggtgtaacatttgcatc

SEQ ID NO: 43639 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttcgctcagaaacttcccggcaacgacaattccacagccacgctgtgtctcgggcaccatgcggtccctaacggaaccattgttaagacaatcaccaatgatcaaattgaggtgacaaacgctaccgaactggtgcagtctagctccacaggcgagatctgcgactctccgcaccagatccttgatggggaaaattgtaccctgattgacgccctcctgggagatccccagtgcgacggctttcaaaacaaaaagtgggatctgttcgtcgagagaagcaaagcctattccaagtgttacccttatgacgtgcccgattacgcttctctccggagcctggttgcctccagcgggacgcttgaatttaataacgagtctttcaattggaccggagtgacacagaacggcacctccagcgcttgcatccgcagatctaataactcctttttcagccggctgaattggctcacacatctgaagtttaaatatcctgcccttaacgtcaccatgcccaataacgagaagttcgacaaactgtacatttggggcgtgcaccatcctgggacggataacgaccagatctttctctatgcgcaggcctctggacgcattacagtttccaccaagagaagccaacagacagtgatcccgaatattggctcccggccccgcgtcagagatatcccttctcggatcagcatttactggaccatcgtgaaacccggggacattctgctgatcaactccaccggaaatctcattgctcctcgcggctacttcaagatcagaagcgggaagtcttccatcatgcggagcgacgcccccattggaaaatgtaactctgaatgcatcacaccgaatggcagcattcctaacgataagccctttcagaatgtgaaccgcatcacgtatggcgcttgtcctagatacgtcaaacagaataccctgaaacttgccacagggatgcggaacgttcccgagaagcaaacccgcggaattttcggcgcgatcgccgggtttatcgaaaatggatgggagggcatggtggacgggtggtatggattcagacaccagaactccgagggcattggccaggctgccgatctgaagtctacacaagctgccatcgaccagattaatgggaaactcaaccggctgatcggaaagaccaatgaaaagttccaccagattgagaaagaatttagcgaggtggaaggcagaatccaggatcttgagaagtacgtcgaggacacgaaaattgatctgtggtcctataacgccgaactcctggtggctctggagaaccaacatacaatcgacctcaccgatagcgaaatgaataagctgttcgagaaaaccaagaagcagcttcgcgaaaacgcggaggacatggggaatggatgctttaaaatctaccacaagtgtgataacgcctgcattggctctatccggaatgggacatatgaccatgacgtttacagagatgaggctctgaacaatcgcttccagattaaaggcgtggaactcaagtccggatacaaagactggatcctgtggattagctttgccatctcttgcttccttctgtgtgtcgccctcctgggctttatcatgtgggcttgccagaaggggaacattcggtgtaatatctgcatt

SEQ ID NO: 43640 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttcgctcagaaacttcccggcaacgacaattccacagccacgctgtgtctcgggcaccatgcggtccctaacggaaccattgttaagacaatcaccaatgatcaaattgaggtgacaaacgctaccgaactggtgcagtctagctccacaggcgagatctgcgactctccgcaccagatccttgatggggaaaattgtaccctgattgacgccctcctgggagatccccagtgcgacggctttcaaaacaaaaagtgggatctgttcgtcgagagaagcaaagcctattccaattgttacccttatgacgtgcccgattacgcttctctccggagcctggttgcctccagcgggacgcttgaatttaacaatgagtctttcaactggaccggagtgacacagaatggcacctccagcgcttgcatccgcagatctaacaattcctttttcagccggctgaactggctcacacatctgaagtttaagtatcctgcccttaatgtcaccatgcccaacaacgagaaattcgacaagctgtacatttggggcgtgcaccatcctgggacggataatgaccagatctttctctatgcgcaggcctctggacgcattacagtttccaccaaaagaagccaacagacagtgatcccgaacattggctcccggccccgcgtcagaaatatcccttctcggatcagcatttactggaccatcgtgaagcccggggatattctgctgatcaactccaccggaaatctcattgctcctcgcggctacttcaaaatcagaagcgggaagtcttccatcatgcggagcgacgcccccattggaaagtgtaactctgaatgcatcacaccgaatggcagcattcctaacgacaaaccctttcagaatgtgaaccgcatcacgtatggcgcttgtcctagatacgtcaagcagaataccctgaaacttgccacagggatgcggaacgttcccgagaagcaaacccgcggaattttcggcgcgatcgccgggtttatcgaaaatggatgggagggcatggtggatgggtggtatggattcagacaccagaactccgagggcattggccaggctgccgacctgaaatctacacaagctgccatcgatcagattaatgggaagctcaaccggctgatcggaaaaaccaacgaaaagttccaccagattgagaaggaatttagcgaggtggaaggcagaatccaggaccttgagaaatacgtcgaggatacgaagattgacctgtggtcctataatgccgaactcctggtggctctggagaaccaacatacaatcgatctcaccgacagcgaaatgaataaactgttcgagaagaccaaaaagcagcttcgcgaaaacgcggaggatatggggaatggatgctttaagatctaccacaaatgtgacaacgcctgcattggctctatccggaatgggacatatgatcatgacgtttacagagacgaggctctgaacaatcgcttccagattaagggcgtggaactcaaatccggatacaaggattggatcctgtggattagctttgccatctcttgcttccttctgtgtgtcgccctcctgggctttatcatgtgggcttgccagaaagggaacattcggtgtaatatctgcatt

SEQ ID NO: 43641 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttctcccagaaacttcccggcaacgacaattctacagctacgctgtgtctcgggcaccatgccgtccctaacggaaccattgttaagacaatcaccaatgatcaaattgaggtgacaaacgcgaccgaactggtgcagagctcctctacaggcgggatctgcgacagcccgcaccagatccttgatggagagaattgtaccctgattgacgctctcctgggcgatccccagtgcgacgggtttcaaaacaaaaagtgggatctgttcgtcgaaagatccaaagcctattctaattgttacccttatgacgtgcccgattacgccagcctccggtccctggttgctagctctggaacgcttgagtttaacaatgaatccttcaactgggccggcgtgacccagaatggcacaagctctgcttgcaagcgcagatccaacaagagctttttctctcggctgaattggctcacccatctgaaatataagtaccctgcccttaacgtcacaatgcccaataacgagaaatttgacaagctgtatatctggggagtgcaccatcctgttaccgattccgaccagattagcctctacgcgcaggcctccgggcgcatcacggtgtctacaaaaagaagccaacagaccgtcattccgaacatcggctaccggccccgcgtgagagatatttccagccggatctctatctattggacaattgtgaagcctggggacatcctgctgattaattccaccggaaacctcatcgctccccgcggctacttcaagattagaagcgggaaatctagcatcatgcggtccgacgcccctatcggaaagtgtaattctgagtgcattacccccaacggcagcatcccgaatgataaaccttttcagaacgtcaatcgcattacatatggcgcttgtcccagatacgttaagcagaacacgctgaaacttgccaccgggatgcggaatgtgcctgaaaagcaaacacgcggaatcttcggcgcgattgccgggtttatcgagaacggatgggaaggcatggtggacgggtggtatggattcagacaccaaaattccgagggcaccggccaggctgccgatctgaaaagcacacaggctgccatcaaccagattaatgggaagctcaaccggctgatcggaaagaccaatgagaaatttcaccagattgaaaaggagttctctgaagtcgagggcagaatccaggaccttgaaaaatacgtggaggatacgaagattgacctgtggtcctataacgccgagctcctggttgctctggaaaaccaacatacaatcgatctcaccgacagcgagatgaataaactgttcgaacgcaccaagaagcagcttcgggagaacgcggaagatatggggaatggatgctttaaaatttaccacaagtgtgacaacgcctgcatcgagtctatcagaaatggcacatacgatcatgacgtgtatcgcgacgaggctctgaacaatcggttccagattaaaggggtcgaactcaagtccggctacaaagattggatcctgtggattagctttgccatctcctgcttccttctgtgtgtggccctcctgggatttattatgtgggcttgccagaagggcaacatcagatgtaatatctgcatt

SEQ ID NO: 43642 - RNA, 1698 nt, synthetic construct
  misc_feature 1..1698: note = derived and/or modified sequence opt5 from anti-influenza_Chain
  source 1..1698: mol_type = other RNA
atgaagaccatcattgccctgagctacatcctctgcctggtgttcgctcagaaacttcccggcaacgacaattccacagccacgctgtgtctcgggcaccatgcggtccctaacggaaccattgttaagacaatcaccaatgatcaaattgaggtgacaaacgctaccgaactggtgcagtctagctccacaggcgggatctgcgactctccgcaccagatccttgatggagagaattgtaccctgattgacgccctcctgggcgatccccagtgcgacgggtttcaaaacaaaaagtgggatctgttcgtcgaaagaagcaaagcctattccaattgttacccttatgacgtgcccgattacgcttctctccggagcctggttgcctccagcggaacgcttgagtttaacgacgaatctttcaattggaccggcgtgacacagaacggcacctccagctcttgcaagcgcagatccaataacagctttttctctcggctgaattggctcacacatctgaagtttaaatatcctgctcttaacgtcaccatgcccaataacgagaagttcgataaactgtacatctggggagtgcaccatcctgttacggacaacgatcagatttttctctatgcccaggcgtccgggcgcatcacagtgagcaccaagagatcccaacagacagtcattccgaatatcggctctcggccccgcattagaaacatccctagccggatctccatttactggaccatcgtgaaacccggggacattctgctgatcaatagcaccggaaacctcattgcccctcgcggctacttcaagatcagatctgggaagtccagcatcatgcggtctgacgctcccattggaaaatgtaatagcgagtgcatcacaccgaacggctccattcctaatgataagccctttcagaacgtgaatcgcatcacgtatggcgcctgtcctagatacgtcaaacagaacaccctgaagctggctacagggatgcggaatgttcccgaaaaacaaacccgcggaattttcggcgccatcgcggggtttatcgagaacggatgggaaggcatggtggacgggtggtatggattcagacaccaaaattctgagggcattggccaggccgctgatcttaagagcacacaggccgctatcaaccagattaatgggaaactcaaccggctgatcggaaagaccaacgagaagttccaccagattgaaaaagagttttccgaagtggagggcagaatccaggaccttgaaaagtacgtcgaggatacgaaaattgacctgtggagctataatgccgagctcctggtggccctggaaaaccaacatacaatcgatctcaccgactctgagatgaataagctgttcgaacgcaccaaaaagcagcttcgggagaacgctgaagatatggggaatggatgctttaagatctaccacaaatgtgacaacgcgtgcattggctccatcagaaatgggacatatgatcatgacgtttaccgcgacgaggccctgaacaatcggttccagattaagggcgtggagctcaaaagcggatacaaggattggatcctgtggatttcttttgctatctcctgcttccttctgtgtgtcgccctcctgggctttatcatgtgggcctgccagaaagggaacattagatgtaatatctgcatt

SEQ ID NO: 43643 - RNA, 1698 nt, synthetic construct
  misc_feature 1..1698: note = derived and/or modified sequence opt5 from anti-influenza_Chain
  source 1..1698: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaaactctgtgatctggacggagtgaaaccccttatcctgagagattgcagcgttgcgggctggctcctggggaaccctatgtgtgacgagttcatcaatgtgccggaatggtcctatattgtcgagaaggctaaccccaccaatgatctgtgctaccctggatcttttaacgactatgaggaactcaagcatctgcttagccggatcaatcacttcgagaaaattcagatcattcccaagtcctcttggagcgatcatgaagcctccagcggcgtgtcttccgcctgtccttacctggggagcccctcctttttccgcaacgttgtgtggctcatcaaaaagaactctacatatcctaccattaaaaagagctacaataatacaaaccaggaggacctgcttgtcctgtggggaatccaccacccgaatgatgctgccgagcaaaccagactctatcagaaccccacgacctacatctctattggcacatccaccctgaaccagcggctggtgcctaagatcgctacacgcagcaaagtgaatggccagtccgggagaatggaatttttctgggccattctcaagcccaacgacgcgatcaattttgagtctaacggaaatttcattgcccctgaatacgcttataaaatcgtcaagaaaggcgatagcgccatcatgaagtccgagctggaatacgggaactgcaataccaaatgtcaaacgcccatgggagctattaacagctctatgccgtttcataatatccaccctcttacaattggcgagtgccccaagtatgttaagtccaaccggctggtgctcgccaccgggctgcgcaatagccctcagagagagtctcggcgcaaaaagagaggacttttcggcgcgatcgccggctttattgaagggggatggcagggcatggtggacgggtggtacggatatcatcacagcaacgagcagggctccgggtacgctgccgacaaagaatctacacaaaaggctatcggagtcaccaataaagtgaacagcatcattgataagatgaatacccagttcgaggccgttggccgggaatttaacaacctggagcgcagaatcgagaatctcaacaagaaaatggaagacggcttcctggatgtgtggacatataatgccgagctgctcgtcctgatggaaaacgagcggacgcttgacttccacgattccaatgtgaagaacctgtacgacaaagttcgcctccagctgagagataatgctaaggaacttgggaacggatgttttgagttctaccataaatgcgacaatgagtgtatggaaagcattcggaacggcacctataatccccaatactctgaggaagcgagactgaagcgcgaggagatctccggggtgaagctcgaaagcattggaacatatcagatcctgtctatttactccaccgtcgccagctccctggctctcgccatcatgatcgccggcctgtctctttggatgtgcagcaacgggtccctgcagtgccggatttgtatc

SEQ ID NO: 43644 - RNA, 1698 nt, synthetic construct
  misc_feature 1..1698: note = derived and/or modified sequence opt5 from anti-influenza_Chain
  source 1..1698: mol_type = other RNA
atgaaggccatcctggtggtcctcctgtacaccttcgctacagccaacgcggacacgctttgcattggctatcacgctaataacagcaccgatacagttgacaccgtgctggagaagaatgtgacagtcacccattccgtgaacctcctggaagataagcacaatgggaaactttgtaagctgagaggagttgctcccctccatctgggcaaatgcaacatcgccgggtggattctgggaaatcctgagtgtgaatctctcagcacagcctcctcttggagctacatcgtggagacctcctctagcgacaacggcacgtgctatccgggggattttattgactacgaagaactgcgggagcagctttccagcgtctcttccttcgaacgctttgagatcttccccaagaccagctcttggcctaatcacgattccaacaagggagtgacagccgcttgtccccatgccggcgcgaaatctttttataagaatctgatctggctcgttaaaaagggcaacagctaccctaaactgtccaagagctatattaatgacaaggggaaagaagtgcttgtcctgtggggaatccaccacccctccacctctgccgatcaacagagcctctaccagaacgctgacgcctacgtgttcgtgggcacatccagatatagcaagaaatttaagcctgagattgctatccggccgaaagtccgcgatcaggaggggagaatgaattactattggaccctggttgaacccggagacaagattacgttcgaggccacaggcaacctggtggtgcctcggtacgcgtttgccatggaacgcaacgctgggtctggaatcattatctccgatacccccgtccatgactgcaatacaacctgtcaaacccctaaaggcgccatcaacacaagcctccccttccagaatattcacccgatcacgattggcaagtgccctaagtatgtgaaatctaccaagctgagacttgctacagggctgcggaacgttcccagcatccagtcccgcggactctttggcgccattgccgggttcatcgagggaggctggaccgggatggtggacggatggtacggctatcatcaccagaatgaacaaggctctgggtacgctgcggatctgaaaagcacacagaacgccatcgacgagattaccaataaggtcaactccgtgatcgagaaaatgaatacgcagtttacagctgttggaaaggagttcaaccaccttgagaagagaattgaaaatctgaacaaaaaggtggatgacggcttcctcgatatctggacctacaatgccgagctgctggtcctcctggaaaacgagcggacccttgactatcatgatagcaatgtgaaaaacctgtacgagaaggtccgctctcagctcaaaaacaatgccaaggaaattgggaacggatgttttgagttctatcacaagtgcgacaatacatgtatggaatccgtgaaaaacggcacctacgattatcctaagtacagcgaggaagctaaactgaatagagaggagatcgacggggttaaacttgaatctacacggatctatcaaattctggccatctactccacggtggcgagctccctcgtcctggtggtttctctgggcgctattagcttttggatgtgctccaacggatctctccagtgccgcatctgtatt

SEQ ID NO: 43645 - RNA, 1698 nt, synthetic construct
  misc_feature 1..1698: note = derived and/or modified sequence opt5 from anti-influenza_Chain
  source 1..1698: mol_type = other RNA
atgaaggccatcctggtggtcctcctgtacaccttcgctacagccaacgcggacacgctttgcattggctatcacgctaataacagcaccgatacagttgacaccgtgctggagaagaatgtgacagtcacccattccgtgaacctcctggaagataagcacaatgggaaactttgtaagctgagaggagttgctcccctccatctgggcaaatgcaacatcgccgggtggattctgggaaatcctgagtgtgaatctctcagcacagcctcctcttggagctacatcgtggagacctcctctagcgacaacggcacgtgctatccgggggattttattgactacgaagaactgcgggagcagctttccagcgtctcttccttcgaacgctttgagatcttccccaagaccagctcttggcctaatcacgattccaacaagggagtgacagccgcttgtccccatgccggcgcgaaatctttttataagaatctgatctggctcgttaaaaagggcaacagctaccctaaactgtccaagagctatattaatgacaaggggaaagaagtgcttgtcctgtggggaatccaccatccccctacctccgccgatcaacagtctctctaccagaacgctgacgcctacgtgttcgtgggcagctccagatatagcaagaaatttaagccggagattgctatccggcccaaagtccgcgatcaggaggggagaatgaattactattggacactggttgaacctggagacaagattaccttcgaggccacgggcaacctggtggtgccccggtacgcgtttgccatggaacgcaacgctgggtctggaatcattatctccgatacacctgtccacgactgcaataccacatgtcaaacccccaaaggcgccatcaacaccagcctcccgttccagaatattcaccctatcacaattggcaagtgccccaagtatgtgaaatctacgaagctgagacttgctaccgggctgcggaacatccctagcattcagtcccgcggactctttggcgccatcgccgggttcatcgagggaggctggacagggatggttgacggatggtacggctatcatcaccagaatgaacaaggctctgggtacgctgcggatctgaaaagcacccagaacgccattgacgagatcacaaataaggtgaactccgtcattgagaaaatgaatacccagtttacggctgtgggaaaggagttcaaccaccttgagaagagaatcgaaaatctgaacaaaaaggttgatgacggcttcctcgatatttggacatacaatgccgagctgctggtgctcctggaaaacgagcggacccttgactatcatgatagcaatgtcaaaaacctgtacgagaaggtgcgctctcagctcaaaaacaatgccaaggaaatcgggaacggatgttttgagttctatcacaagtgcgacaatacctgtatggaatccgtcaaaaacggcacatacgattatcccaagtacagcgaggaagctaaactgaatagagaggagatcgacggggtgaaacttgaatctacccggatttatcaaatcctggccatttactccacagttgcgagctccctcgtgctggtcgtgtctctgggcgctatcagcttttggatgtgctccaacggatctctccagtgccgcatttgtatc

SEQ ID NO: 43646 - RNA, 1698 nt, synthetic construct; identical to SEQ ID NO: 43643
  misc_feature 1..1698: note = derived and/or modified sequence opt5 from anti-influenza_Chain
  source 1..1698: mol_type = other RNA

SEQ ID NO: 43647 - RNA, 1698 nt, synthetic construct; identical to SEQ ID NO: 43636
  misc_feature 1..1698: note = derived and/or modified sequence opt5 from anti-influenza_Chain
  source 1..1698: mol_type = other RNA

SEQ ID NO: 43648 - RNA, 1698 nt, synthetic construct; identical to SEQ ID NO: 43644
  misc_feature 1..1698: note = derived and/or modified sequence opt5 from anti-influenza_Chain
  source 1..1698: mol_type = other RNA

SEQ ID NO: 43649 - RNA, 1698 nt, synthetic construct; identical to SEQ ID NO: 43645
  misc_feature 1..1698: note = derived and/or modified sequence opt5 from anti-influenza_Chain
  source 1..1698: mol_type = other RNA

SEQ ID NO: 43650 - RNA, 1698 nt, synthetic construct; identical to SEQ ID NO: 43637
  misc_feature 1..1698: note = derived and/or modified sequence opt5 from anti-influenza_Chain
  source 1..1698: mol_type = other RNA

SEQ ID NO: 43651 - RNA, 1698 nt, synthetic construct; identical to SEQ ID NO: 43638
  misc_feature 1..1698: note = derived and/or modified sequence opt5 from anti-influenza_Chain
  source 1..1698: mol_type = other RNA

SEQ ID NO: 43652 - RNA, 1698 nt, synthetic construct; identical to SEQ ID NO: 43639
  misc_feature 1..1698: note = derived and/or modified sequence opt5 from anti-influenza_Chain
  source 1..1698: mol_type = other RNA

SEQ ID NO: 43653 - RNA, 1698 nt, synthetic construct; identical to SEQ ID NO: 43640
  misc_feature 1..1698: note = derived and/or modified sequence opt5 from anti-influenza_Chain
  source 1..1698: mol_type = other RNA

SEQ ID NO: 43654 - RNA, 1698 nt, synthetic construct; identical to SEQ ID NO: 43641
  misc_feature 1..1698: note = derived and/or modified sequence opt5 from anti-influenza_Chain
  source 1..1698: mol_type = other RNA

SEQ ID NO: 43655 - RNA, 1698 nt, synthetic construct; identical to SEQ ID NO: 43642
  misc_feature 1..1698: note = derived and/or modified sequence opt5 from anti-influenza_Chain
  source 1..1698: mol_type = other RNA

SEQ ID NO: 43656 - RNA, 1683 nt, synthetic construct
  misc_feature 1..1683: note = derived and/or modified sequence opt5 from anti-influenza_Chain
  source 1..1683: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgaaaagacacacaatgggaagctgtgtgatctcgacggagtgaaacccctgatccttagagattgcagcgttgcgggctggctgctcgggaaccctatgtgtgacgagtttatcaatgtgccggaatggtcctatattgtcgagaaggctaaccccgtgaatgatctgtgctaccctggagacttcaacgattatgaggaactgaagcatctcctgtctcggatcaatcactttgagaaaattcagatcattcccaagagctcctggtctagccatgaagcctcccttggcgttagctctgcctgtccttaccaggggaaatccagcttctttcgcaacgtggtctggctgatcaagaaaaattctacctatcccacaattaagagatcctacaacaataccaaccaagaggacctcctggtgctttggggaatccaccaccctaatgatgctgccgagcagacaaagctgtatcagaacccgaccacgtacatcagcgtgggcacctctacactcaaccagcggctggtcccccgcattgctaccagatccaaagttaatggccaaagcgggcggatggagttcttttggacaatcctgaagcctaacgacgccattaatttcgaatccaacggaaattttatcgcgcccgaatacgcctataaaattgtgaagaaaggcgattctaccatcatgaaaagcgagctcgaatacgggaactgcaatacgaaatgtcagacacctatgggagctatcaactccagcatgcccttccataatattcacccgctgaccatcggcgagtgccctaagtatgtgaagtctaaccgccttgtcctggccacagggctcagaaatagcccccagcgggagcgcagacggaaaaagcgcggactgtttggcgctattgccggcttcatcgaagggggatggcagggcatggtggacgggtggtacggatatcatcactccaacgagcaaggctctgggtacgcggccgacaaagaaagcacccagaaggctattgatggagttaccaataaagtgaactccatcatcgacaagatgaatacacagtttgaggccgtcggcagagagttcaacaaccttgaacggcgcattgagaatctgaacaagaaaatggaagatggcttcctcgacgtgtggacgtataatgctgagctgctggttctcatggaaaacgagagaaccctggattttcacgactctaatgtgaagaacctttacgataaagtccggctgcaactcagagacaatgccaaggaactggggaacggatgtttcgagttttaccataaatgcgataatgagtgtatggaaagcgtgcgcaacggcacatatgactaccctcagtattccgaggaagcccggcttaagagagaggagatcagcggggtcaagctggaatctattggaatctaccagattcagcactccggcgggcgcagctctctcgagggcccccggttcgaacaaaaactgatctccgaggaagatctgaatatgcataccgga

SEQ ID NO: 43657 - RNA, 1683 nt, synthetic construct
  misc_feature 1..1683: note = derived and/or modified sequence opt5 from anti-influenza_Chain
  source 1..1683: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaaactctgtgatctggacggagtgaaaccccttatcctgagagattgcagcgttgcgggctggctcctggggaaccctatgtgtgacgagttcatcaatgtgccggaatggtcctatattgtcgagaaggctaaccccgccaatgatctgtgctaccctggaaactttaatgactatgaggaactcaagcatctgctttctcggatcaaccacttcgagaaaattcagatcattcccaagagctcctggtctgatcatgaagccagctccggcgtgagctctgcttgtccttaccaggggaaatccagctttttccgcaatgttgtgtggctgatcaagaaaaactcttcctatcccaccattaagagaagctacaataacacaaatcaagaggacctcctggtcctttggggaatccaccaccctaacgatgccgctgagcagacccggctgtatcagaacccgacaacctacatctctgtgggcacgtccaccctcaatcagcgcctggtgcccaagattgccacaagaagcaaagtcaacggccaatccgggcggatggaatttttctggaccatcctgaagcctaatgacgcgattaactttgagtctaatggaaacttcatcgcccccgaatacgcttataaaattgttaagaaaggcgatagcgccatcatgaagtccgagctcgaatacgggaattgcaacacaaaatgtcagacccctatgggagctatcaatagctctatgccctttcataacattcacccgctgacgatcggcgagtgccctaagtatgtgaagtccaatcgccttgtgctggccacagggctcagaaacagcccccagcgggagcgcagacggaaaaagcgcggactgttcggcgcgattgccggctttatcgaagggggatggcagggcatggtcgacgggtggtacggatatcatcactctaatgagcaaggcagcgggtacgctgccgacaaagaatccacccagaaggctattgatggagtgacaaacaaagttaattctatcatcgacaagatgaacacccagttcgaggccgtgggcagagaatttaacaatcttgagcggcgcattgagaacctgaataagaaaatggaagatggcttcctcgacgtctggacctataacgccgagctgctggtgctcatggaaaatgagagaacactggatttccacgacagcaacgttaagaatctttacgataaagtgcggctgcaactcagagacaacgctaaggaactggggaatggatgttttgagttctaccataaatgcgataacgagtgtatggaatccgtccgcaatggcacgtatgactaccctcagtatagcgaggaagcgcggcttaagagagaggagatctctggggtgaagctggaatccattggaatctaccagattcagcacagcggcgggcggtcttccctcgagggcccccgctttgaacaaaaactgatcagcgaggaagatctgaacatgcataccgga

SEQ ID NO: 43658 - RNA, 1701 nt, synthetic construct
  misc_feature 1..1701: note = derived and/or modified sequence opt5 from anti-influenza_Chain
  source 1..1701: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaagctctgtgatctggacggagtgaaaccccttatcctgagagattgcagcgttgcgggctggctcctggggaaccctatgtgtgacgagttcatcaatgtgccggaatggtcctatattgtcgagaaggctaaccccgccaatgatctgtgctaccctggaaactttaatgactatgaggaactcaagcatctgctttctcggatcaaccacttcgagaaaattcagatcattagcaagtcctcttggagcgatcatgaagcctccagcggcgtgtcttccgcttgtccctaccaggggacccctagctttttccgcaatgttgtgtggctgatcaaaaagaacaatacatatcccaccattaaaagatcttacaacaatacaaaccaagaggacctcctgatcctttggggaatccaccactccaacaatgccgctgagcagaccaagctgtatcagaaccctacgacctacattagcgtcggcacatctaccctcaatctgcggctggtgccgaagatcgccacacgctccaaagtgaacggccagagcgggagaatggactttttctggaccattctcaagcccaatgatgcgatcaactttgaatccaatggaaacttcattgcccctgagtacgcttataaaatcgtcaagaaaggcgattctgccatcatgaaaagcgaagttgagtacgggaattgcaacacgaaatgtcaaacacccattggagctatcaattccagcatgccttttcataacattcaccccctgaccatcggcgaatgcccgaagtatgtgaagtctaataaacttgtgctggccacagggctccggaactcccctctgcgcgagagacggcgcaagagaggacttttcggcgcgattgccggctttatcgaagggggatggcagggcatggtcgacgggtggtacggatatcatcacagcaatgaacagggctctgggtacgctgccgacaaagagagcacccagaaggctatcgatggagtgaccaacaaagttaactccattatcgacaagatgaatacacaattcgaagccgtgggccgggagtttaacaatctggaacgcagaattgagaacctcaataagaaaatggaggatggcttcctggacgtctggacgtataacgccgaactgctcgtgctgatggagaatgaacggacccttgatttccacgactctaacgttaagaatctgtacgataaagtgcgcctccagctgagagacaacgctaaggagcttgggaatggatgttttgagttctaccataaatgcgataacgagtgtatggagagcgtccggaatggcacatatgactacccccagtattccgaagaggcgagactgaagcgcgaagagatcagcggggtgaagctcgagtctattggaacctaccaaatcctgtccatttatagcacagtcgcctcttccctggctctcgccatcatggtggccggcctgagcctttggatgtgctccaacgggtctctgcagtgccggatctgtatt

SEQ ID NO: 43659 - RNA, 1701 nt, synthetic construct
  misc_feature 1..1701: note = derived and/or modified sequence opt5 from anti-influenza_Chain
  source 1..1701: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaagctctgtgatctggacggagtgaaaccccttatcctgagagattgcagcgttgcgggctggctcctggggaaccctatgtgtgacgagttcatcaatgtgccggaatggtcctatattgtcgagaaggctaaccccgccaatgatctgtgctaccctggaaactttaatgactatgaggaactcaagcatctgctttctcggatcaaccacttcgagaaaattcagatcattcccaagagctcctggtctgatcatgaagccagctccggcgtgagctctgcttgtccttaccaggggaccccctcctttttccgcaatgttgtgtggctgatcaaaaagaacaatacatatcctaccattaaaagaagctacaacaatacaaaccaagaggacctcctgatcctttggggaatccaccactctaacgatgccgctgagcagaccaagctgtatcagaatccgacgacctacatttccgtcggcacaagcaccctcaaccagcggctggtgcccaagatcgccacacgctctaaagtgaatggccaatccgggagaatggactttttctggaccattctgaagcctaacgatgcgatcaattttgaaagcaacggaaatttcattgcccccgagtacgcttataaaatcgtcaagaaaggcgactccgccatcgttaagtctgaagtggagtacgggaactgcaatacgaaatgtcagacacctattggagctatcaacagctccatgccctttcataatattcacccgctcaccatcggcgaatgccctaagtatgtgaaaagcaacaaactggtccttgccacagggctgcgcaattctcccctccgggagagacggcgcaagagaggactgttcggcgcgattgccggctttatcgaagggggatggcagggcatggtggacgggtggtacggatatcatcactccaacgaacagggcagcgggtacgctgccgataaagagtctacccaaaaggctatcgacggagttaccaataaagtgaacagcattatcgataagatgaacacacagttcgaagccgtcggccgggagtttaataaccttgaacgcagaattgagaatctgaacaagaaaatggaggacggcttcctcgatgtgtggacgtataatgccgaactgctggttctcatggagaacgaacggaccctggacttccacgattccaatgtgaagaacctttacgacaaagtccgcctgcagctcagagataatgctaaggagctggggaacggatgttttgagttctaccataaatgcgacaatgagtgtatggagtctgtgcggaacggcacatatgattaccctcaatatagcgaagaggcgagacttaagcgcgaagagatctccggggtcaagctggagagcattggaacctaccagatcctctctatttattccacagtggccagctctctggctctggccatcatggttgccggcctctccctgtggatgtgcagcaatgggtcccttcagtgccggatctgtatt

SEQ ID NO: 43660 - RNA, 1683 nt, synthetic construct
  misc_feature 1..1683: note = derived and/or modified sequence opt5 from anti-influenza_Chain
  source 1..1683: mol_type = other RNA
gacaagatctgcctgggccaccatgccgtgagcaacgggaccaaagtcaatacactcacggagagaggagttgaagtggtgaacgccaccgagacagtcgaacggaccaatgtgccccgcatttgttccaagggcaaaagaacagttgatctggggcagtgcggacttctgggcaccatcacagggcctccgcaatgtgaccagttcctcgagttttctgccgatctgattatcgaacggcgcgagggaagcgacgtgtgctaccccggcaagttcgtcaacgaggaagcgcttagacagattctgcgggagtccggcgggatcgataaagaaaccatgggatttacgtattctggcatccgcaccaatgggacaaccagcgcttgtagacggtccggatctagcttctacgccgagatgaagtggctcctgtccaacacagacaatgccgcttttcctcagatgaccaagagctataaaaacacgcgcaaggatcccgccctgattatctggggcattcaccattctgggtccacaaccgagcaaacaaaactctacggaagcggcaataagctgatcaccgtggggtcttccaactatcagcagagcttcgttccttctcccggcgctagacctcaggtgaatggacaatccggccggattgactttcactggcttatcctgaacccgaatgataccgtcacattcagctttaacggggccttcattgcgcccgaccgcgcctcctttctcagaggaaaatctatgggcatccagagcgaagtccaggtggatgctaattgcgagggggactgttaccattccggaggcacgatcattagcaacctgcctttccagaacatcaattctcgggccgtgggcaagtgcccccgctatgttaagcaagaatcccttctgctcgctaccgggatgaaaaacgtgcctgagattcccaagagacggagacgcggactgtttggcgccatcgcggggttcattgaaaatggatgggagggcctgatcgatgggtggtacggcttccggcaccagaacgcccagggagagggcacagctgccgactacaaaagcacccaatctgctatcgaccagattacagggaagctcaatagactgatcgaaaagaccaaccagcagtttgagcttattgataatgagttcacggaagtggaacgccaaatcggaaacgtcattaattggacacgggacagcatgaccgaggtgtggtcctataacgccgagctgctcgttgccatggaaaatcagcacaccatcgatctggctgactctgagatgaacaaactttacgaaagagtgaaacgccagctgcgggagaatgcggaagaggatggcacagggtgttttgagatcttccataagtgcgacgatgactgtatggccagcattagaaacaatacctatgatcactccaagtaccgcgaagaggctatccagaaccggattcaaatcgacccggtcaaactcagctctggatataaggattccggcagactggtgcctcgcgggagccccggctctggatacattcctgaagctccccgggacggccaggcctatgttagaaaagacggggagtgggtgctgctctccacatttctgggaaagcccatccctaacccgcttctgggcctcgatagcacgggg

SEQ ID NO: 43661 - RNA, 1701 nt, synthetic construct
  misc_feature 1..1701: note = derived and/or modified sequence opt5 from anti-influenza_Chain
  source 1..1701: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggagaaaacacacaatgggaagctctgtgatctggacggagtgaaaccccttatcctgagagattgcagcgttgcgggctggctcctggggaaccctatgtgtgacgagttcatcaatgtgccggaatggtcctatattgtcgagaaggctaaccccgccaatgatctgtgctaccctggaaactttaatgactatgaggaactcaagcatctgctttctcggatcaaccacttcgagaaaattcagatcattcccaagagctcctggtctgatcatgaagccagctccggcgtgagctctgcttgtccttaccaggggaccccctcctttttccgcaatgttgtgtggctgatcaaaaagaacaatacatatcctaccattaaaagaagctacaacaatacaaaccaagaggacctcctgatcctttggggaatccaccactctaacgatgccgctgagcagaccaagctgtatcagaatccgacgacctacatttccgtcggcacaagcaccctcaaccagcggctggtgcccaagatcgccacacgctctaaagtgaatggccaaaacgggagaatggactttttctggaccattctgaagcctaatgatgcgatcaactttgaatccaatggaaacttcattgcccccgagtacgcttataaaatcgtcaagaaaggcgacagcgccatcgttaagtccgaagtggagtacgggaattgcaacacgaaatgtcagacacctattggagctatcaattctagcatgccctttcataacattcacccgctcaccatcggcgaatgccctaagtatgtgaagtccaataaactggtccttgccacagggctgcggaacagccccctccgcgagagacggcgcaagagaggactgttcggcgcgattgccggctttatcgaagggggatggcagggcatggtggacgggtggtacggatatcatcactctaatgaacagggctccgggtacgctgccgataaagagagcacccaaaaggctatcgacggagttaccaacaaagtgaactctattatcgataagatgaatacacagttcgaagccgtcggccgggagtttaacaatcttgaacgcagaattgagaacctgaataagaaaatggaggacggcttcctcgatgtgtggacgtataacgccgaactgctggttctcatggagaatgaacggaccctggacttccacgatagcaacgtgaagaatctttacgacaaagtccgcctgcagctcagagataacgctaaggagctggggaatggatgttttgagttctaccataaatgcgacaacgaatgtatggagtccgtgcggaatggcacatatgattaccctcaatattctgaagaggcgagacttaagcgcgaagagatcagcggggtcaagctggagtccattggaacctaccagatcctcagcatttattctacagtggcctccagcctggctctggccatcatggttgccggcctctctctgtggatgtgctccaacgggagccttcagtgccggatctgtatt

SEQ ID NO: 43662 - RNA, 1683 nt, synthetic construct; identical to SEQ ID NO: 43660
  misc_feature 1..1683: note = derived and/or modified sequence opt5 from anti-influenza_Chain
  source 1..1683: mol_type = other RNA

SEQ ID NO: 43663 - RNA, 1683 nt, synthetic construct; identical to SEQ ID NO: 43656
  misc_feature 1..1683: note = derived and/or modified sequence opt5 from anti-influenza_Chain
  source 1..1683: mol_type = other RNA

SEQ ID NO: 43664 - RNA, 1683 nt, synthetic construct; identical to SEQ ID NO: 43657
  misc_feature 1..1683: note = derived and/or modified sequence opt5 from anti-influenza_Chain
  source 1..1683: mol_type = other RNA

SEQ ID NO: 43665 - RNA, 1701 nt, synthetic construct; identical to SEQ ID NO: 43661
  misc_feature 1..1701: note = derived and/or modified sequence opt5 from anti-influenza_Chain
  source 1..1701: mol_type = other RNA

SEQ ID NO: 43666 - RNA, 1701 nt, synthetic construct; identical to SEQ ID NO: 43658
  misc_feature 1..1701: note = derived and/or modified sequence opt5 from anti-influenza_Chain
  source 1..1701: mol_type = other RNA

SEQ ID NO: 43667 - RNA, 1701 nt, synthetic construct; identical to SEQ ID NO: 43659
  misc_feature 1..1701: note = derived and/or modified sequence opt5 from anti-influenza_Chain
  source 1..1701: mol_type = other RNA

SEQ ID NO: 43668 - RNA, 1704 nt, synthetic construct
  misc_feature 1..1704: note = derived and/or modified sequence opt5 from anti-influenza_Chain
  source 1..1704: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaaactctgtgatctggacggagtgaaaccccttatcctgagagattgcagcgttgcgggctggctcctggggaaccctatgtgtgacgagttcctgaatgtgccggaatggtcctatatcgtcgagaagattaaccccgctaatgatctctgctaccctggagactttaacgattatgaggaactgaagcatcttctgtctcggatcaatcacttcgagaaaattcagatcattcccaagagctcctggtctgactacgaagccagctccggcgtgagctctgcctgtccttatcaggggcgctccagctttttcagaaacgttgtgtggctcatcaaaaagaataacgcttaccccaccattaaacggtcttataataacacaaatcaagaggatctgcttgtcctgtggggaatccatcaccctaacgacgccgctgagcagatccgcctctaccagaacccgaccacatacatttccatcggcaccagcacgctgaatcagagactggtgcccaagattgccacccggtctaaggtgaacggccaatccgggcgcatggaatttttctggacaatcctcaaaagcaatgatgcgattaactttgagtccaatggaaacttcatcgcccctgaatatgcttacaagatcgtcaaaaagggcgactctaccattatgaaaagcgagctggaatatgggaattgcaacacaaagtgtcagacccccatcggagccattaattccagcatgccttttcacaacatccatccccttacgattggcgagtgcccgaaatacgttaagtctaatagactggtgctcgctacagggctgcggaactcccctcagggagagcgcagacggcgcaagagaggccttttcggcgccatcgcggggtttatcgaaggaggctggcaggggatggtggacggatggtatggctaccaccatagcaatgagcaagggtctggatatgccgctgataaagaaagcacccagaaggccattgacggcgtcacaaacaaagttaattccatcattaacaagatgaacacccagttcgaggctgtgggccgggaatttaataacctggagcgcagaatcgagaatctcaacaaaaagatggaagatgggttcctggacgtgtggacctacaatgccgagctgctcgtcctgatggaaaacgagcggacacttgatttccacgactctaatgtgaagaacctgtacgataaagttagactccaactgcgcgacaatgccaaggaacttggaaacggctgttttgagttctatcaccggtgcgataatgagtgtatggaaagcgtgagaaacgggacgtacgactatccccagtactccgaggaagctcgcctgaaacgggaggagattagcggagtcaagctcgaatctatgggcatctatcagattctgtccatctacagcaccgtggcgtcttccctggccctcgctatcatggtcgccgggctgtttctttggatgtgcagcaatggctccctgcagtgcagaatttgtatc

SEQ ID NO: 43669 - RNA, 1704 nt, synthetic construct
  misc_feature 1..1704: note = derived and/or modified sequence opt5 from anti-influenza_Chain
  source 1..1704: mol_type = other RNA
atggagaagatcgtgctgctcctggccattgtcagccttgttaaatccgaccagatctgcattggctaccacgctaacaattctaccgaacaagtggatacaatcatggagaagaacgtgacggtcacccatgcccaggacattctggaaaagacacacaatgggaaactctgtgatctggacggagtgaaaccccttatcctgagagattgcagcgttgcgggctggctcctggggaaccctatgtgtgacgagttcatcaatgtgccggaatggtcctatattgtcgagaaggctaaccccaccaatgatctgtgctaccctggatcttttaacgactatgaggaactcaagcatctgcttagccggatcaatcacttcgagaaaattcagatcattcccaagtcctcttggagcgatcatgaagcctccagcggcgtgtcttccgcctgtccttacctggggagcccctcctttttccgcaacgttgtgtggctcatcaaaaagaactctacatatcctaccattaaaaagagctacaataatacaaaccaggaggacctgcttgtcctgtggggaatccaccacccgaatgatgctgccgagcaaaccagactctatcagaaccccacgacctacatctctattggcacatccaccctgaaccagcggctggtgcctaagatcgctacacgcagcaaagtgaatggccagtccgggagaatggaatttttctggaccattctcaagcccaacgacgccatcaattttgagtctaacggaaatttcattgcgcctgaatacgcctataaaatcgtcaagaaaggcgatagcgctatcatgaagtccgagctggaatacgggaactgcaatacgaaatgtcaaacacccatgggagccattaacagctctatgccgtttcataatatccaccctcttaccattggcgagtgccccaagtatgttaagtccaaccggctggtgctcgctacagggctgcgcaatagccctcagagagagtctcggcgcaaaaagagaggacttttcggcgccatcgcgggctttattgaagggggatggcagggcatggtggacgggtggtacggatatcatcacagcaacgagcagggctccgggtacgccgctgacaaagaatctacccaaaaggccatcgatggagtcaccaataaagtgaacagcatcattgacaagatgaatacacagttcgaggctgttggccgggaatttaacaacctggagcgcagaatcgagaatctcaacaagaaaatggaagatggcttcctggacgtgtggacgtataatgccgagctgctcgtcctgatggaaaacgagcggacccttgatttccacgactccaatgtgaagaacctgtacgataaagttcgcctccagctgagagacaatgccaaggaacttgggaacggatgttttgagttctaccataaatgcgataatgagtgtatggaaagcattcggaacggcacatataattacccccaatattctgaggaagctagactgaagcgcgaggagatctccggggtgaagctcgaaagcattggaacctaccagatcctgtctatttattccacagtcgcgagctccctggccctcgctatcatgatggccggcctgtctctttggatgtgcagcaacgggtccctgcagtgccggatctgtatt

SEQ ID NO: 43670 - RNA, 1704 nt, synthetic construct
  misc_feature 1..1704: note = derived and/or modified sequence opt5 from anti-influenza_Chain
  source 1..1704: mol_type = other RNA
atggagaagatcgtgctcctgttcgccattgtcagcctggttaaatccgaccagatctgcattggctaccacgctaacaattctaccgaacaagtggatacaatcatggagaagaacgtgacggtcacccatgcccaggacattcttgaaaagacacacaatgggaagctgtgtgatctcgacggagtgaaacccctgatccttagagattgcagcgttgcgggctggctgctcgggaaccctatgtgtgacgagtttatcaatgtgccggaatggtcctatattgtcgagaaggctaaccccgtgaatgatctgtgctaccctggagacttcaacgattatgaggaactgaagcatctcctgtctcggatcaatcactttgagaaaattcagatcattcccaagagctcctggtctagccatgaagcctcccttggcgttagctctgcctgtccttaccaggggaaatccagcttctttcgcaacgtggtctggctgatcaagaaaaattctacctatcccacaattaagagatcctacaacaataccaaccaagaggacctcctggtgctttggggaatccaccaccctaatgatgctgccgagcagacaaagctgtatcagaacccgaccacgtacatcagcgtgggcacctctacactcaaccagcggctggtcccccgcattgctaccagatccaaagttaatggccaaagcgggcggatggagttcttttggacaatcctgaagcctaacgacgccattaatttcgaatccaacggaaattttatcgcgcccgaatacgcctataaaattgtgaagaaaggcgattctaccatcatgaaaagcgagctcgaatacgggaactgcaatacgaaatgtcagacacctatgggagctatcaactccagcatgcccttccataatattcacccgctgaccatcggcgagtgccctaagtatgtgaagtctaaccgccttgtcctggccacagggctcagaaatagcccccagcgggagcgcagacggaaaaagcgcggactgtttggcgctattgccggcttcatcgaagggggatggcagggcatggtggacgggtggtacggatatcatcactccaacgagcaaggctctgggtacgcggccgacaaagaaagcacccagaaggctattgatggagttaccaataaagtgaactccatcatcgacaagatgaatacacagtttgaggccgtcggcagagagttcaacaaccttgaacggcgcattgagaatctgaacaagaaaatggaagatggcttcctcgacgtgtggacgtataatgctgagctgctggttctcatggaaaacgagagaaccctggattttcacgactctaatgtgaagaacctttacgataaagtccggctgcaactcagagacaatgccaaggaactggggaacggatgtttcgagttttaccataaatgcgataatgagtgtatggaaagcgtgcgcaacggcacatatgactaccctcagtattccgaggaagcccggcttaagagagaggagatcagcggggtcaagctggaatctattggaatctaccagattctctccatctatagcaccgtggcttcttccctggcgctggccattatggttgctggcctcagcctgtggatgtgctccaatgggtctcttcagtgccgcatctgtatc

SEQ ID NO: 43671 - RNA, 1704 nt, synthetic construct; identical to SEQ ID NO: 43668
  misc_feature 1..1704: note = derived and/or modified sequence opt5 from anti-influenza_Chain
  source 1..1704: mol_type = other RNA

SEQ ID NO: 43672 - RNA, 1704 nt, synthetic construct; identical to SEQ ID NO: 43669
  misc_feature 1..1704: note = derived and/or modified sequence opt5 from anti-influenza_Chain
  source 1..1704: mol_type = other RNA

SEQ ID NO: 43673 - RNA, 1704 nt, synthetic construct; identical to SEQ ID NO: 43670
  misc_feature 1..1704: note = derived and/or modified sequence opt5 from anti-influenza_Chain
  source 1..1704: mol_type = other RNA

SEQ ID NO: 43674 - RNA, 1707 nt, synthetic construct
  misc_feature 1..1707: note = derived and/or modified sequence opt5 from anti-influenza_Chain
  source 1..1707: mol_type = other RNA
agcaagtccagaggctacaaaatgaacacccagatcctggtgttcgccctcgtcgcttctattcccacaaatgccgacaagatctgcctggggcaccatgcggttagcaacggaacgaaagtgaatacccttacagagcggggcgtggaagtcgtgaacgctaccgagacagttgaacgcaccaatgtgcctagaatttgttccaaggggaaacggacagtcgatctgggacaatgcggcctcctggggaccatcacgggaccgccccagtgtgaccagtttcttgagttctctgccgatctgattatcgaacgcagagagggcagcgacgtgtgctatcctggcaagtttgttaacgaggaagccctccggcagatcctgcgcgagtccgggggaattgataaggaaaccatgggcttcacatactctgggatcagaaccaatggaacaaccagcgcttgtcggcgctccggcagctctttttatgccgagatgaaatggctgctctccaacacggacaatgctgccttcccccaaatgacaaagagctacaaaaacaccagaaaggatcctgcgctgattatctgggggattcaccattctggatccacaaccgagcagaccaaactttatggcagcggcaataagctgatcacagtggggtcttccaactaccagcagagctttgtcccctcccctggagcccggccgcaagtgaatggccagtctgggcgcattgacttccactggctcatcctgaaccccaatgatacggtgacctttagcttcaacggagcttttatcgcccctgacagagcttccttccttcggggcaagagcatggggattcagtctgaagtccaggttgatgccaactgcgagggagactgttatcattccggcggcacaatcattagcaatctgccctttcaaaacatcaattctcgcgcggtggggaaatgccctagatacgtgaagcaggaaagcctcctgctggccaccggaatgaaaaacgtccccgagattccgaagcggagacgccggggcctcttcggggctatcgccggattcatcgaaaatggctgggaggggctgattgatggctggtacggatttagacaccagaacgctcaaggcgaggggacagccgccgactataaatccacccagtctgctatcgaccagattacgggaaaacttaatcgcctgatcgaaaagacaaaccagcaattcgagctcattgataatgaatttaccgaggtggaacggcagatcggcaacgttatcaattggaccagagacagcatgacagaggtgtggtcctacaacgcggagctgcttgtcgccatggaaaatcagcacaccattgatctggctgacagcgagatgaacaagctctatgaacgcgtgaagcggcagctgagagagaatgccgaagaggatgggacaggatgtttcgagatctttcataaatgcgacgatgactgtatggcctctattcgcaacaacacgtacgatcactccaagtatcgggaagaggctatccaaaatcgcattcagatcgaccctgttaaactgagctctggctacaaggatgtgattctctggttctcctttggggccagctgcttcatcctgcttgcgatcgctatgggcctggtctttatttgcgtgaaaaacggaaatatgagatgtaccatctgcatt

SEQ ID NO: 43675 - RNA, 1707 nt, synthetic construct; identical to SEQ ID NO: 43674
  misc_feature 1..1707: note = derived and/or modified sequence opt5 from anti-influenza_Chain
  source 1..1707: mol_type = other RNA

SEQ ID NO: 43676 - RNA, 1692 nt, synthetic construct
  misc_feature 1..1692: note = derived and/or modified sequence opt5 from anti-influenza_Chain
  source 1..1692: mol_type = other RNA
gaccagatctgcattggctaccacgccaacaatagcaccgagaaggtggatacaaacctggaaagaaatgtcacggttacccatgctaaagacatcctcgagaagacacacaacgggaaactgtgtaaacttaatgggattccccctctggaactcggcgattgctccatcgccgggtggctgcttggaaacccggagtgtgaccggctgctctctgtgcccgaatggagctatattatggagaaggagaatcctcgcgatggcctgtgctaccccgggtccttcaacgactatgaggagctgaagcatctcctgtctagcgtgaagcactttgaaaaagtcaagatccttcctaaagatagatggacccaacatacaaccacaggaggctcccgggcgtgtgctgtgtctggcaatcccagcttctttcgcaacatggtttggctgaccaaggaggggtccgactaccctgtggccaaaggaagctataataacacgtctggcgagcagatgctcatcatttggggagtccaccacccgatcgatgaaaccgagcagagaacactgtaccagaatgtgggaacctatgtttccgtgggcacaagcacccttaacaagcggtctacgcccgaaattgccacacgccctaaggtcaatgggcaaggaggcagaatggagttctcctggaccctgctcgacatgtgggatacaatcaactttgaaagcaccggcaacctgattgctcccgagtacgggttcaaaatctctaagcggggatccagcggcattatgaaaaccgaggggacactggaaaattgcgagacgaagtgtcagacccctctcggagccatcaacacaaccctgccctttcataatgtgcacccgcttacaatcggcgaatgccctaaatacgtgaagtccgagaaactggtcctcgctaccgggctgcgcaacgttccccagattgaatctagaggacttttcggcgccatcgcgggctttattgaagggggatggcagggcatggtggacgggtggtatggataccatcacagcaatgatcaaggctccgggtatgccgctgacaaggagagcacgcagaaggccttcgacggcatcacaaacaaagtcaattctgtgattgaaaagatgaacacccagtttgaggctgtgggaaaagagttcggcaatctggaacggcgcctcgaaaacctgaataagagaatggaggatgggtttctggacgtttggacctacaacgccgagctcctggtgcttatggaaaatgagcggacactggatttccacgactccaacgtcaaaaatctctatgataaggtgcgcatgcagctgagagacaacgttaaggaacttggaaacggctgtttcgagttttaccataaatgcgatgacgagtgtatgaatagcgtgaagaacgggacctatgattaccctaaatacgaagaggaatctaagctgaatcggaacgagatcaaaggagtcaagctcagctccatgggcgtgtatcaatctgggagactggtcccccgcggcagccccggatccggctacatccctgaagcgccgcgggacgggcaggcctatgtgagaaaggatggagagtgggttctgctcagcacattcctgggcaaacccattcctaatccccttctggggctcgactctacggga

SEQ ID NO: 43677 - RNA, 1692 nt, synthetic construct
  misc_feature 1..1692: note = derived and/or modified sequence opt5 from anti-influenza_Chain
  source 1..1692: mol_type = other RNA
cagaagctgcccggcaacgacaatagcaccgccacactctgcctggggcaccatgctgtgcctaacggaacgatcgtcaaaaccattacaaatgatcaaatcgaggttaccaacgccacagaacttgtgcagtcctctagcaccggcgggatttgtgactccccgcaccagatcctggatggagagaattgcacactcattgacgcgctgcttggcgatccccagtgtgacgggttccaaaacaagaaatgggatctgtttgtggaaagatctaaggcttacagcaattgctatccttacgacgtccccgattatgcctccctccggtctctggtggccagctccggaaccctggagttcaacgacgagagctttaattggacgggcgttacccagaacggcacatcttccagctgtaaacgcagatctaataactccttctttagccggctcaattggctgacccagcttaagttcaagtaccctgctctgaacgtgacaatgcccaataacgaaaaatttgataagctctatatctggggagtccatcaccctgtgaccgacaacgatcagatcttcctgtacgcccaggcttctgggcgcattacggtttccacaaaaagaagccagcagaccgtgatcccgaatattggctcccggccccgcatcagaaacattccttctcggatcagcatttattggacaatcgtcaagcccggggacatccttctgattaattccaccggaaacctcatcgcccctcgcggctactttaaaattagaagcgggaagtcttccatcatgcggagcgacgcgcccattggaaagtgcaattctgagtgtatcaccccgaacggcagcatccctaatgataaacccttccagaacgtgaatcgcattacatacggcgcctgccctagatatgtgaagcaaaacacgctgaaactggctaccgggatgcggaatgtccccgaaaagcagacacgcggaatctttggcgccattgctgggttcatcgagaacggatgggaaggcatggttgacgggtggtacggatttagacatcaaaattccgagggcattggccaagccgcggatctcaaatctacccaggccgctatcaaccagatcaatgggaagctgaaccggcttattggaaaaacaaacgagaagttccaccagatcgaaaaggagttcagcgaagtggagggccgcattcaagacctggaaaaatatgtggaggataccaagatcgacctctggtcctacaatgccgagctgcttgtcgctctggaaaaccagcacacgattgatctcacagacagcgagatgaataaactgtttgaaagaaccaagaaacagctgcgggagaacgccgaagatatggggaatggatgtttcaagatctatcataagtgcgacaacgcctgtattggctctatcagaaatgggacctacgatcacgacgtgtatcgcgacgaggctctcaacaatcggtttcagatcaaaggcgttgagctgaagtccggaagcggcagacttgtgccccgcgggtctcctggatccggctacattccggaagcgccccgggatgggcaagcctacgtcagaaaagacggagagtgggtgctgctcagcacattcctgggcaagcctatccccaaccctcttctggggctcgattccaccggc

SEQ ID NO: 43678 - RNA, 1692 nt, synthetic construct; identical to SEQ ID NO: 43676
  misc_feature 1..1692: note = derived and/or modified sequence opt5 from anti-influenza_Chain
  source 1..1692: mol_type = other RNA

SEQ ID NO: 43679 - RNA, 1692 nt, synthetic construct; identical to SEQ ID NO: 43677
  misc_feature 1..1692: note = derived and/or modified sequence opt5 from anti-influenza_Chain
  source 1..1692: mol_type = other RNA

SEQ ID NO: 43680 - RNA, 1695 nt, synthetic construct
  misc_feature 1..1695: note = derived and/or modified sequence opt5 from anti-influenza_Chain
  source 1..1695: mol_type = other RNA
gacaccatctgcattggctaccacgccaacaatagcacagatacggtggacaccgtcctggagaagaacgttacagtgacccattccgtgaatctcctggaagattctcacaacgggaaactttgtctgctcaagggaatcgctcccctgcagcttggcaattgcagcgtcgccgggtggattctgggaaaccctgagtgtgaactcctgatctccagagagtcttggagctatattgtggaaaaaccgaatcccgagaacggcacatgctaccctgggcatttcgcggactatgaggaactgcgggagcaactctcctctgttagctcctttgaacgcttcgagatctttcccaaggagagctcttggcctaatcacaccacaaccggagtgtccgctagctgttctcataacggcgaatccagcttctacaaaaatctgctttggctgacgggcaagaacgggctctatcccaatctgtctaagtcctacgccaacaataaagagaaggaagtccttgtgctgtggggagttcaccaccctccgaacatcggcgatcagagagccctctatcataaagagaacgcttacgtgagcgtcgtgtcctctcactacagccggaagtttacccccgaaattgccaaacgccctaaggtgagagaccaggaggggcggatcaattattactggacactgctggagcccggagataccattatcttcgaagctaacggcaatctcattgcccctcgctatgcgtttgccctgtccagagggttcggaagcggcatcattaactctaatgctcccatggacgagtgcgatgccaagtgtcagacaccgcaaggcgctatcaactccagccttccttttcagaatgtccatcccgttaccatcggggaatgccctaaatacgtgcggtctgccaagctgcgcatggtgacgggactcagaaacattcccagcatccagtcccggggcctgttcggggcgattgccggatttatcgagggcgggtggacaggaatggtcgacggctggtatggctaccaccaccagaatgaacaagggtctggatatgctgccgatcagaaaagcacccagaacgctattaatggcatcacaaacaaggttaattccgtgatcgagaaaatgaacacccagttcaccgccgtggggaaggagtttaataaacttgaacgcagaatggagaacctgaacaagaaggtcgacgatggattcattgacatctggacatacaatgccgaactcctggtgctgctcgagaacgaacggacgctggacttccatgatagcaatgttaaaaacctttacgagaaggtgaaatctcaactgaagaataacgctaaagagattggcaatgggtgttttgagttctatcacaagtgcaacgacgaatgtatggaatccgtcaagaatggcacctacgattatcccaaatacagcgaggagtctaagctcaaccgcgagaaaatcgacggagtgaagctggaatccatgggcgtctatcagagcgggagacttgtgcctcggggatccccgggctctgggtacattcccgaagcgcctagagatggacaggcctatgttcgcaaagacggcgagtgggtgctgctcagcacatttctggggaagcccatccctaatcccctgctcggcctggattccaccgga

SEQ ID NO: 43681 - RNA, 1695 nt, synthetic construct
  misc_feature 1..1695: note = derived and/or modified sequence opt5 from anti-influenza_Chain
  source 1..1695: mol_type = other RNA
caaaactacaccggcaatcccgtgatctgcctggggcaccatgccgtcagcaacggaacaatggttaagacgctcaccgacgatcaaattgaggtggtgacagctcaggaactggtcgagtcccagcaccttcctgaactgtgtccgtctcccctcagactggtggacggccagacctgcgatatcgttaatggggcccttggaagccctggctgtgaccatctgaacggggcggagtgggatgtgttcattgaacggcccacagctgtcgatacctgctatccttttgatgtgcccgactaccaatccctccgctctatcctggccaataacggaaaattcgagtttattgccgaggagttccagtggaatacagttaagcagaacggcaaaagcggcgcttgtaagagagccaatgtgaacgactttttcaatcggctgaactggctcaccaaatccgacgggaatgcttatcctctgcagaaccttacgaaggtcaataacggagattacgcccgcctgtatatctggggcgtgcaccatccgtctaccgacacagaacaaaccaacctctacaagaataaccccgggagagtgacagtcagcacccagacgtcccagacaagcgttgtgcctaatatcggatctcggccctgggtgcgcggcctgtccagcagaatttctttttattggaccatcgtcgaacctggggatcttattgtgttcaacacaatcggaaatctgattgcgccccggggccactacaaactcaactcccagaagaaaagcaccatcctgaataccgccgttccgattggctcttgcgtgtccaagtgtcacacagacaaagggagcatctccacgaccaagccttttcaaaacatctctcgcattagcatcggagactgccccaagtacgtcaaacagggctccctgaagctcgctacagggatgagaagcattctggagaaagccacccggggacttttcggcgctatcgccgggtttattgagaatggatggcagggcctgatcgatggctggtatgggttccgccatcaaaacgcggaaggaacaggcaccgccgctgacctcaagtctacgcaggccgctatcgatcagattaatgggaaactgaacagacttatcggaaagcctaatgagaaataccaccagattgaaaaggagtttgaacaagtggagggccggatccaggacctggagaagtatgttgaagatacaaaaattgacctctggtcctacaacgccgagctgctggtggccctcgaaaatcagcataccatcgatgtcaccgacagcgagatgaacaagctgttcgaacgcgtgagacaccagcttcgggagaacgctgaggataaagggaatggctgtttcgaaatctttcaccaatgcgacaactcttgtattgagagcatcagaaatggaacatatgatcatgacatttaccgcgacgaagcgatcaacaatcggttccagattcagggcgtcaagctgatccaggggtataaagattccggaagactcgtgccccgcggctctcccgggagcggatacattcctgaggccccgcgggacggccaggcttacgttagaaaggatggggaatgggtgctgctttccacctttctgggcaagcccatccctaaccccctcctgggactggacagcacaggc

SEQ ID NO: 43682 - RNA, 1695 nt, synthetic construct
  misc_feature 1..1695: note = derived and/or modified sequence opt5 from anti-influenza_Chain
  source 1..1695: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtaacctggatggagtgaaaccccttatcctgaaggactgctccgtggccggctggctcctggggaatcctatgtgtgatgagttccttaacgtctctgaatggagctatattgtggaaaaagcgtccccggctaatggactgtgctaccccggcgactttaacgattatgaggagctcaagcatctgctgtctagaatcaatcacctcaagaaaatcaagattatccctaaaagctactggtccaaccatgaagcctctagcggggtttccgccgcttgtagctatctgggagagccctctttctttcggaatgtggtctggcttattaagaaaaacaatacctaccctcccatcaaggtgaactatacaaataccaaccaggaagacctgctcgttctgtggggcattcaccaccctaacgatgagaaggagcagatccgcatttaccaaaatccgaacacatccatcagcgtgggcacctctacgcttaatcagagactggtccccaaaatcgccacccggcctaaggtgaacgggcagtccggacgcatggagttcttttggacaattctcaaacccaatgacagcatcaacttcgattctaatggcaactttattgctcctgaatacgcctataagatcgcgaaaaagggggactccgtgattatgaaaagcgaactggagtacggaaattgcaacaccaagtgtcagacacccatgggcgccatcaattcctctatgccgttccataacatccaccctctgaccattggggaatgccccaagtatgtcaaaagcaatagactcgttctggctacgggacttcggaacgcccctcaaacagagacccgcggcctgtttggcgctatcgccgggttcattgagggaggctggcaggggatggtggatggatggtacggctatcatcactccaatgaacaggggagcggatacgcggccgacaaggagtctacacagaaagctatcgacggcattaccaacaaggtgaactccatcatcgataaaatgaatacccaatttgaaattgtcggcagagagttcaacaatctcgaacggcgcatcgagaacctgaataagaagatggaggacgggtttcttgatgtgtggacatataacgccgaactgctcgttctgatggagaatgaaagaacgctggacttccacgatagcaacgtgaaaaatctctacgagaaggtccggctgcagcttcgcgacaacgctaaagaactgggaaatggctgtttcgagttttaccataagtgcgataacgagtgtatggaatctgtgagaaatgggacctatgactacccccagtatagcgaggaagcccggctctcccgcgaggagatttctggagttaaaatggaaagcatggtgacataccaatccggcagactggtcccccgggggagccctggctctggatatatcccggaggcccccagagatggccaggcttacgtgcgcaaggacggggaatgggtccttctgtccaccttcctcggaaagcctattcccaaccctctgctgggcctcgatagcacaggg

SEQ ID NO: 43683 - RNA, 1695 nt, synthetic construct; identical to SEQ ID NO: 43680
  misc_feature 1..1695: note = derived and/or modified sequence opt5 from anti-influenza_Chain
  source 1..1695: mol_type = other RNA

SEQ ID NO: 43684 - RNA, 1695 nt, synthetic construct; identical to SEQ ID NO: 43681
  misc_feature 1..1695: note = derived and/or modified sequence opt5 from anti-influenza_Chain
  source 1..1695: mol_type = other RNA

SEQ ID NO: 43685 - RNA, 1695 nt, synthetic construct; identical to SEQ ID NO: 43682
  misc_feature 1..1695: note = derived and/or modified sequence opt5 from anti-influenza_Chain
  source 1..1695: mol_type = other RNA

SEQ ID NO: 43686 - RNA, 1698 nt, synthetic construct
  misc_feature 1..1698: note = derived and/or modified sequence opt5 from anti-influenza_Chain
  source 1..1698: mol_type = other RNA
gacaccctgtgcatcggctaccacgccaacaatagcacagatacggtggacaccgtcctcgagaagaacgttacagtgacccattccgtgaatctgcttgaagataaacacaacgggaagctgtgtaaactcagaggagtcgctcccctgcatcttggcaagtgcaatattgccgggtggatcctgggaaaccctgagtgtgaatctctcagcacagcgtcctcttggagctatattgtggagaccccgtcctctgacaatggcacatgctaccccggggatttcatcgactatgaggaactgcgggagcagctgagctccgttagctcttttgaacgcttcgagatttttcctaaaacctccagctggcccaaccacgattctaataagggagtgacggctgcctgtcctcatgccggcgctaagtccttctacaaaaacctcatctggctggtcaagaaaggcaatagctatcccaaactttctaagtcctacatcaacgacaaggggaaggaagtgctggttctctggggcattcaccaccctagcacctccgccgatcaacagtctctgtatcagaatgctgacacatacgtgtttgtcggaagctccagatacagcaaaaagttcaaaccggagatcgccattcggcccaaggtgcgcgatcaggaggggagaatgaactattactggacccttgtggaacctggagacaaaatcacatttgaggcgaccggcaatctggtcgttccccggtatgccttcgctatggaacgcaacgccgggtctggaattatcatttccgatacgcctgtgcatgactgcaacacaacctgtcaaacacccaagggcgctatcaataccagcctcccgtttcagaacatccaccctattaccatcggcaaatgccccaagtacgtgaagtctacaaaactgagactggccacggggctccggaatattcctagcatccagtcccgcggactgttcggcgcgattgccgggtttatcgagggaggctggaccgggatggtcgacggatggtatggctaccatcaccagaacgaacaaggctctgggtatgctgccgatcttaagagcacacagaatgctatcgacgagattaccaacaaagttaattccgtgatcgagaagatgaacacacagttcaccgccgtgggaaaagaatttaatcacctggagaagagaattgaaaacctcaataagaaagtcgatgacggcttcctggatatctggacgtacaacgccgagcttctggtgctcctggaaaatgagcggacactggactaccatgatagcaacgttaagaatctctatgagaaagtgcgctctcagctgaagaacaacgctaaagaaattgggaatggatgtttcgagttttaccacaagtgcgacaacacctgtatggaatccgtcaagaatggcacctatgattaccccaaatatagcgaggaagcgaaacttaacagagaggagatcgacggggtgaagctggaatctacacggatctaccaatccggccgcctcgtccccagaggaagccctggctccgggtatattccggaggctccccgggatggacaggcctacgtgagaaaggacggcgaatgggttctgctttctaccttcctggggaaacctatccccaatcctctcctgggactggacagcacaggc

SEQ ID NO: 43687 - RNA, 1698 nt, synthetic construct
  misc_feature 1..1698: note = derived and/or modified sequence opt5 from anti-influenza_Chain
  source 1..1698: mol_type = other RNA
gacagaatctgcattggctaccaaagcaacaattccaccgatacagtgaacacgctgatcgagcaaaaggtccccgttacccagacaatggaactcgtggagaccgaaaaacaccctgcctattgtaatacagacctgggggctccgcttgagctgcgggattgcaagattgaagccgtgatctacggaaaccccaaatgtgacattcatctcaaggatcagggctggtcttatatcgtcgagcgccctagcgcgcccgaggggatgtgctaccctggatccgtggaaaatctggaggaacttagattcgtgttttctagcgctgcctcctataaacggatccgcctgttcgactactctagatggaacgttaccagctccggcacaagcaaggcctgtaatgcttctaccgggggacagtccttttatcggagcattaactggctcacgaagaaaaagcccgatacctacgacttcaatgagggcacatacgtcaacaatgaggatggcgacatcatttttctgtgggggatccaccatcctccggataccaaagaacaaacaaccctgtataagaacgccaatacgctctcttccgtgacaaccaacacaattaatcgcagcttccagcccaacatcggacctagacccctggttcggggccagcaggggcgcatggactactattggggcattcttaaaagaggagagaccctgaagatccggaccaacgggaatctcatcgctcctgaatttggatacctgcttaagggcgagtctcacggccgcacaattcaaaacgaagatatccccattgggaattgctatacgaaatgtcagacctacgccggagcgatcaactccagcaagccgttccagaatgcctccagacattatatgggcgagtgccctaaatacgtgaagaaggcttctctgcggctcgccgtcgggctgcgcaacacacccagcgtggagcctagaggactgtttggcgctattgccgggttcatcgaaggaggctggtccggcatgatcgacgggtggtacggatttcaccacagcaattctgagggcaccgggatggcggccgaccagaaatccacacaagaagctattgataaaatcaccaacaaggtgaataacattgtcgacaagatgaatcgggagttcgaagttgtgaaccatgagtttagcgaggtggagaaaagaatcaatatgattaacgataagatcgacgatcagatcgaagacctctgggcctataatgctgaactgcttgtcctgctcgagaaccagaaaacgctggatgaacacgactctaacgtgaagaatcttttcgatgaggttaaacgccggctgagcgccaacgccattgacgctggaaatggctgtttcgatatcctccataagtgcgacaacgagtgtatggaaacaattaagaatgggacctacgaccacaaagagtatgaagaggaggcgaagctggaaagatccaaaatcaacggcgtgaagctggaggaaaataccacatacaaatctggacgcctcgtcccccggggcagccccgggtccggatatattcctgaggccccgagagatggccaggcttacgtgcgcaaggacggggaatgggttctgcttagcacctttctgggaaagcccatccctaaccccctcctgggccttgattctacaggg

SEQ ID NO: 43688 - RNA, 1698 nt, synthetic construct; identical to SEQ ID NO: 43686
  misc_feature 1..1698: note = derived and/or modified sequence opt5 from anti-influenza_Chain
  source 1..1698: mol_type = other RNA

SEQ ID NO: 43689 - RNA, 1698 nt, synthetic construct; identical to SEQ ID NO: 43687
  misc_feature 1..1698: note = derived and/or modified sequence opt5 from anti-influenza_Chain
  source 1..1698: mol_type = other RNA

SEQ ID NO: 43690 - RNA, 1701 nt, synthetic construct
  misc_feature 1..1701: note = derived and/or modified sequence opt5 from anti-influenza_Chain
  source 1..1701: mol_type = other RNA
gacaagatctgcattggctaccacgccaacaatagcaccacacaggtggatacgatcctggagaaaaacgtcaccgttacacattccgtggaactcctggagaatcaaaaggaagagagattctgtaaaattcttaacaaggctcccctggacctccgggggtgcaccatcgaaggatggattctgggcaatcctcagtgtgatcttctgctcggggaccagtcttggagctatatcgtggagcgcccgacagcccagaacggaatctgctaccccggcgcgctgaatgaggtcgaggaactgaaagctctcattgggtccggagaaagagtggagcggtttgagatgttccctaagtctacctggacaggcgttgataccagctccggcgtgacgaaggcctgtccctataactctgggagctccttttaccgcaatctgctttggatcattaaaaccaagagcgccgcttatcctgtcatcaaaggaacatacaacaataccggctctcaacccattctgtatttctggggagtgcaccatcctccggacacaaacgaacagaataccctctacgggtccggcgatagatacgttcggatggggacggagagcatgaactttgccaagtctcccgaaatcgctgcccgccctgcggtgaatggacagagaggccggattgactattactggtccgtcctgaaacccggcgagacacttaacgtggaaagcaacgggaatctgatcgccccttggtatgcttacaagttcgtgtctaccaacaataagggagccatctttaaatccaacctccccattgagaattgcgatgctacatgtcagaccatcgccggcgtcctgcgcaccaacaagacattccaaaatgttagcccgctgtggattggggagtgccctaaatatgtgaagtccgaatctctcagactggcgacgggacttcggaacgtgccccagatcgagacccgcggcctgtttggggccattgctggattcatcgaaggcggctggacagggatgatcgacggatggtacggctatcaccatgagaatagccaggggtccggatacgccgctgataaagaaagcacccagaaggccattgacggcatcacaaacaaagtcaattctattatcgataagatgaacacccaatttgaggccgtggaccacgagttctccaatctcgaaagacggattgacaacctgaataagcgcatggaggatgggtttcttgacgtttggacgtacaacgctgaactgctcgtgctgctggagaacgaaagaacactcgatctgcacgacgcgaatgtcaaaaacctttatgagaaggtgaaaagccagctgcgggataatgccaacgacctcggcaatggatgtttcgagttctggcataagtgcgataacgaatgtatcgagtctgttaaaaatggcacctacgactatcctaagtaccaggatgaaagcaagctgaacagacaagagatcgagtccgtgaaacttgacaatctgggggtctatcagtctggacgcctcgtgccccggggcagccccgggtccggatacattcctgaagctccgagagatggccaggcctatgtccgcaaggacggggagtgggtgctgctgagcacctttctcggcaaacccatccctaaccccctgcttggactggactctacaggc

SEQ ID NO: 43691 - RNA, 1701 nt, synthetic construct; identical to SEQ ID NO: 43690
  misc_feature 1..1701: note = derived and/or modified sequence opt5 from anti-influenza_Chain
  source 1..1701: mol_type = other RNA

SEQ ID NO: 43692 - RNA, 1704 nt, synthetic construct
  misc_feature 1..1704: note = derived and/or modified sequence opt5 from anti-influenza_Chain
  source 1..1704: mol_type = other RNA
gaccacatctgcattggctaccatgccaacaatagcaccgaacaggtggatacaatcatggaaaagaacgtcacggttacccacgctcaagacattctggagaaaacacataatgggaagctctgtgatctgaacggagtgaaaccccttatcctgaaggactgctccgtggccggctggctcctggggaatcctatgtgtgatgagttcattaacgtcccggagtggtcttatatcgtggaaaaagcgaatcccgctaacgacctttgctaccctggaaattttaacgattatgaggagctgaagcacctcctgagcagaatcaatcatttcgaaaagattcagatcattcccaaagactcctggtctgatcacgaggccagcctgggcgtttcctctgcctgtccttaccaggggaacagctcctttttccggaatgtggtctggctcatcaagaaaggaaacgcttatcccaccattaagaaaagctacaataacacaaaccaggaagacctgcttgtgctgtggggcatccaccatcctaatgatgaggccgagcaaacccgcctctatcagaacccgacaacctacatttctatcggcacgtccaccctgaatcagagacttgttcccaagatcgctacacggagcaaggtgaacgggcagtctggacgcattgactttttctggaccatcctgaaacctaatgatgccattaactttgaatccaatggcaacttcatcgcgcccgagtacgcctataagattgtcaaaaagggggacagcacaatcatgaaatctgaagtggagtacggaaattgcaacaccagatgtcaaacgcctatgggcgctatcaattccagcatgccctttcacaacattcatccgctcacaatcggggaatgccctaagtatgtgaaatccaataagctggtcctggccaccggactccggaactctccccagcgcgagagacggcgcaagagaggcctgttcggcgctattgccgggtttatcgagggaggctggcaggggatggttgacggatggtacggctatcaccacagcaatgaacaggggtccggatacgcggccgataaagagagcacacaaaaggctattgacggcgtgaccaacaaagtgaactctatcatcgataagatgaatacccagttcgaagccgtcggccgggagtttaacaatcttgaacgcagaattgagaacctgaataaaaagatggaggacgggttcctcgatgtgtggacatataacgctgaactgcttgttctgatggagaatgaacggacgctcgacttccatgattccaacgtgaagaatctgtacgacaaagtccgcctgcagctcagagataacgccaaggagctgggaaatggctgttttgagttctaccacaaatgcgacaacgaatgtatggagagcgtgcggaatgggacctatgattaccctcaatattctgaagaggccagacttaagcgcgaagagatcagcggagttaaactggagtccattggcacataccagtctgggcggctcgtgcccagaggcagccccggatccggctatatccctgaagctccgcgcgacgggcaggcgtacgtccggaaggacggagagtgggtgctgcttagcacctttctgggcaagcccattcctaaccccctcctggggctggattctacagga

SEQ ID NO: 43693 - RNA, 1704 nt, synthetic construct
  misc_feature 1..1704: note = derived and/or modified sequence opt5 from anti-influenza_Chain
  source 1..1704: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtgatctggacggagtgaaaccccttatcctgagagattgctccgtggccggctggctcctggggaaccctatgtgtgacgagttcattaatgtcccggagtggtcttatatcgtggaaaaggcgaaccccgctaatgatctttgctaccctggaaactttaatgactatgaggagctgaaacatctcctgagccggatcaaccacttcgaaaagattcagatcattcccaagtcctcttggagcgatcatgaggcctcctctggcgttagctccgcctgtccttaccaggggacccccagctttttccgcaatgtggtctggctgatcaaaaagaacaatacatatcctaccattaaaagatcttacaacaatacaaaccaagaagacctcctgatcctttggggcattcaccactccaacgatgctgccgagcagaccaagctgtatcagaatccgacgacctacatcagcgtgggaacatctaccctcaaccagcggctggttcccaaaatcgctacacgctccaaggtgaatggccaaagcgggagaatggactttttctggaccattcttaagcctaacgatgccatcaattttgagtctaacggaaatttcattgcgcccgaatacgcctataaaatcgtcaagaaaggcgactccgctattgtgaagtccgaggtggaatacgggaactgcaatacgaaatgtcagacacctatcggagccatcaactcctctatgccctttcataatattcacccgctgaccatcggcgagtgccctaagtatgtcaaaagcaacaagctcgttctggctacagggctgcggaatagccccctccgcgaaagacggcgcaagagaggactgttcggcgccattgcgggctttatcgaagggggatggcagggcatggtggacgggtggtacggatatcatcacagcaacgagcagggctctgggtacgccgctgataaagaatccacccaaaaggccattgacggagtgaccaataaagtcaacagcatcatcgataagatgaacacacagttcgaggctgtgggccgggaatttaataaccttgagcgcagaattgaaaatctgaacaaaaagatggaggacggcttcctcgatgtttggacgtataatgccgagctgcttgtgctgatggaaaacgagcggaccctcgacttccacgattctaatgtcaagaacctgtacgacaaagtgcgcctgcagctcagagataatgccaaggaactggggaacggatgttttgagttctaccataaatgcgacaatgaatgtatggagagcgttcggaacggcacatatgattaccctcaatattccgaggaagctagacttaagcgcgaggaaatctctggggtgaaactggagagcattggaacctaccagtccggccggctcgtccccagagggagccccggctctggatatatccctgaggcgccgcgcgacggccaggcctacgtgcggaaggacggggaatgggtcctgctttccacatttctgggaaagcccattcctaatcccctcctgggcctggatagcaccggg

SEQ ID NO: 43694 - RNA, 1704 nt, synthetic construct; identical to SEQ ID NO: 43692
  misc_feature 1..1704: note = derived and/or modified sequence opt5 from anti-influenza_Chain
  source 1..1704: mol_type = other RNA

SEQ ID NO: 43695 - RNA, 1704 nt, synthetic construct; identical to SEQ ID NO: 43693
  misc_feature 1..1704: note = derived and/or modified sequence opt5 from anti-influenza_Chain
  source 1..1704: mol_type = other RNA

SEQ ID NO: 43696 - RNA, 1707 nt, synthetic construct
  misc_feature 1..1707: note = derived and/or modified sequence opt5 from anti-influenza_Chain
  source 1..1707: mol_type = other RNA
gaccagatctgcattggctaccacgccaacaatagcaccgagcaagtggatacaatcatggaaaagaacgtcacggttacccatgctcaggacattctggagaaaaagcacaatgggaaactctgtgatctggacggagtgaagccccttatcctgagagattgctccgtggccggctggctcctggggaaccctatgtgtgacgaatttattaatgtcccggagtggtcttatatcgtggaaaaagcgaaccccgttaatgatctttgctaccctggagactttaacgattatgaggagctgaagcatctcctgagccggatcaatcacttcgaaaagattcagatcattcccaaatcctcttggagctcccatgaggcttctctgggcgtgagctccgcctgtccttaccaggggaagtcctctttcttccgcaacgtcgtgtggctcatcaaaaagaatagcacatatcccaccattaaaagaagctacaacaatacaaaccaagaagacctgcttgttctgtggggaatccaccaccctaatgatgccgctgagcagaccaagctctatcagaacccgacaacctacatttctgtgggcacgtccaccctgaaccagcggcttgtcccccgcatcgccacaagaagcaaggtgaatggccaatctgggcggatggagtttttctggaccatcctgaaacctaacgacgctattaattttgaatccaacggaaatttcatcgcccccgagtacgcgtataagattgtgaaaaagggcgatagcacaatcatgaaatccgaactcgagtacgggaactgcaataccaagtgtcagacgcctatgggagccattaactctagcatgccctttcataatatccacccgctgacaatcggcgaatgccctaaatatgtcaagtccaaccgcctggttctcgctaccgggctgagaaatagcccccagcgggagcgcagacggaagaaacgcggacttttcggcgccattgctggctttatcgaagggggatggcagggcatggtggacgggtggtacggatatcatcactctaacgaacaaggctccgggtacgccgcggacaaggagagcacacagaaagccattgatggagtgaccaataaggtcaactctatcattgacaaaatgaatacccagttcgaagctgtgggcagagagtttaacaacctggaacggcgcatcgagaatctcaacaagaagatggaggatggcttcctggacgtttggacatataatgccgaacttctggtgctcatggagaacgaaagaacgctggatttccacgacagcaatgtcaaaaacctgtacgataaggtgcggctccaactgagagacaatgctaaagagcttgggaacggatgttttgagttctaccataagtgcgataatgagtgtatggagtccgttcgcaacggcacctatgactaccctcagtattctgaagaggcccggctgaaaagagaagagatcagcggggtgaagctcgagtccattggaatctaccagagcggccgcctggtcccccgggggtctcccggctccggatatattcctgaagccccgagagatggccaggcttacgtgcgcaaggacggggagtgggtccttctgagcacatttctcggaaaacccatccctaatcccctgctgggcctcgactctaccggg

SEQ ID NO: 43697 - RNA, 1707 nt, synthetic construct
  misc_feature 1..1707: note = derived and/or modified sequence opt5 from anti-influenza_Chain
  source 1..1707: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtgatctggacggagtgaaaccccttatcctgagagattgctccgtggccggctggctcctggggaaccctatgtgtgacgagttcattaatgtcccggagtggtcttatatcgtggaaaaggcgaaccccaccaatgatctttgctaccctggcagctttaacgactatgaggagctgaaacatctcctgtcccggatcaatcacttcgaaaagattcagatcattcccaagtctagctggtccgatcatgaggcttctagcggagtttccagcgcctgtccttacctggggtctccctcctttttccgcaacgtggtctggctcatcaaaaagaatagcacatatcctaccattaaaaagtcttacaacaatacaaaccaggaagacctgcttgtgctgtggggaatccaccacccgaatgatgccgctgagcaaaccagactctatcagaaccccacgacctacatttccatcggcacaagcaccctgaaccagcggcttgttcctaaaatcgccacacgctctaaggtgaatggccagtccgggagaatggagtttttctggaccattctgaagcccaacgacgctatcaattttgaaagcaacggaaatttcattgcccctgagtacgcgtataaaatcgtcaagaaaggcgattccgccattatgaagtctgaactcgagtacgggaactgcaatacgaaatgtcaaacacccatgggagctatcaacagctccatgccgtttcataatatccaccctctgaccattggcgaatgccccaagtatgtgaaaagcaaccggctggtgctcgccacagggctgcgcaattctcctcagagagagtcccggcgcaagaagagaggacttttcggcgctatcgccggctttattgaagggggatggcagggcatggtcgacgggtggtacggatatcatcacagcaacgaacagggctctgggtacgcggccgacaaagagagcacccaaaaggctatcgatggagttaccaataaagtgaactccattatcgacaagatgaatacacagttcgaagccgtgggccgggagtttaacaacctggaacgcagaatcgagaatctcaacaaaaagatggaggatggcttcctggacgtctggacgtataatgctgaacttctggtgctcatggagaacgaacggaccctggatttccacgactctaatgttaagaacctgtacgataaagtgcgcctccagctgagagacaatgccaaggagcttgggaacggatgttttgagttctaccataaatgcgataatgaatgtatggagagcattcggaacggcacatataattacccccaatattccgaagaggccagactgaagcgcgaagagatcagcggggtcaaactcgagtctattggaacctaccagtccggccggctggtgcccagagggagccctggctctggatatatcccggaagctccccgcgacggccaggcgtacgttcggaaggatggggagtgggtgcttctgtccacatttctcggaaagcctattcccaaccctctgctgggcctcgacagcaccggg

SEQ ID NO: 43698 - RNA, 1707 nt, synthetic construct
  misc_feature 1..1707: note = derived and/or modified sequence opt5 from anti-influenza_Chain
  source 1..1707: mol_type = other RNA
gaccagatctgcattggctaccacgccaacaatagcaccgagcaagtggatacaatcatggaaaagaacgtcacggttacccatgctcaggacattctggagaaaacacacaatgggaagctctgtgatctggacggagtgaaaccccttatcctgagagattgctccgtggccggctggctcctggggaaccctatgtgtgacgagttccttaatgtctctgaatggagctatattgtggaaaagatcaacccggcgaatgatctgtgctaccccggaaactttaataactatgaggagctcaaacatctgctgtcccggatcaatcgcttcgaaaagattcagatcattcctaagtctagctggcccgaccacgaggcttccctcggcgtttctagcgcctgtccttaccaagggggaccctccttttatagaaacgtggtctggctgatcaaaaagaataacacctaccctacaattaaaaagagctatcataataccaaccaggaagatcttctggtgctctggggcatccaccacccgaacgacgaggccgagcagacacggatttacaaaaatcccaccacgtacatctctgttggcacctccacactgaaccagcgccttgtgcctaagatcgctaccagaagcaaggtcaatgggcagtctggacgggtggagttcttttggacaattctgaaatccaacgataccatcaatttcgaaagcaacggcaattttattgcccccgaaaacgcttataagatcgtgaaaaagggggactctacgattatgaaatccgagctcgaatacggaaattgcaacacaaagtgtcaaacccctatcggcgccatcaatagctccatgcccttccataacattcacccgctgacaatcggggagtgccctaaatatgtcaagtctaatcgcctggttctcgcgaccggactgagaaacagcccccagggcgagcggcgcagaaagaaacggggcctttttggggccattgctggattcatcgaaggcgggtggcagggaatggtggatggctggtacgggtatcatcactccaatgagcagggaagcggctacgccgctgacaaggaatctacccaaaaagccattgacggcgtgacaaacaaggtcaactccatcatcgataaaatgaatacgcagtttgaggcggtggggcgcgagttcaacaatctggaaagacggattgagaacctcaataagaagatggaagacggatttctggatgtttggacctataacgccgagcttctggtgctcatggaaaatgagcgcacactggacttccacgatagcaacgtcaaaaatctgtacgacaaggtgagactccagctgcgggataacgctaaagaacttggcaatgggtgtttcgagttttaccatagatgcgacaacgagtgtatggaatctgttcgcaatggaacctatgattaccctcaatatagcgaggaagcccggctgaagagagaggagatctccggcgtgaaactcgaatctattgggacataccagagcggccgcctggtcccccggggatcccccggcagcgggtatatccctgaggctccgagagacggacaggcctacgtgcgcaaggatggcgaatgggtccttctgtctaccttcctcgggaagcccattcctaaccccctgctgggactcgactccacgggc

SEQ ID NO: 43699 - RNA, 1707 nt, synthetic construct; identical to SEQ ID NO: 43696
  misc_feature 1..1707: note = derived and/or modified sequence opt5 from anti-influenza_Chain
  source 1..1707: mol_type = other RNA

SEQ ID NO: 43700 - RNA, 1707 nt, synthetic construct; identical to SEQ ID NO: 43697
  misc_feature 1..1707: note = derived and/or modified sequence opt5 from anti-influenza_Chain
  source 1..1707: mol_type = other RNA

SEQ ID NO: 43701 - RNA, 1707 nt, synthetic construct; identical to SEQ ID NO: 43698
  misc_feature 1..1707: note = derived and/or modified sequence opt5 from anti-influenza_Chain
  source 1..1707: mol_type = other RNA

SEQ ID NO: 43702 - RNA, 1728 nt, synthetic construct
  misc_feature 1..1728: note = derived and/or modified sequence opt5 from anti-influenza_Chain
  source 1..1728: mol_type = other RNA
atctgcattggctaccacgccaacaatagcaccgaacaggtggacacaatcatggaaaagaacgtcacggttacccatgctcaagatattctggagaaaacacacaatgggaagctctgtgacctggatggagtgaaaccccttatcctgagagactgctccgtggccggctggctcctggggaaccctatgtgtgatgagttcattaatgtcccggagtggtcttatatcgtggaaaaggcgaaccccgctaatgacctttgctaccctggaaactttaatgattatgaggagctgaaacatctcctgagccggatcaaccacttcgaaaagattcagatcattcccaagtcctcttggagcgaccatgaggcctcctctggcgttagctccgcctgtccttaccaggggacccccagctttttccgcaatgtggtctggctgatcaaaaagaacaatacatatcctaccattaaaagatcttacaacaatacaaaccaggaagatctcctgatcctttgggggattcaccactccaacgacgctgccgagcaaaccaagctgtatcagaatccgacgacctacatcagcgtgggcacatctaccctcaaccagcggctggttcccaaaatcgctacacgctccaaggtgaatggccagaacgggagaatggatttcttctggaccattcttaagcctaatgacgccatcaactttgagagcaatggaaacttcattgcgcccgaatacgcctataaaatcgtcaagaaaggcgattctgctattgtgaagtccgaggtggaatacgggaattgcaacacgaaatgtcaaacacctatcggagccatcaatagctccatgccctttcataacattcacccgctgaccatcggcgagtgccctaagtatgtcaaatctaataagctcgttctggctacagggctgcggaacagccccctcggatacattcctgaagcgccccgcgacggccaggcctatgtgagaaaggacggcgagtgggtgctgctttccaccttcctgcggagcgataaaacccatacatgtcccccttgcccggcccccgagctcctgggaggaccttctgtctttctttttccccctaagcccaaagacacgctgatgatctcccgcaccccggaagtgacatgtgttgtggtcgatgtgagccacgaggaccctgaagttaagtttaattggtacgtggatggcgtcgaggtgcacaacgctaaaaccaagcccagagaggaacagtataactctacataccgggtcgtgagcgttctcaccgtgctgcatcaggactggctgaatgggaaggagtacaaatgcaaggtctccaacaaagccctccctgctcccattgaaaagacgatctctaaagccaagggacaacctcgcgagccccaggtgtatacactgccgcctagcagagaagagatgaccaagaatcaggtttcccttacctgcctggtgaaaggcttctaccccagcgatatcgccgtcgaatgggagtctaacgggcaacccgagaataactataagacaacccctccggtgctcgactccgatggcagcttctttctgtactctaaacttacagtggacaagtcccggtggcagcagggaaatgttttcagctgttccgtcatgcacgaagctctgcataaccactatacgcagaaatctctcagcctgtcccccggcaag

SEQ ID NO: 43703 - RNA, 1728 nt, synthetic construct
  misc_feature 1..1728: note = derived and/or modified sequence opt5 from anti-influenza_Chain
  source 1..1728: mol_type = other RNA
atggtggtcaccagcaacgccgacagaatctgcacaggcattacgtcctctaatagcccccacgttgtgaagaccgctacacagggggaggtgaacgtcaccggagtgatccctctgacaaccacaccgaccaaatcccatttcgccaatctcaagggcacggaaacccgggggaaactgtgtcccaagtgccttaactgtacagatctggacgttgcgctcggacgccctaaatgcaccggcaatattccctctgctagagtgagcatcctgcacgaggtccggcctgtgacatccgggtgttttcccattatgcatgatcgcaccaagatcagacaacttcctaacctgctccggggatacgaacacatccgcctgtctacgcataatgttattaacgccgagaatgccccgggcggcccctataagatcgggacaagcggatcctgccctaacgtgaccaatggcaacgggttctttgctacaatggcctgggctgtccccaaaaatgacaacaataagaccgccaccaacagcctgacaattgaagtgccttacatctgtacggagggagaggatcagattaccgtgtggggcttccactctgacaacgaaacacagatggcgaaactctatggggattccaagccccagaaatttaccagctctgccaatggagtcacaacccactacgtttcccaaatcggcggcttcccgaaccagacggaggacgggggactgcctcagagcggcagaattgtggtggattatatggtccagaagtctgggaagacaggaaccatcacctaccaacggggcatccttctgccccagaaagtgtggtgcgcttccggaaagagcaaagttattaaggggtccctccctctgatcggcgaagccgactgtcttcatgagaaatatggcgggctgaataagtctaaaccctactacacaggagagcacgctaaggccattggcaactgccccatctgggtgaagacccctctcaaactggcgaatgggacaaagtatcgcccgcccgccaaactgctcaaggaaagaggatttttcggcgctattgccgggtttctggagggcggatgggaaggcatgatcgctgggtggcatggatacacgagccacggcgcccacggggtcgccgtggctgcggatcttaaatccacccaggaggccatcaacaagattacaaagaatctgaacagcctctctgaactggaggttaaaaatcttcagcggctgtccggagctatggacgagctccataacgaaatcctggagctggatgaaaaggtggacgacctccgcgccgataccattagctctcaaatcgagctggccgtccttctgagcaatgaaggcattatcaactccgaggacgagcacctcctggctcttgaaagaaaactgaagaaaatgctcgggccttctgccgtggagatcggcaatggatgtttcgaaacaaagcataagtgcaaccagacctgcctggatcggattgcggctggcacgtttgacgccggggagttcagcctgcccacctttgattccctcaatatcacagccgctagcctgaacgacgatggacttgacaaccacaccattctgctctattactctacagccgcttccagcctggccgtcaccctgatgatcgcgattttcgtggtttatatggtgtctcgcgataatgtctcctgtttccatagc

SEQ ID NO: 43704 - RNA, 1728 nt, synthetic construct; identical to SEQ ID NO: 43703
  misc_feature 1..1728: note = derived and/or modified sequence opt5 from anti-influenza_Chain
  source 1..1728: mol_type = other RNA

SEQ ID NO: 43705 - RNA, 1728 nt, synthetic construct; identical to SEQ ID NO: 43702
  misc_feature 1..1728: note = derived and/or modified sequence opt5 from anti-influenza_Chain
  source 1..1728: mol_type = other RNA

SEQ ID NO: 43706 - RNA, 1731 nt, synthetic construct
  misc_feature 1..1731: note = derived and/or modified sequence opt5 from anti-influenza_Chain
  source 1..1731: mol_type = other RNA
gccaaggctggcgtgcagagcgtcaaaatggagaagatcgttctcctgttcgccattgtgtccctggtgaaatctgaccaaatctgcattgggtaccacgcgaacaatagcaccgaacaggtcgatacaatcatggagaagaacgtgacggttacccatgctcaggacattcttgaaaagacacacaatggaaagctgtgtgatctcgacggcgtgaagcccctgatccttagagattgctccgtcgccgggtggctgctcggaaaccctatgtgtgacgagtttatcaatgtgccggaatggtcttatattgttgagaaagccaaccccgtgaatgatctgtgctaccctggcgacttcaacgattatgaggaactgaagcatctcctgagccggatcaatcactttgagaaaattcagatcattcccaagtcctcttggagctcccatgaagctagccttggggtctcttccgcctgtccttaccaaggaaaaagctctttctttcgcaacgtggtgtggctgatcaagaaaaattccacctatcccacaattaaaagaagctacaacaataccaaccaggaggacctcctggtcctttggggcatccaccaccctaatgatgctgccgagcagacaaagctgtatcagaacccgaccacgtacatctctgttggcacctccacactcaaccaacggctggtgccccgcattgcgaccagaagcaaagtgaatgggcagtccggacggatggagttcttttggacaatcctgaagcctaacgacgccattaatttcgaatctaacggcaattttatcgctcccgaatacgcctataaaattgtcaagaaaggggatagcaccatcatgaagtccgagctcgaatacggaaactgcaatacgaagtgtcagacacctatgggcgctatcaacagctctatgcccttccataatattcacccgctgaccatcggggagtgccctaaatatgtgaagtccaaccgccttgttctggccacaggactcagaaatagcccccagcgggagcgcagacggaaaaagcgcggcctgtttggcgcgattgccgggttcatcgaaggaggctggcaagggatggtggacggatggtacggctatcatcactctaacgagcaggggagcggatacgctgccgacaaagaatccacccagaaggctattgatggcgtcaccaataaggtgaactctatcatcgacaaaatgaatacacaatttgaggccgttggcagagagttcaacaaccttgaacggcgcattgagaatctgaacaagaaaatggaagatgggttcctcgacgtgtggacgtataatgccgagctgctggtcctcatggaaaacgagagaaccctggattttcacgacagcaatgtgaagaacctttacgataaagtccggctgcagctcagagacaatgctaaggaactgggaaacggctgtttcgagttttaccataagtgcgataatgagtgtatggaatccgtgcgcaacgggacatatgactaccctcagtatagcgaggaagcgcggcttaaaagagaggagatctctggagttaagctggaatccattggcatctaccagattctcagcatctattctaccgtggcctccagcctggctctggccctcatggtcgccgggctgtccctttggatgtgctctaatggcagcctgcaatgccgcatttgtatc

SEQ ID NO: 43707 - RNA, 1731 nt, synthetic construct; identical to SEQ ID NO: 43706
  misc_feature 1..1731: note = derived and/or modified sequence opt5 from anti-influenza_Chain
  source 1..1731: mol_type = other RNA

SEQ ID NO: 43708 - RNA, 1737 nt, synthetic construct
  misc_feature 1..1737: note = derived and/or modified sequence opt5 from anti-influenza_Chain
  source 1..1737: mol_type = other RNA
atggtggtcaccagcaacgccgacagaatctgcacaggcattacgtcctctaatagcccccacgttgtgaagaccgctacacagggggaggtgaacgtcaccggagtgatccctctgacaaccacaccgaccaaatcccatttcgccaatctcaagggcacgcaaacccgggggaaactgtgtcccaactgccttaattgtacagatctggacgttgcgctcggacgccctaagtgcatgggcaccattccctctgctaaagccagcatcctgcacgaagtgaagcctgtcacatccgggtgttttcccattatgcatgatagaaccaagatccggcagcttcctaacctgctccgcggatacgagaatatcagactgtctgcccggaacgtgattaatgctgaaacggccccgggcggcccctatatcgttgggacaagcggatcctgccctaacgtgaccaatggcaaagggttctttgctacaatggcctgggcggtccccaagaacaaaaataagaccgccaccaaccctctgacagtggaggtgccctacatttgtacgaaaggagaagaccagatcaccgtctggggcttccacagcgataatgaggctcagatggttacactctatggggactctaagccgcaaaagtttacctccagcgccaacggagtgacaacccattacgtgtctcagattggcggcttccctaaccagacggaggatgaagggctgcagcaatccggacgcatcgtcgtggactatatggttcagaaacccggcaagacagggaccattgtgtaccagagaggagtccttctgcctcagaaagtgtggtgcgctagcggccggtctaaggttatcaaagggtccctccccctgatcggagaggccgattgtcttcacgaaaagtatggcggcctgaataaaagcaagccctactacaccggggagcacgcgaaggccattggaaactgccctatctgggtgaaaacaccgctcaagctggctaatggcaccaaatatagaccccctgccaagctgctcaaagagcgcgggtttttcggagctattgccggctttctggaagggggctgggagggaatgatcgccggctggcatgggtacacatcccacggagctcatggcgtcgcggtggccgctgaccttaagtctacgcaagaagccattaacaagatcaccaaaaatctgaacagcctctccgagctggaagtcaagaatcttcagcggctgagcggggccatggatgagctccacaacgagatcctggaactggacgagaaagtggatgacctccgcgctgacacaatttcttcccagatcgaactggccgttcttctgagcaatgagggaattatcaactctgaagatgagcacctcctggcgcttgagagaaagctgaaaaagatgctcggccccagcgctgtggacattgggaatggctgtttcgaaaccaagcataaatgcaaccaaacatgcctggatcggatcgccgccggaacctttaatgctggcgagttctccctgcctacgtttgactctctcaacatcaccgccgctagcctgaatgatgacgggcttgataaccacacaattctgctctattactccaccgccgcgagctctctggccgtcacactgatgatcgctattttcatcgtgtatatggtttcccgcgacaacgtgttccttctccatctgagcattagaaag

SEQ ID NO: 43709 - RNA, 1737 nt, synthetic construct; identical to SEQ ID NO: 43708
  misc_feature 1..1737: note = derived and/or modified sequence opt5 from anti-influenza_Chain
  source 1..1737: mol_type = other RNA

SEQ ID NO: 43710 - RNA, 1731 nt, synthetic construct
  misc_feature 1..1731: note = derived and/or modified sequence opt5 from anti-influenza_Chain
  source 1..1731: mol_type = other RNA
atggagaccatcagcctgattacaatcctcctggtggtcacggcctccaacgctgacaagatttgcatcggccaccagtctaccaatagcacagaaaccgttgatacacttaccgagacaaacgtgcccgtgacccatgccaaagaactgctccacacggagcataatgggatgctgtgtgcgacctcccttggacaccctctgattctcgacacatgcaccatcgaaggcctggtctacgggaacccgtcttgtgatctgctcctgggaggcagagagtggagctatatcgtggagcggtcctctgctgttaatgggacatgctaccccggaaacgtggaaaatcttgaggaactgcgcaccctcttcagctccgccagctcttatcaacgcattcagatctttcctgacacgacatggaacgtcacctacacaggcacctcccgggcctgtagcggctctttctatcgctccatgagatggctgacccaaaagagcgggttttaccccgtgcaggatgctcaatatacaaataaccggggaaaatctattcttttcgtttggggcatccatcaccctcccacgtacaccgagcagacaaatctgtacattcgcaacgacaccacaacctccgtgacgacagaggatctcaatagaacctttaagcctgtcatcgggccgcggcccctggtgaacggactgcagggccgcattgactattactggagcgtgctcaaacctgggcagaccctgagagtccggtccaatggaaaccttatcgccccctggtatggccacgttctgtctggcgggagccatggacgcatcctcaagacagatctgaagggcgggaactgcgtggtgcaatgtcagaccgaaaaaggaggccttaattccacactgcctttccacaacattagcaagtacgcttttgggacgtgccccaaatatgtcagagttaattctctcaagctggccgtgggactgcggaacgtgccggcgcgctccagcagaggcctcttcggcgccatcgctgggtttattgagggaggctggcctgggctggtcgccggatggtacggcttccagcattctaatgaccagggggtgggcatggctgccgatcgggacagcacccaaaaagcgatcgataagattacatccaaggttaacaatatcgtggacaaaatgaacaagcagtatgaaatcattgaccacgagttttctgaagtcgagaccagacttaatatgatcaacaataaaattgatgaccagatccaagatgtgtgggcctacaacgctgagctgctcgtcctgcttgaaaatcagaagacactggacgagcacgatgccaacgtgaataacctctacaacaaagttaagcgcgctctgggaagcaatgccatggaagacggcaaagggtgtttcgagctgtatcataagtgcgatgaccagtgtatggaaaccattcggaacggaacgtacaatagacgcaagtatcgggaggagtccagactcgaacgccagaaaatcgagggcgtgaagctggaaagcgaggggacctacaaatctggacggcttgtccccagaggctcccctgggagcggctatatccccgaagcccccagagatggacaggcttacgtgcggaaggacggcgagtgggttctgctctctacatttctggggaaacctattccgaaccccctgcttggactcgattccaccggc

SEQ ID NO: 43711 - RNA, 1731 nt, synthetic construct; identical to SEQ ID NO: 43710
  misc_feature 1..1731: note = derived and/or modified sequence opt5 from anti-influenza_Chain
  source 1..1731: mol_type = other RNA

SEQ ID NO: 43712 - RNA, 1752 nt, synthetic construct
  misc_feature 1..1752: note = derived and/or modified sequence opt5 from anti-influenza_Chain
  source 1..1752: mol_type = other RNA
atgaaggccatcattgtgctgctcatggtcgttaccagcaacgctgacagaatctgcacaggcattacgtcctctaatagcccccacgtggtgaaaaccgccacacagggggaggtcaacgtgaccggagttatccctctgacaaccacaccgaccaagtcccatttcgcgaatcttaaaggcacgcaaacccgggggaagctgtgtcccaactgctttaattgtacagatctcgacgtggctctgggacgccctaaatgcatgggcaacaccccctctgccaaggtcagcattcttcacgaagtgaagcctgccacatccgggtgtttccccatcatgcatgatagaaccaaaatccggcagctgcctaatctcctgcgcggatacgagaacattagactgtctacgagcaatgttatcaacacagaaaccgctccgggcggcccctataaggtggggacatccggaagctgccctaatgtcgccaacggcaatgggtttttcaacaccatggcttgggtgattcccaaagacaataacaagaccgccatcaaccctgtgacagtcgaggttccctacatttgttctgaaggagaggatcagatcacggtgtggggctttcactccgacgataaaacccagatggagcggctctatggggacagcaatccgcaaaagttcacatcttccgcgaacggagtgaccacacattacgtcagccagattggcggctttcctaatcagaccgaagatgaggggctgaagcagtctggacgcatcgtggttgactatatggtgcaaaaacccggcaagacggggacaatcgtctaccagagagggattcttctgcctcagaaagtgtggtgcgcctccggccggagcaaggttatcaaagggtccctccccctgattggagaagctgattgtcttcacgagaagtatggcggcctgaacaaatctaagccctactacaccggggagcacgccaaggctatcggaaattgccctatttgggtgaaaaccccgctcaagctggccaacggcacaaaatatagaccccctgcgaagctgctcaaagaacgcgggttctttggagccatcgctggcttcctggagggaggctgggaaggaatgatcgccggctggcatgggtacaccagccacggagctcatggcgtcgccgtggccgctgaccttaagtccacacaggaggcgattaataagatcacgaaaaacctgaattatctcagcgaactggaggtcaagaaccttcaacggctgtctggggccatgaatgagctccacgatgaaattctggagctggacgaaaaagtggacgatctccgcgctgacaccatctccagccagattgagctggccgttcttctgtctaacgaaggaatcatcaatagcgaggatgagcacctcctggcccttgaaagaaagctgaaaaagatgctcggcccctccgctgtggagattgggaacggctgttttgaaacaaagcataaatgcaatcagacctgcctggaccggatcgccgcgggaacattcaacgctggcgatttttctctgcctaccttcgacagcctcaacattacggccgcctccctgaatgatgacgggcttgataaccacaccatcctgctctactatagcacagctgcctcttccctggctgtcaccctgatgattgccatcttcattgtgtacatggttagccgcgacaatgtgtcttgttccatctgcctt

SEQ ID NO: 43713 - RNA, 1752 nt, synthetic construct
  misc_feature 1..1752: note = derived and/or modified sequence opt5 from anti-influenza_Chain
  source 1..1752: mol_type = other RNA
atgaaggccatcattgtgctgctcatggtcgttaccagcaacgctgacagaatctgcacaggcattacgtcctctaatagcccccacgtggtgaaaaccgccacacagggggaggtcaacgtgaccggagttatccctctgacaaccacaccgaccaagtcctacttcgcgaatcttaaaggcacgaagacccgggggaaactgtgtcccgattgcctcaactgtacagacctggatgtggctcttggacgccctatgtgcgtcggcaccacaccctctgccaaggccagcattctgcatgaagtgagacctgttacctccgggtgttttcccatcatgcacgaccggacgaagatccgccaactcgctaatctgctgagaggatatgagaacattcggctctctacacagaatgtgatcgatgccgaaaaagctcctggcggcccgtaccgcctggggaccagcggatcctgccccaacgccacaagcaagtctggcttctttgcgaccatggcctgggctgtccctaaagacaataacaagaatgccaccaacccccttacagtggaggtgccttatatttgtacggaaggggaggatcagatcaccgtctggggattccattccgacgataaaacacagatgaagaatctgtacggcgacagcaacccccaaaagtttacctcttccgctaatggggttacaacccactatgtgagccagattggaggcttcccggatcagacggaggacggcgggctccctcagtctggaagaatcgtggtcgattacatgatgcaaaaacccggcaagacagggaccattgtgtatcagcggggagttctgcttcctcagaaagtgtggtgcgcctccggccgcagcaaggtcatcaaagggtccctgcccctcatcggagaagcggactgtctgcatgagaagtacggcggcctgaacaaatctaagccctactataccggggaacacgccaaggctattggaaactgccctatctgggtgaaaacaccgctcaagctggccaatggcaccaaatacagaccccctgctaagctgctgaaagagcgggggtttttcggagccattgccggctttctcgaagggggctgggaaggaatgatcgctggctggcacgggtatacaagccatggagcgcacggcgttgccgtggctgccgacctgaagtccacgcaggaggccattaacaagatcaccaaaaatcttaacagcctgtctgaactcgaggtcaagaatctgcaacgcctgtccggggctatggatgaactccataacgagatcctggagcttgacgaaaaagtggatgacctgagagccgatacaattagctctcagatcgagctcgcggtcctgcttagcaatgaaggaattatcaactccgaggacgaacaccttctcgctctggagcggaagctgaaaaagatgctcggcccctctgccgtggatattgggaatggctgtttcgagaccaagcacaaatgcaaccagacatgcctggaccgcatcgccgctggaacctttaatgccggcgagttcagccttcctacgtttgattccctgaacatcaccgctgccagcctcaatgacgatgggctggacaaccatacaattctgctttactattctaccgcggcctccagcctcgctgttacactgatgctggccatcttcattgtgtacatggtctctagagacaatgtgtcctgtagcatctgcctc

SEQ ID NO: 43714 - RNA, 1752 nt, synthetic construct
  misc_feature 1..1752: note = derived and/or modified sequence opt5 from anti-influenza_Chain
  source 1..1752: mol_type = other RNA
atgaaggccatcattgtgctgctcatggtcgttaccagcaacgctgacagaatctgcacaggcattacgtcctctaatagcccccacgtggtgaaaaccgccacacagggggaggtcaacgtgaccggagttatccctctgacaaccacaccgaccaagtcctacttcgcgaatcttaaaggcacgcggacccgcgggaagctgtgtcccgattgcctcaactgtacagacctggatgtggctcttggaagacctatgtgcgtcggcaccacaccctctgccaaagccagcattctgcatgaagtgaagcctgttacctccgggtgttttcccatcatgcacgaccggacgaagatccgccaactccctaatctgctgagaggatatgagaacattcggctctctacacagaatgtgatcgatgctgaaaaagccccgggcggcccctaccgcctggggaccagcggatcctgccctaacgctacaagcaagtctggcttctttgccaccatggcgtgggccgtccccaaagacaataacaagaatgctaccaaccctcttacagtggaggtgccctatatttgtacggaaggggaggatcagatcaccgtctggggattccattccgacgataaaacacagatgaagaatctgtacggcgacagcaacccgcaaaagtttacctcttccgccaatggggttacaacccactatgtgagccagattggatctttccctgatcagacggaggacggcggcctcccccagtccgggagaatcgtggtcgattacatgatgcaaaaacctggaaagacaggcaccattgtgtatcagcgcggggttctgcttccccagaaagtgtggtgcgctagcggacggtccaaggtcatcaaaggctctctgcccctcatcggggaagccgactgtctgcatgagaagtacggaggcctgaacaaaagcaagccttactataccggcgaacacgcgaaggccattgggaactgcccgatctgggtgaaaacacccctcaagctggctaatggaaccaaatacagacctcccgccaagctgctgaaagagcggggctttttcggggctattgccggatttctcgagggcgggtgggaaggcatgatcgccggatggcacggctatacatcccatggggctcacggagttgcggtggccgctgaccttaagagcacgcaggaggccattaacaagatcaccaaaaatcttaactctctgtccgaactcgaggtcaagaatctgcaacgcctgagcggcgccatggatgaactccataacgagatcctggagcttgacgaaaaagtggatgacctgagagctgatacaatttctagccagatcgagctcgccgtcctgctttccaatgaagggattatcaactctgaggacgaacatctgctcgcgctggagcggaagctgaaaaagatgctcggacctagcgctgtggagattggcaatgggtgtttcgaaaccaagcacaaatgcaaccagacatgcctggatcgcatcgccgccggcacctttaatgctggagagttctcccttcccacgtttgacagcctgaacatcaccgccgcttctctcaatgatgacggcctggataaccacacaattctgctttactattccaccgccgcgagctctctcgccgttacactgatgctggctatcttcattgtgtacatggtctccagagacaatgtgagctgttccatctgcctc

SEQ ID NO: 43715 - RNA, 1752 nt, synthetic construct; identical to SEQ ID NO: 43712
  misc_feature 1..1752: note = derived and/or modified sequence opt5 from anti-influenza_Chain
  source 1..1752: mol_type = other RNA

SEQ ID NO: 43716 - RNA, 1752 nt, synthetic construct; identical to SEQ ID NO: 43713
  misc_feature 1..1752: note = derived and/or modified sequence opt5 from anti-influenza_Chain
  source 1..1752: mol_type = other RNA

SEQ ID NO: 43717 - RNA, 1752 nt, synthetic construct; identical to SEQ ID NO: 43714
  misc_feature 1..1752: note = derived and/or modified sequence opt5 from anti-influenza_Chain
  source 1..1752: mol_type = other RNA

SEQ ID NO: 43718 - RNA, 1758 nt, synthetic construct
  misc_feature 1..1758: note = derived and/or modified sequence opt5 from anti-influenza_Chain
  source 1..1758: mol_type = other RNA
atgaaggccatcattgtgctgctcatggtcgttaccagcaacgctgacagaatcatttgcacaggcatcacgtcctctaatagcccccacgtggtgaaaaccgccacacagggggaggtcaacgtgaccggagttattcctctgacaaccacaccgaccaagtcccatttcgcgaatcttaaaggcacggaaacccgggggaagctgtgtcccaaatgcctcaactgtacagatctggacgtggctcttggacgccctaagtgcaccggcaatatcccctctgccagagtcagcatcctgcacgaggtgcggcctgttacatccgggtgttttcccattatgcatgatcgcaccaagatcagacaactccctaacctgctgcggggatacgaacacattcgcctctctacgcataatgtgatcaacgccgagaatgctccgggcggcccctataaaattgggacaagcggatcctgccctaacgtcaccaatggcaacgggttctttgccacaatggcttgggccgtgcccaagaatgacaacaataaaaccgcgaccaacagcctgacaatcgaagtgccttacatttgtacggagggagaggatcagatcaccgtctggggcttccactctgacaacgaaacacagatggccaaactttatggggattccaagccccagaagtttaccagctctgctaatggagttacaacccactacgtgtcccaaatcggcggcttcccgaaccagacggaggacgggggactgcctcagagcggcagaattgtggtcgattatatggtgcagaagtctgggaaaacaggaaccatcacctaccaacggggcattctcctgccccagaaggtttggtgcgcctccgggcgcagcaaagtgatcaagggatcccttcctctgattggcgaagctgactgtctccatgagaaatatggcgggctgaataagtctaaaccctactacacaggagagcacgccaaggcgatcggcaactgccccatctgggtcaagacccctctgaaactcgccaatgggacaaagtatagaccgcccgctaaactgcttaaggaacggggatttttcggcgccattgctgggtttctggagggcggatgggaaggcatgatcgccgggtggcatggatacacgagccacggcgcccacggggtggctgttgcggccgatctcaaatccacccaggaggctattaacaagatcacaaagaatctgaacagcctttctgaactggaggtgaaaaatctccagcgcctgtccggagccatggacgagctgcataacgaaattctcgagctggatgaaaaggtcgacgaccttagagccgataccatcagctctcaaatcgagctggctgtgctcctgagcaatgaaggcattatcaactccgaggacgagcaccttctggccctcgaacggaaactgaagaaaatgctggggccttctgcggtcgagattggcaatggatgtttcgaaacaaagcataagtgcaaccagacctgcctcgatcgcatcgctgccggcacgtttgacgccggggagttcagcctgcccacctttgattcccttaatattacagctgccagcctgaacgacgatggactcgacaaccacaccatcctgctgtattactctacagctgcctccagccttgcggtgaccctcatgattgccatcttcgttgtgtatatggtctctagagataatgtgtcctgtagcatctgcctg

SEQ ID NO: 43719 - RNA, 1758 nt, synthetic construct; identical to SEQ ID NO: 43718
  misc_feature 1..1758: note = derived and/or modified sequence opt5 from anti-influenza_Chain
  source 1..1758: mol_type = other RNA

SEQ ID NO: 43720 - RNA, 1749 nt, synthetic construct
  misc_feature 1..1749: note = derived and/or modified sequence opt5 from anti-influenza_Chain
  source 1..1749: mol_type = other RNA
atggaggccagactgctcgtgctgctttgcgctttcgccgcgaccaacgctgacacaatctgtattggctaccacgccaataacagcacggataccgtcgacacagttctggaaaagaatgtgaccgtgacacattccgtcaacctcctggaggattctcacaatgggaaactttgcaagctgaaaggaatcgctcccctccagctgggcaagtgtaacattgccgggtggctgctcggaaatcctgaatgcgacctgcttctgaccgccagctcctggtcttatatcgtggagacaagcaactccgaaaatggcacctgttacccgggggattttattgactatgaggagctccgggaacaactgtctagcgtttccagcttcgagaaatttgaaatcttccccaagacgtcttcctggcctaaccatgagaccacaaagggagtgaccgctgcctgcagctacgcgggcgcctcttccttttatcgcaatcttctgtggctcaccaaaaagggcagctcttaccccaaactgtccaagagctatgtcaacaataaagggaaggaggtgctggttctctggggagtgcaccatcctcccacaggcacggatcagcagtccctgtaccagaacgctgacgcctacgtctctgtggggagctccaagtataatagacggttcacacctgaaatcgctgcccgcccgaaagtgagagatcaagcgggacggatgaactactattggacccttctggagcccggcgacacaattacctttgaagccaccgggaacctcatcgctccttggtacgccttcgctctgaatcgcggaagcggctctggcattatcacatccgatgcccccgtccacgactgtaacacgaagtgccagacccctcacggggccattaatagctctcttccctttcagaacatccatccggttacaattggagagtgtcctaaatatgtgagaagcaccaagctgcggatggctacaggcctccgcaatatcccctccatccagtctagagggctgttcggagcgattgccggctttatcgaagggggatggaccggcatgattgatggctggtacgggtatcaccatcaaaacgagcagggaagcggctacgctgccgaccagaaatccacgcagaatgccatcgacgggattacaaacaaggtgaatagcgtcatcgagaaaatgaacacccaattcaccgctgtgggaaaggaatttaataacctggagcggcgcatcgaaaatctcaacaagaaagttgatgacggcttcctggatatttggacatacaatgccgagcttctggtgctcctggaaaacgagagaacccttgacttccacgattctaacgtccggaatctgtatgagaaggtgaaatcccagctcaagaacaatgcgaaagaaatcgggaacggctgctttgagttctaccacaagtgtgacgatgcttgcatggaaagcgttcgcaatggaacatatgactaccctaagtattctgaggaatccaaactgaacagagaggagattgatggcgtgaagctggaaagcatgggggtctaccagtccggacggctcgtgcccagaggctctcccgggagcggatatatccctgaggccccgcgcgacggccaagcctacgtccggaaagatggggaatgggtgctgctttccacgtttctgggcaagcccattcctaatcccctcctgggactggactctaccggc

SEQ ID NO: 43721 - RNA, 1749 nt, synthetic construct; identical to SEQ ID NO: 43720
  misc_feature 1..1749: note = derived and/or modified sequence opt5 from anti-influenza_Chain
  source 1..1749: mol_type = other RNA

SEQ ID NO: 43722 - RNA, 1755 nt, synthetic construct
  misc_feature 1..1755: note = derived and/or modified sequence opt5 from anti-influenza_Chain
  source 1..1755: mol_type = other RNA
atggagagaaccgtgctgctcctggccacagtcagccttgttaagtccgaccagatctgcattggctaccacgctaacaattctacggaacaagtggataccatcatggagaaaaacgtgacagtcacccatgcccaggacattctggaacggacacacaatgggaagctctgtgatctgaacggagtgaaaccccttatcctgcgcgactgcagcgttgcgggctggctcctggggaatcctatgtgtgatgagttcattaacgtgccggaatggtcctatatcgtcgagaaggcttctcccgccaatgacctgtgctaccctggaaactttaatgattatgaggaactcaaacatctgcttagcagaatcaaccacttcgagaagattcagatcattcccaagtcctcttggagcaatcatgacgcctccagcggcgtgtcttccgcttgtccttacctggggcggagctcctttttccgcaacgttgtgtggctcatcaaaaagaactctgcctatcccaccattaaaagaagctacaataatacaaaccaggaagatctgcttgtcctgtggggagtgcaccaccctaacgacgctgccgagcaaaccaagctctatcagaatccgacgacctacatctctgtgggcacatccaccctgaaccagcggctggtccccgagattgcgacacgccctaaagttaatggccagagcgggagaatggaatttttctggaccatcctcaagcccaacgatgccatcaattttgagtccaacggaaatttcattgctcctgaatacgcctataagatcgtgaaaaagggcgactctacgattatgaaaagcgagctggaatacgggaactgcaatacaaagtgtcaaacccccatgggagctatcaactccagcatgccgtttcataatattcaccctcttacaatcggcgagtgccccaaatatgtgaagtctaaccggctggtcctcgccaccgggctgcgcaatacccctcagagagagcggcgccggaaaaagagaggacttttcggcgcgatcgccggctttattgaagggggatggcagggcatggtggatgggtggtacggatatcatcactccaacgagcagggcagctgttactctgctgacaaggaaagcacacaaaaagccatcgacggggttacgaataaggtgaactccattatcaacaaaatgaatacccagttcgaggctgtcggacgcgaatttaacaatctggagagacggattgagaacctcaataagaaaatggaagatggcttcctggacgtgtggacatataacgccgagctgctcgttctgatggaaaatgagagaacccttgatttccacgactctaacgtgaagaatctgtacgataaggtccgcctccagctgcgggacaacgccaaagaacttggcaatgggtgctttgagttctaccataagtgtgataacgagtgcatggaaagcgtgaaaaatggaacatatgactacccccaatattccgaggaagctagactgaaccgcgaggagatcagcggcgtcaagctcgaatctatggggacctaccagtccggacggctggtgcccagaggcagccctgggtctggctatatcccggaggcgccccgcgatggacaggcctacgttcggaaagacggcgaatgggtgctgctctccacgtttctggggaagcctattcccaatcctcttctgggactcgatagcacaggc

SEQ ID NO: 43723 - RNA, 1755 nt, synthetic construct; identical to SEQ ID NO: 43722
  misc_feature 1..1755: note = derived and/or modified sequence opt5 from anti-influenza_Chain
  source 1..1755: mol_type = other RNA

SEQ ID NO: 43724 - RNA, 1947 nt, synthetic construct
  misc_feature 1..1947: note = derived and/or modified sequence opt5 from anti-influenza_Chain
  source 1..1947: mol_type = other RNA
atgggcgacaagatcaacttcatttttgggatccacaatcatcagcccctgggaaacttcggctgggtgtttgaggaagcctacgagaaatgctattggcctttcctcgaaaccctggaggaatacccgaatatgaaggtcgctattcacacaagcgggccccttatcgagtggctgcaagataacagacctgagtatattgacctcctgcggtcccttgttaaacgcggacaggtggaaatcgtggtcgccggcttttacgagcccgtgctggcgtctatccctaaggaagatagaattgagcagatccggctcatgaaagagtgggctaagagcattgggttcgacgcccgcggagtttggctgacggaaagagtgtggcagcccgagctggtcaagaccctcaaagaatccggcatcgattatgtgattgttgacgattaccattttatgtctgccggcctgagcaaggaggaactttattggccttactacacagaggacgggggagaggtgatcgctgtcttcccgattgatgaaaaactgcggtatctcatcccctttcgccctgtggacaaggtgctggagtaccttcactccctgatcgatggcgacgaatctaaagtcgccgttttccatgatgacggggagaagtttggaatttggcccggcacctatgaatgggtgtacgagaaggggtggctcagagagttctttgaccggatcagctccgatgaaaagattaatctgatgctgtatacagagtacctcgaaaagtataaacctcgcggactggtgtaccttcccatcgctagctacttcgagatgtctgaatggtccctgccggccaagcaagcgagactcttcgtcgagtttgtgaacgagctgaaagttaagggcattttcgaaaaatatcgggtgtttgtccgcggcgggatctggaagaatttcttttacaagtatcctgagagcaactacatgcacaaaagaatgcttatggtgtctaagctggttcggaataaccccgaagcccgcaaatatctcctgagagctcagtgtaatgacgcctactggcacggactgttcggcggggtgtatctccctcatctgcggagagctatctggaacaatcttattaaggccaactcctacgtcagcctgggaaaagtgatccgcgatattgactacgatggctttgaggaggtcctcatcgaaaatgacaacttctatgcggtgtttaagccctcttacgggggatccctggttgagttcagctccaagaaccggcttgtgaattatgtcgatgtgctggccagacgctgggaacactaccatggctatgttgagtctcagtttgacggcgtggctagcattcacgaactcgagaaaaagatccccgatgagatccggaaagaagtcgcctacgacaagtatagacgcttcatgctgcaggatcacgtggtgcctctggggaccacactcgaggactttatgttctcccggcaacaggaaattggagagttcccgagagttccctacagctacgaactgcttgacggcgggatccgcctgaaacgggagcatctcggaattgaggtcgaaaagaccgtgaagctggtgaacgatggctttgaggtcgaatatatcgtgaataacaaaacggggaatcctgttctgttcgctgtggagcttaacgtcgccgtgcagtctattatggaatcccccggcgttctcagaggaaaggagatcgtggtcgacgataaatacgccgtgggcaagtttgctctgaaattcgaggacgaaatggaggtttggaagtatcctgtgaagaccctgagccagtctgaaagcgggtgggatctcattcaacagggagtctcctacatcgtgcccatccgcctggaggacaaaattcggtttaaacttaaattcgaggaagcgtctggc

SEQ ID NO: 43725 - RNA, 1947 nt, synthetic construct
  misc_feature 1..1947: note = derived and/or modified sequence opt5 from anti-influenza_Chain
  source 1..1947: mol_type = other RNA
atgagcagaatgaccctgaagtcctctatgaaaaagcgggtgctcagcctgcttatcgccgtcgttttcctgtccctcacaggcgtgtttccctctgggctgattgagacgaaagtgagcgctgccaagatcaccgaaaactaccagttcgactcccgcattagacttaattctatcggatttattcctaaccacagcaaaaaggcgacaatcgctgccaattgctccaccttctatgtcgtgaaggaggatggcacaatcgtttacaccgggacagccaccagcatgtttgacaacgatacgaaagaaaccgtgtatattgctgacttctcttccgtcaatgaggaaggaacatactatctggccgtgccgggcgttgggaaaagcgtgaactttaaaatcgctatgaatgtctacgaggatgccttcaagaccgcgatgctcggaatgtatctgctgcggtgtggcacatctgtgtccgccacctacaacggcattcattacagccacgggccctgccatacgaatgacgcttatctcgattacatcaacggacaacacacaaagaaggactctaccaagggctggcatgatgccggggactataataaatacgtggtcaacgctggaattacagttggctccatgtttctggcctgggagcacttcaaggatcagcttgaacctgtggcgctggagatccccgagaaaaataacagcattcctgactttctcgatgaactgaagtatgagatcgactggatccttaccatgcagtaccccgacgggtccggacgcgtggcccacaaagtctctaccagaaatttcggcggctttattatgcctgaaaacgagcatgatgaacggttcttcgtgccgtggagctccgctgccacagctgactttgttgccatgacggccatggctgcgcgcatcttcagaccctatgatcctcagtacgccgagaagtgtattaacgctgccaaagtgagctacgaatttctgaagaataaccccgccaatgtcttcgctaaccaatctgggttttccaccggagagtatgccacagtgagcgacgcggatgaccggctctgggctgccgccgagatgtgggaaaccctgggcgatgaggaatacctgcgcgacttcgagaatagagctgcccagttttctaagaaaatcgaagctgatttcgactgggataacgttgccaatctcgggatgtttacatatctgcttagcgagcggcctggaaagaaccccgcgctggtgcagtccattaaagactctctcctgagcaccgccgactccatcgtccgcacgagccagaatcacggctacgggagaacacttggaaccacctattactggggctgcaacggcacagtggtccggcaaaccatgatcctccaggtggctaataagatttctccgaacaatgattatgttaacgccgctctggacgccatctcccatgtgttcgggcgcaattactacaacagaagctatgtcacaggactgggcattaaccctcccatgaatcctcacgatcggagatctggggcggacggaatctgggagccctggcccggctacctggttgggggcggatggcctggcccgaaagattgggtggacattcaggattcctatcagacgaacgaaatcgccatcaattggaacgctgccctcatttacgctctggccgggtttgtgaattataacagcccccaaaatgaggtcctttacggagacgtgaacgatgacggcaaggttaattccaccgatctgacactcctgaagcgctatgtgcttaaagccgtctctaccctgcctagctccaaggctgagaaaaacgcggacgtgaatcgggatgggagagtgaactctagcgacgtcacaatcctctcccgctacctgattcgggtgatcgaaaagctgcccatt

SEQ ID NO: 43726 - RNA, 1947 nt, synthetic construct; identical to SEQ ID NO: 43724
  misc_feature 1..1947: note = derived and/or modified sequence opt5 from anti-influenza_Chain
  source 1..1947: mol_type = other RNA

SEQ ID NO: 43727 - RNA, 1947 nt, synthetic construct; identical to SEQ ID NO: 43725
  misc_feature 1..1947: note = derived and/or modified sequence opt5 from anti-influenza_Chain
  source 1..1947: mol_type = other RNA

SEQ ID NO: 43728 - RNA, 2046 nt, synthetic construct
  misc_feature 1..2046: note = derived and/or modified sequence opt5 from anti-influenza_Chain
  source 1..2046: mol_type = other RNA
atgaagcccagccacttcaccgagaaaagatttatgaagaaagtgctgggcctcttcctggtcgttgtgatgcttgcctccgtgggggtcctgcctacatctaaggtgcaggctgccggaacgaccgttacaagcatggaatacttttccccggcggacggccccgtgatctctaaaagcggggtcggaaaggcttcctatggcttcgtgatgcctaagtttaacgggggatctgccacctggaatgatgtttacagcgacgtgggcgtcaacgtgaaagtgggcaataactgggtcgatattgaccaggccgggggatatatctacaatcagaactggggccattggtccgatgggggattcaatggctattggtttacactcagcgctaccacagagattcagctgtactctaaggccaacggggttaaacttgaatatcagctggtgttccaaaatatcaacaagaccacgattaccgctatgaatcccacacagggacctcagatcaccgcctcctttacaggcggcgcggggttcacctaccccacgtttaacaatgacagcgccgtgacatacgaggctgtcgccgatgacctcaaagtgtatgttaagcctgtgaactcttccagctggatcgatattgacaataacgctgcctctggatggatctacgatcacaacttcggccagtttaccgacgggggaggcgggtattggttcaatgtcacagaatccattaacgtgaagctggagagcaaaacctcctctgcgaatctggtttacaccatcacattcaacgagccgacgcggaatagctatgtgattaccccctacgaaggaacaacctttacagccgatgctaacggctccatcggcattcctctccccaagatcgacgggggagcccctatcgctaaagagctgggcaatttcgtctatcaaattaacatcaatgggcagtgggtggaccttagcaactcttcccagagcaagtttgcctactctgccaatggatacaacaatatgagcgatgctaaccagtggggctattgggcggactacatttatgggctgtggttccaacccatccaggaaaatatgcagattcgcatcggctacccgctcaacggacaagccggcgggaacatcggaaataactttgtcaattataccttcattggcaaccctaatgctcccagacctgatgtgtccgaccaggaggatatctctattgggacgcccacagaccccgccatcgccggaatgaacctgatttggcaggatgagtttaatggcaccacccttgacacaagcaaatggaactacgaaaccgggtattacctgaataacgatcctgctacatggggctggggaaatgccgagctccagcattacacgaactccacccaaaatgtttatgtgcaggacggcaagctgaacatcaaagcgatgaatgatagcaagtctttcccgcaggaccccaaccggtacgctcagtattccagcgggaagatcaacacaaaagacaagctgtctctcaaatacggacgcgtcgattttagagccaagctgcctaccggcgacggggtgtggcccgccctttggatgctgcctaaagattccgtttatggaacatgggctgccagcggcgaaattgacgtgatggaggctcgggggcgcctccccggctccgtctctggaaccatccacttcggcgggcaatggccggtgaatcagagctccggaggcgattaccattttcctgaagggcagacgttcgccaacgactatcacgtgtactctgttgtctgggaggaggataatattaagtggtacgtggacggaaagtttttctataaagtgaccaaccagcaatggtacagcacagcggcccccaataaccctaatgctcccttcgatgaacctttttatctgatcatgaaccttgccgtcggcgggaatttcgacggcggaagaacccccaacgcttccgatattccggccacaatgcaagtggactacgttcgggtgtataaggagcag

SEQ ID NO: 43729 - RNA, 2046 nt, synthetic construct; identical to SEQ ID NO: 43728
  misc_feature 1..2046: note = derived and/or modified sequence opt5 from anti-influenza_Chain
  source 1..2046: mol_type = other RNA

SEQ ID NO: 43730 - RNA, 2058 nt, synthetic construct
  misc_feature 1..2058: note = derived and/or modified sequence opt5 from anti-influenza_Chain
  source 1..2058: mol_type = other RNA
atgaccaagagcatctacttctccctgggcattcacaaccatcagcccgtggggaattttgacttcgtcatcgagagagcctatgaaatgtcttacaaacctctcattaactttttctttaagcacccggatttccccatcaatgttcattttagcggattcctgcttctgtggctcgagaaaaaccaccctgaatattttgagaagctgaaaattatggctgaacggggccaaatcgagttcgtgtccgggggattttacgagcccatccttcctattatccccgacaaggataaggtgcagcagattaaaaagctgaataaatatatctacgacaagttcggccagacacctaaagggatgtggctcgccgaacgcgtctgggagccgcatctggtgaagtatattgcggaagctggaatcgagtacgttgtggtcgatgacgcccactttttctctgtgggcctgaaggaggaagatctcttcggctactatctgatggaggaacaagggtacaaacttgccgtttttcccattagcatgaagctgagatatctcatccctttcgctgaccccgaggaaacgatcacctacctggataaatttgcctccgaggacaagtctaaaattgctctcctgttcgatgacggagagaagtttggcctctggcctgatacatatcggaccgtgtacgaagaggggtggctggaaacattcgtcagcaaaatcaaggagaactttctgctcgtgacccccgtgaatctgtatacatacatgcagcgcgtcaagccgaaaggaagaatttaccttcctaccgcctcctatcgggaaatgatggagtgggttctgttccccgaggcgcagaaggaactcgaggaactggtggagaaacttaagacggaaaacctgtgggacaaatttagcccttacgtgaagggcgggttctggcgcaattttctcgccaagtatgacgagtctaaccacatgcagaaaaagatgctgtacgtctggaaaaaggtgcaagattcccccaatgaggaagttaaagagaaggctatggaagaggtgttccagggacaggccaacgacgcttattggcatggcatctttggcgggctgtacctcccccacctgagaaccgccatttatgagcatcttatcaaggcggaaaattacctggagaacagcgaaatccggttcaatattttcgattttgactgcgatggaaacgacgagatcattgtcgaatctcctttctttaacctctacctgtccccgaatcacggcgggagcgtgcttgagtgggatttcaaaacaaaggcctttaacctgaccaatgttctcacacgcagaaaagaggcttatcactctaagctgtcctacgtgaccagcgaagcccagggaaaatccatccatgagcggtggacggctaaggaagagggcctggaaaacattctcttctatgacaatcaccgcagagtctcttttacagagaagatcttcgagagcgaacccgtgctggaggatctttggaaagactccagccggctggaagtcgattctttttacgagaactatgactacgaaatcaataaggacgagaacaaaattcgcgtgcttttctccggggtttttagaggattcgagctgtgtaagagctatatcctgtacaaagataagtcttttgtggacgtcgtgtacgaaattaaaaatgttagcgagacccctatctcccttaacttcggctgggaaattaatctcaacttcctggcccccaatcatcctgattattactttctgatcggcgaccaaaagtatcccctctctagcttcgggattgagaaggtgaacaattggaaaatcttttccggaatcggcattgagctggaatgcgtccttgatgtggaggccagcctgtaccggtatccgatcgaaacagtgtctctctccgaggaagggttcgagagagtttaccagggaagcgctctgattcacttttataaggtcgacctgcctgtgggctctacctggcgcaccacaatccggttctgggtgaaa

SEQ ID NO: 43731 - RNA, 2058 nt, synthetic construct; identical to SEQ ID NO: 43730
  misc_feature 1..2058: note = derived and/or modified sequence opt5 from anti-influenza_Chain
  source 1..2058: mol_type = other RNA

SEQ ID NO: 43732 - RNA, 2115 nt, synthetic construct
  misc_feature 1..2115: note = derived and/or modified sequence opt5 from anti-influenza_Chain
  source 1..2115: mol_type = other RNA
atgcccaccaacctgttctttaatgcccaccatagccctgtgggcgctttcgcctcctttacactcgggttcccgggaaagtctggcgggctggaccttgagctggcgagaccccctcggcagaacgtcctcatcggagttgaaagcctgcacgagtccggcctttaccatgtgctgccctttctcgaaacggctgaggaagatgagtctaaacgctatgacattgagaatcctgatcccaaccctcaaaagccgaatatcctgattcccttcgccaaagaagagatccagagagaatttcacgtggccaccgacacatggaaggctggggatctgaccttcacaatttacagccctgtcaaagccgtgcccaaccctgagaccgctgacgaggaggaactcaagctggcccttgttcccgcggtgatcgtcgaaatgacaatcgataataccaacggaacgcgggcccgcagagcctttttcggctttgagggcaccgacccgtatacatccatgcggcgcattgatgatacctgccctcagctgagaggggtgggacagggccggatcctctctattgttagcaaggacgaaggggtgcgctccgctctgcatttcagcatggaggacatccttacagctcaactggaggaaaattggacctttggactcggcaaagtcggggccctgattgtggatgtgcccgcgggagagaagaaaacgtaccagttcgccgtctgtttctatagaggcggctacgttacagctgggatggacgcctcttatttttacacccggttctttcagaacatcgaagaggtgggactgtacgctctcgaacaggccgaggtgctgaaggagcaatccttccgcagcaataaacttattgaaaaggagtggctgtctgacgatcagacatttatgatggcccacgctatcagatcctattacggcaacacccagctcctggaacacgaggggaagcctatctgggtcgtgaatgaaggagagtatcggatgatgaacaccttcgaccttacagttgatcagctgtttttcgagctcaaactgaatccctggacggtgaagaacgtcctggacctctacgtggaacgctatagctacgaggatagagttcggtttcccggcgaagagaccgagtatccttctgggatttccttcacacatgacatgggagtggcgaacacctttagcagaccgcactactcctcttacgaactgtatggcatcagcggctgcttctcccatatgacacacgagcaacttgtcaattgggtgctgtgtgccgctgtctacattgaacagaccaaagattgggcctggcgcgacaagcggctcgccatcctggagcagtgccttgaaagcatggtgagacgcgatcaccccgaccctgagcaacggaacggggttatgggactggattctacgagaacaatgggcggggctgagattaccacctatgactccctcgacgtgagcctgggacaggcccgcaataacctgtacctcgcgggcaaatgttgggctgcctatgtcgccctggaaaaactttttcgggatgtggggaaggaggaactggctgccctcgctggcgagcaggccgaaaagtgcgcggccacaatcgtttctcatgtgaccgacgatggatacatccccgctattatgggcgaggggaatgacagcaagatcattcctgccatcgagggactggtcttcccctatttcacaaactgtcacgaagctctggatgagaatggcagatttggggcctacattcaggcgcttcgcaaccatctccaatacgtgctgcgggaaggaatctgcctgttcccggacggcgggtggaaaatctcctctacgagcaataactcctggctcagcaagatttatctgtgtcagtttatcgccagacacattcttggctgggagtgggatgaacagggaaaacgcgctgacgccgctcatgtggcctggctgacccaccctacactctctatctggtcctggagcgatcagattatcgccggcgagattaccgggtctaagtactatccccggggagttacatccatcctgtggctggaggaaggcgag

SEQ ID NO: 43733 - RNA, 2115 nt, synthetic construct; identical to SEQ ID NO: 43732
  misc_feature 1..2115: note = derived and/or modified sequence opt5 from anti-influenza_Chain
  source 1..2115: mol_type = other RNA

SEQ ID NO: 43734 - RNA, 2148 nt, synthetic construct
  misc_feature 1..2148: note = derived and/or modified sequence opt5 from anti-influenza_Chain
  source 1..2148: mol_type = other RNA
atggaggacttcgtgagacagtgctttaaccccatgatcgtcgaactggccgagaaggctatgaaagaatacggcgaggatctcaagattgaaaccaataaattcgccgcgatctgtacacacctggaggtttgctttatgtatagcgacttccattttattaacgagcaaggggaatccatcattgtggagcctgaagatccgaatgctctcctgaagcaccggttcgagatcatcgagggacgcgacagaacgatggcctggaccgtggtcaactctatttgtaatacaaccggcgccgaaaaacccaagtttctccctgatctgtacgactataaggagaaccggttcatcgaaattggggtgacacgcagagaggttcatatctactatcttgaaaaagctaataagattaaaagcgagaagacccacatccatatcttttccttcacaggagaggaaatggccaccaaagctgattacacgctggacgaggaatctcgggcccgcattaagaccagactctttacaatccggcaggagatggcgagccgcggcctgtgggattccttcagacagtctgaacgcggggaggagaccattgaggaacggtttgaaatcacaggaaccatgagacggctggccgaccagagccttccccctaacttctcctgcctggagaatttccgcgcttatgtggatggctttgaacccaacggctacattgaggggaaacttagccaaatgtctaaagaggtcaatgccagaatcgaacctttcctgcggacgacaccgagacccattcgcctccctgacggacccccttgttttcagcggtccaagttcctgcttatggatagcctgaaactctctatcgaggacccctcccacgaaggcgaggggatcccgctgtacgacgctattaagtgcatgagaacctttttcggatggaaagagcctagcgtggttaagccccacggcaaagggatcaaccctaattatctgctctcttggaaacaggtgctggccgaacttcaggatattgagtccgaagagaagatcccccgcacaaagaacatgaagaaaaccagccaactgaagtgggcgctcggagaaaatatggcccccgagaaagtcgactttgatgactgtaaggatatttccgacctgaagcagtacgattctgacgagcctgaacttcggagcctgtccagctggatccagaacgagttcaacaaggcttgcgaactcaccgattctatctggattgagctggacgaaatcggcgaggatgtggccccgattgagcatatcgcttccatgagacgcaattattttacagccgaagtgagccactgtcgggccacggagtacattatgaagggcgtctatatcaacaccgctctgctcaatgcgtcttgcgccgctatggacgacttccagctgattcccatgatcagcaaatgtagaacaaaggaagggcgccggaaaaccaacctttacggatttatcattaagggcagatcccatctgcgcaatgatacagacgttgtgaacttcgtgtctatggagtttagcctcaccgatcctcggctggaaccccacaagtgggagaaatattgcgtccttgagatcggggacatgctgctcagatccgccattggacaagtgagccggcctatgttcctgtacgttcgcacgaatggcacatctaagatcaaaatgaagtgggggatggaaatgagacggtgcctgctccagtccctgcagcaaattgagagcatgatcgaagccgagtcttccgtgaaagagaaggatatgaccaaggagttctttgaaaacagaagcgaaacctggcccatcggagagtccccgaaaggcgtcgaagagggctctattgggaaggtgtgtcgcacacttctggctaaaagcgttttcaattccctctacgcctctcctcagctggagggatttagcgcggaatcccggaagctgcttctcatcgtgcaggctctgagagacaacctggagcccggcaccttcgatctcgggggactgtatgaagccattgaggaatgccttatcaatgacccttgggtcctgctcaacgccagctggtttaattctttcctgacacacgctctgcgc

SEQ ID NO: 43735 - RNA, 2148 nt, synthetic construct; identical to SEQ ID NO: 43734
  misc_feature 1..2148: note = derived and/or modified sequence opt5 from anti-influenza_Chain
  source 1..2148: mol_type = other RNA

SEQ ID NO: 43736 - RNA, 2256 nt, synthetic construct
  misc_feature 1..2256: note = derived and/or modified sequence opt5 from anti-influenza_Chain
  source 1..2256: mol_type = other RNA
atgaacatcaatccctacttcctgtttattgacgtgcctatccaggccgctattagcaccacattcccgtatacgggcgttcccccttactcccacgggaccggaacaggctataccatcgatacagtcattagaacccatgagtactctaacaaggggaaacaatatatcagcgacgtgacaggatgcgtgatggtcgatcccaccaatggccctctccccgaagacaacgagccttccgcctacgcgcagctggattgtgtgcttgaagctctggaccggatggatgaggaacacccggggctctttcaggccggatctcagaatgccatggaggctctgatggttacgaccgtggacaagctgacacaaggccgccagaccttcgattggacagtctgcagaaaccagcccgccgctaccgcccttaatacgacaatcaccagctttcggctcaacgacctgaatggcgcggataaagggggactggtgcctttctgtcaggacattatcgattccctcgacaagcccgagatgatctttttcacagttaaaaacattaagaagaaactgcctgccaagaatcgcaaaggctttcttattaagagaatccccatgaaagtgaaggaccggattacccgcgtcgaatatatcaagagagctctgtctctcaacaccatgacaaaagatgccgagcgggggaagctgaaacgcagagctatcgccacggcggggattcaaatccggggcttcgtgcttgtggtcgaaaatctggccaagaacatttgcgagaatctcgagcagagcgggctgccggttggaggcaacgaaaagaaggctaaactgtccaacgccgtggctaagatgctcagcaattgtcctcccggcgggatctctatgaccgtgacaggagacaacaccaagtggaatgagtgcctgaaccctcgcatttttcttgccatgacagaaagaatcacccgggattcccccatctggttccgcgacttttgtagcattgcccccgtcctgttctctaataaaatcgctagactcggcaaggggttcatgattacgtccaaaacaaagcggctgaaagcgcagatcccttgcccggatctttttaacattcccctggagagatacaatgaagagacccgcgccaagctcaagaaactgaagcctttctttaacgaggaaggaaccgctagcctgtctcccggcatgatgatggggatgttcaatatgctctccacagtgctgggagttgccgcccttggcatcaaaaacatcggcaataaggagtacctgtgggacgggctccagagctccgatgactttgctctgttcgtgaacgccaaagatgaagagacctgtatggaaggaattaatgacttttatcggacatgcaaacttctgggcatcaacatgtctaagaaaaagagctactgtaatgagacggggatgttcgagtttacctccatgttctatagagatggatttgtcagcaacttcgcgatggaactcccttcttttggcgtggctggggttaacgagtccgccgacatggccattggcatgacaatcattaaaaataacatgatcaataacggaatgggccccgctaccgcccaaacagctattcagctgttcatcgccgactaccgctatacctacaagtgccatcggggagatagcaaagtggaaggaaagagaatgaagatcattaaagagctgtgggaaaatacgaagggccgcgacgggctcctggtcgcggatggaggcccgaacctttataatctgcggaacctccacatccctgagattatcctgaaatacaatattatggaccccgagtacaaggggagactgcttcatcctcagaaccccttcgtgggccacctctctatcgaaggaatcaaagaggccgatattacccctgctcacggccccatcaagaaaatggactatgatgccgtcagcgggacacattcctggcgcaccaagcggaatagatctattctgaacacagaccaacgcaatatgatcctggaggaacagtgctacgctaagtgttgcaacctctttgaggcctgtttcaatagcgcgtcctatcggaaaccggtgggacagcacagcatgctggaagccatggctcatagacttcggatggatgcccgcctggactacgagtctggcagaatgtccaaggaagattttgagaaagctatggcccacctcggggaaattggatatatg

SEQ ID NO: 43737 - RNA, 2256 nt, synthetic construct; identical to SEQ ID NO: 43736
  misc_feature 1..2256: note = derived and/or modified sequence opt5 from anti-influenza_Chain
  source 1..2256: mol_type = other RNA

SEQ ID NO: 43738 - RNA, 2265 nt, synthetic construct
  misc_feature 1..2265: note = derived and/or modified sequence opt5 from anti-influenza_Chain
  source 1..2265: mol_type = other RNA
atggccgtggacatcaagaaaattatcaagcagatgaccctggaggaaaaagctggcctctgcagcgggctggatttctggcacacaaagcccgtcgagagacttggcattccttccatcatgatgacggacggaccgcatgggctgcggaaacaacgcgaagatgccgagattgcggacatcaacaattctgttcccgctacctgttttcctagcgccgccggactcgcttgctcctgggatagagaactggtggagcgggtgggcgccgctcttggggaggaatgtcaggccgagaacgtctctatcctgctcggacccggcgcgaatattaagcgcagccctctgtgcggcagaaacttcgaatacttttccgaggacccctatctgtctagcgagctcgccgcttcccacatcaagggggtgcagagccagggagttggcgcctgtctgaaacatttcgctgccaataaccaagaacaccggcgcatgacagtggataccattgtcgacgagagaacacttcgggaaatctactttgcgtctttcgagaatgccgtgaagaaagctcgcccttgggttgtgatgtgcgcctataacaagctgaatggggaatactgttccgagaacagatatctcctgaccgaggtccttaaaaatgaatggatgcatgatggatttgtggtgagcgactggggcgctgtcaacgatcgggtttctgggctggacgccggactcgatctggagatgccgacatcccacggcattaccgacaagaagatcgtggaagccgtgaaaagcggcaagctgtctgagaatattctcaaccgcgctgtcgaaagaatcctgaaagtgatcttcatggcgcttgagaataagaaagagaacgcccagtacgacaaggatgctcaccatcggctggcccgccaggccgctgccgaatccatggttctcctgaaaaacgaggacgatgtgcttcccctgaagaagtctgggacgattgcgctcatcggagcttttgtcaaaaagcctagatatcagggctccgggtctagccacattacccccacacggctggacgatatctacgaagagattaaaaaggccggaggcgacaaagtgaatctggtttactccgaagggtatagactcgagaacgatggaatcgacgaggaactgatcaatgaggccaagaaggctgccagcagctccgatgtggctgtcgtgttcgccggccttcctgacgaatacgagagcgagggctttgatcgcacccatatgtctattcccgaaaaccaaaatcggctgatcgaggcggtcgccgaagtgcagagcaacattgttgtggtcctcctgaatgggtccccggtggagatgccttggatcgacaaagttaagtctgtgcttgaggcttatctgggaggccaggccctcgggggagctctggccgacgtcctgttcggcgaagtgaaccccagcgggaaactcgcggagacatttcctgtgaagctgtcccacaatcccagctaccttaacttccccggcgaagatgacagagttgagtataaagaaggactgttcgtcggctaccgctattacgataccaaggggattgagcctctctttccgttcggacacggcctgtcttacacgaagtttgaatattccgacatcagcgtggataaaaaggacgtgtctgataattccatcattaacgtcagcgtgaaagttaagaatgtggggaaaatggccggaaaggagatcgtccagctgtacgtgaaggacgttaaatcctctgtgcggagacccgagaaggaacttaaaggcttcgagaaggtctttctcaaccctggggaagagaaaacagtgaccttcacactggataagcgcgcttttgcctattacaatacccaaattaaagactggcatgttgaaagcggcgagttcctgatcctcattggacggtcctctagagatatcgtgctgaaggagagcgtccgcgtgaactccaccgtgaagattcggaaaagatttacagtcaacagcgctgttgaagacgtgatgtctgattccagcgccgccgctgtgcttggccccgtcctgaaggagatcacggacgcgctccagatcgacatggataatgcccacgacatgatggctgccaacattaaaaatatgcctctgcgctctctggtggggtattcccagggacggcttagcgaagagatgctcgaggaactggttgataagatcaacaatgtggag

SEQ ID NO: 43739 - RNA, 2265 nt, synthetic construct; identical to SEQ ID NO: 43738
  misc_feature 1..2265: note = derived and/or modified sequence opt5 from anti-influenza_Chain
  source 1..2265: mol_type = other RNA

SEQ ID NO: 43740 - RNA, 2277 nt, synthetic construct
  misc_feature 1..2277: note = derived and/or modified sequence opt5 from anti-influenza_Chain
  source 1..2277: mol_type = other RNA
atggagagaatcaaggaactgcggaacctcatgagccagtcccgcaccagagagattctgacaaaaacgaccgtggaccacatggccatcattaagaaatacacatctggccggcaagaaaagaatcccgcccttcgcatgaaatggatgatggctatgaagtatcctatcaccgcggataagagaattacagagatgatcccggaacggaacgagcaggggcagaccctgtggagcaaaatgaatgacgctggatccgatcgcgtcatggtttctcccctcgccgtgacatggtggaacagaaatggccctatgaccaacacggtgcattaccccaagatctataaaacctacttcgagcgggtcgaacgcctgaagcacgggacatttggacctgtgcatttcagaaatcaggttaaaattcggcgcagagtggacatcaaccccggccacgccgatcttagcgctaaggaggcccaagacgtcattatggaagtggtttttcctaatgaggtgggggctcggatcctgacctccgagtctcagctcacaattaccaaggagaaaaaggaggaactgcaggattgcaaaatcagcccgctgatggtcgcctatatgctcgagcgcgaactggtgagaaagacgcggttccttcccgtggcgggaggcacatccagcgtctacattgaggttctgcatctcacccagggcacatgttgggagcaaatgtatacccctgggggagaagtgaaaaacgacgatgtggaccagtctctgatcatcgccgctagaaatattgtccgccgggccgctgtgtccgccgatccccttgcgagcctgctcgagatgtgccactctacccagatcggcgggattagaatggttgacatcctgaagcagaaccctacagaagaacaagccgtgggaatttgtaaagctgccatgggcctgcgcatctccagctctttttccttcgggggatttacgttcaagcggaccagcggctcctctgtcaagagagaagaggaggtgctcacaggcaatctgcagacccttaaaatccgcgttcacgaagggtacgaggaatttacaatggtgggacggagagctaccgccattctgcgcaaggccacgcggagactcatccagctgattgtcagcggccgcgatgagcaatccatcgctgaagcgattatcgtggccatggtcttcagccaggaggactgcatgatcaaagctgtgagaggggaccttaactttgttaatcgggccaaccagcggctgaaccccatgcatcagctcctgcgccacttccaaaaggatgccaaagtgctgtttcagaattggggagtcgagccgattgacaacgtgatgggcatgatcgggattctccctgatatgacaccctctatcgaaatgtccatgagaggagttcggattagcaagatgggcgtggacgagtactctagcaccgaaagagtcgtggtgtccatcgatcgcttcctgcgggttagagaccagcgcggcaatgtccttctgtctcctgaggaggtgagcgaaacccaggggacagagaagctcaccattacatattccagctctatgatgtgggaaatcaacggacccgagtccgtgctggtcaatacgtaccaatggatcattagaaactgggaaaccgtgaaaatccagtggagccagaatcccacaatgctttataacaagatggagttcgagccttttcagtctctggttccgaaagctattcggggccaatactccgggttcgtgcgcaccctctttcagcagatgagagatgtcctgggaacattcgacaccgcccagatcattaagctgctcccctttgcggctgcccctcccaaacaaagccggatgcagttctcctcttttacggtgaatgttcgcggcagcgggatgagaatcctggtgcggggcaactcccctgtcttcaattataacaaggccaccaagcgccttacagtgctgggaaaagatgctggcaccctcacagaagaccccgatgaggggaccgccggagttgaatctgctgtgctgagaggctttctgatccttgggaaggaggaccggcgctacggaccggccctcagcattaatgaactgtccaacctggcgaaaggcgagaaggccaatgtcctcatcgggcagggcgacgtggtgctggtcatgaaaagaaagcgggatagctctattcttacggactcccaaacagctaccaagagaatccgcatggccattaac

SEQ ID NO: 43741 - RNA, 2277 nt, synthetic construct; identical to SEQ ID NO: 43740
  misc_feature 1..2277: note = derived and/or modified sequence opt5 from anti-influenza_Chain
  source 1..2277: mol_type = other RNA

SEQ ID NO: 43742 - RNA, 2472 nt, synthetic construct
  misc_feature 1..2472: note = derived and/or modified sequence opt5 from anti-influenza_Chain
  source 1..2472: mol_type = other RNA
atgatgctgagaaagaaaaccaagcagctcatcagctccattctgatccttgtgctgctcctgtctcttttccccgccgctctggccgcggagggcaacacacgggaagacaattttaaacacctcctggggaacgataatgtcaagcgccctagcgaggctggagccctgcaactccaggaagttgacggccagatgacgctggtggatcagcatggggagaaaattcaacttagaggaatgtccacccacggcctgcagtggttcccggaaatcctcaacgacaatgcctacaaggctctgtctaacgattgggacagcaatatgattcggcttgccatgtatgtgggggagaacggatacgctacaaatcccgagctgatcaagcagcgcgtcatcgatggcattgaactcgccatcgagaacgacatgtatgtgattgttgattggcatgtgcacgcgcctggcgaccccagagatcctgtctacgccggggctaaagactttttccgggaaatcgccgctctgtatcccaataaccctcatattatctacgagctggccaatgagccgtcctctaacaataacggaggcgcggggattcccaacaatgaagagggatggaaggccgtgaaagaatatgctgatcctatcgttgagatgctccgcaagagcggcaacgccgacgacaatatcattatcgtggggtcccccaactggagccagagacctgatctggctgccgacaatcccattgatgaccaccacaccatgtacacagtccatttttacaccggatctcacgccgcttccacagaaagctatccgtctgagacccctaactccgagcggggcaatgtgatgagcaacacgcgctacgcgcttgaaaatggcgtggccgtcttcgctaccgagtgggggacatctcaagcctccggagatggcgggccctattttgacgaagccgatgtttggatcgagttcctgaacgaaaataacattagctgggctaattggtccctcaccaacaaaaatgaggtgtctggagcctttacacctttcgagctgggcaagagcaacgcgaccaaccttgaccccgggcccgatcatgtgtgggctcctgaggaactgtccctcagcggagaatacgtcagagcccggatcaagggcgtgaattatgagccgatcgaccgcacgaaatacacaaaggttctgtgggattttaacgacggcaccaaacaggggttcggagtgaatagcgactcccccaacaaggaactgattgccgtcgataatgagaacaatacactcaaagtgagcggcctggacgtttctaacgatgtgagcgacgggaatttttgggctaacgccagactttccgctaatggatggggcaagtctgtcgatatcctgggggccgagaaactcaccatggacgtgattgtcgatgaacctaccacagtggcgatcgccgctattccccagagctccaagagcggctgggccaaccctgagcgggctgttcgcgtgaatgccgaagacttcgtccagcaaacggatggaaagtataaagcgggcctgaccatcacaggggaggacgcccccaaccttaagaatatcgctttccacgaggaagataacaacatgaataacattatcctgtttgtgggaaccgacgccgctgatgttatttacctcgacaatatcaaagtgattggcacagaggtcgaaatcccggtggtgcacgaccctaagggggaggccgttctgccctctgtcttcgaagatggaaccagacagggctgggactgggccggggagtccggcgtgaaaacggctctgacaattgaggaagcgaacggaagcaatgccctctcttgggagtttggctaccctgaagtgaagccctccgataactgggctaccgcccctcggctggacttctggaagtctgatcttgtcagaggggagaatgactatgtggcctttgatttctacctggaccccgttcgcgctaccgaaggagccatgaacatcaatctcgtgtttcagccgcctacaaacggctattgggtccaagcgcccaaaacctacacaatcaatttcgatgagctggaggaagctaaccaggtgaatgggctgtatcattacgaggttaagattaacgtgcgggacatcacgaatattcaggatgacacccttctcagaaacatgatgatcatttttgccgatgtcgaatccgacttcgccggacgcgtgtttgttgacaacgtgcggttcgagggcgctgccacaaccgaacccgtcgagcctgagccggtggatcccggggaagagacacctcccgtggacgaaaaagaggcgaagaaagagcagaaggaagctgagaaggaagagaaagaagccgtcaaggaggagaaaaaggaagccaaagaggaaaagaaggctgttaaaaatgaggccaagaaaaag

SEQ ID NO: 43743 - RNA, 2472 nt, synthetic construct; identical to SEQ ID NO: 43742
  misc_feature 1..2472: note = derived and/or modified sequence opt5 from anti-influenza_Chain
  source 1..2472: mol_type = other RNA

SEQ ID NO: 43744 - RNA, 3063 nt, synthetic construct
  misc_feature 1..3063: note = derived and/or modified sequence opt5 from anti-influenza_Chain
  source 1..3063: mol_type = other RNA
atggccggcccccacagaagccgggctgccgggcctccgcccttcgcggtggacgagcatgtcgctctggaaatggttgcctttcgcggagaggtgttcgccggccacgggctcctggctgatcagagacttatcgcccataccggacggcctgctctgaacgcccaacgcattacacagcagaagcagagagaccaatgccggggccagcgccacagacatcaccaagggggacggaatctccgcaaagcgcacagaacgtttcatgaacaccagtccacccaggatcaggcccatgacgctccccacggccagcaggccaagacaggccacgaggggctgggacatgaacacgctcaagcccagcatcagcaaggccagtctaacgtggtcgatcggcaggacggggagcctgtggaggcgcagcaccaaaaagatggagcccagcgcgctggcaatgcccccgctgggagagttgaacttgagcagcagcctgtggaagcccaacatcagcagcaggagggagacgtccggatcggcaagcgcagacaaaacgccttcgctccgcccgcgctggatcacgtgcacggcgggcctggacggctccagagacatggcctggccgttgagcgccacgtgcccgctgtccagcagcatcaacagcgggtgcagagagggcgccaacagattgaccacgtgctgggacacggcctccctgggcggcagagactggcctttcgcgatggaccccggagaccggtcggcgttgccagccctgtgcttggccagcgcccctgtcctgggcatcggatcgtgcaaaatctgttcagacacggaattgacccctgccgcgtcggccggtgtagacggtccccctctgaactccatgggatgggatgcgctgatgtgcgcgccagaggccacgggcggcatatgagaggccagcgcgacgagcaccctggacggggcagaccgtgtgcgcgcagacggcacgttgacgatgaccgcgatagaacaccccaggaaaaactgtacgacgtggctcgggggcttgatgagcctgcccgcagagtccattttgacgatgaagccgaccggagcgtgttccgcggactggctcagcccgcccctgatgagcccgagggcagacggcgcgacagactcgttctgcaacggcagtccgtgaaccacagacgcgggcggctgtctagacatcgccagcagcaccaaccgcagcagcaacggcctcatggaaatcaggcttttctcggcaagtatgaaaagagacgccggaaacccaccgcctgccttaagagcctgagacgcttccctgataaagacgcgcccgtcctgtactttgtgaaccagctcgagaagaccaaacggagaatgacactgcttctggtctggctcatcttcaccggggtggccggcgaaatccggctggaggctgaagacggagagctgctcggcgttgccgtggattccacgctgaccgggtatagcggacgcggctacgtcacagggtttgacgctcctgaggattctgtgagattctccttcgaagcgccccggggagtttatcgcgtggtctttggcgtgagcttctcttccagatttgccagctacgcccttcgggtggacgattggcaccagaccgggtctctgattaagagaggcggaggcttctttgaggcttccatcggggaaatttggctcgacgagggagcccacacaatggctttccaactgatgaatggcgcccttgattatgttcgcctggaaccggtcagctacgggcctcccgcccggccccctgctcagctctccgactctcaggcgaccgccagcgctcaggccctgtttgccttcctgctctccgagtacggaagacatatcctggctggccaacagcagaacccgtatcgccgggattttgacgccattaattacgtgagaaacgtgacggggaaggagcccgcgcttgtcagcttcgatctgatcgactattctcctacacgcgaagctcacggcgtggttcattaccagacccccgaggattggattgcctgggccggacgggacggcatcgtgtccctcatgtggcactggaatgctcctacagacctgatcgaagatcccagccaagactgttattggtggtacgggttttataccagatgcaccacattcgatgtcgccgcggctctggccgacacgtctagcgagcgctacagacttctcctgcgggatattgacgtgatcgccgctcagctgcagaaatttcagcaagccgatattcctgttctctggcgccccctgcacgaggctgccggaggctggttctggtggggagcgaaggggccggaacctttcaaacagctttggagactgctctacgagcggctggtgcatcaccatggcctgcacaaccttatctgggtctatacccatgaacccggcgccgctgagtggtaccctggggacgcctatgtggatattgttggacgcgacgtgtacgctgatgaccccgatgccctcatgagatccgactggaatgaactgcagacactgtttggcgggcggaagctcgtcgccctgaccgagacaggaacccttccggacgtggaggtgatcacggattatggcatctggtggtcttggttcagcatttggacagacccttttctgagagatgtcgaccccgatcgcctcacccgggtttaccactccgaaagagtgctgacccgcgacgagctgcctgattggcggagctatgtgcttcacgctacaaccgtccaacccgcgggggacctcgccctggctgtgtaccccaaccctggagccggcagactgcatgttgaagtgggcctcccggtcgccgctcccgtggttgtggaggtcttcaacctgcttgggcagcgggtgtttcagtaccaggccggaatgcaacctgcgggcctgtggcgcagagctttcgaactcgccctggcccccggggtttatctggtgcaggtccgggctggaaatcttgtggcccgcagacggtgggtgtctgtccgc

SEQ ID NO: 43745 - RNA, 3063 nt, synthetic construct; identical to SEQ ID NO: 43744
  misc_feature 1..3063: note = derived and/or modified sequence opt5 from anti-influenza_Chain
  source 1..3063: mol_type = other RNA

SEQ ID NO: 43746 - RNA, 3165 nt, synthetic construct
  misc_feature 1..3165: note = derived and/or modified sequence opt5 from anti-influenza_Chain
  source 1..3165: mol_type = other RNA
atgagaaagaaacggcgcggcttcctgaacgccagcaccgctgtgctcgtcgggatcctggccggatttcttggcgttgtgctggcggctacaggggccctcggattcgccgtgagagagtccctgcttctgaagcagtttctcttcctgtcttttgaaggcaatacggacggggctagccccttcggaaaagatgtcgtggttaccgcctcccaagacgtggctgccgatggcgagtactctctgaaggtcgaaaaccggacaagcgtgtgggacggcgttgagattgatctcaccgggaaagtgaatacaggaaccgactatctgctttcctttcacgtctaccagacatctgatagccctcagctgttctccgtgctcgcgcgcaccgaagacgagaagggcgagagatataagatcctggccgataaagtggtcgttccgaactactggaaggaaattcttgtgccctttagccctacgttcgaggggacccccgctaaattttctctgatcattacatcccctaagaaaaccgacttcgtgttttatgtcgataatgtgcaggttctcacacccaaggaagccggacctaaggtggtctacgagaccagcttcgagaaaggcatcggggactggcaaccgcggggatctgatgtgaagatctccattagccccaaagttgctcattctggcaagaaatccctgttcgtgagcaaccgccagaagggctggcacggggcccagatctccctgaaaggcattctcaagacgggaaagacatatgcgtttgaagcctgggtctaccaggagtctgggcaagaccagaccatcattatgacaatgcagagaaaatacagctccgacagctctaccaagtatgaatggatcaaagctgccaccgtgccttccggacagtgggtccaactgagcggcacatacacgattcccgctggggtgaccgttgaggatcttacactgtatttcgaatctcagaatcctaccctcgagttttacgtggacgatgtcaaggtggttgacacaaccagcgccgagatcaaactggaaatgaaccccgaggaagagatcccggcccttaaggatgtgctgaaggactatttccgggtcggagtggctctcccttccaaagtgtttattaatcagaaggatatcgcgctgatttctaaacatagcaactccagcacggccgaaaatgagatgaagcccgactctctgctcgctggcatcgagaacggcaaactgaagttccgctttgaaacagccgataagtacattgagttcgcccaacagaatgggatggttgtcagaggacacacccttgtgtggcataaccagacccctgaatggtttttcaaagacgagaatggcaacctgctctccaaggaagagatgacagagcggctgcgcgaatatatccacaccgtggtcgggcactttaaaggaaaggtgtacgcttgggatgttgtgaacgaggccgtcgaccccaatcagcccgacggccttagacggagcacatggtaccaaatcatggggcctgattatattgaactggcgttcaaatttgctcgcgaggccgacccgaacgccaaactcttctacaatgattataacacgttcgagcccaagaagagagacatcatttacaatctggtgaagtctctgaaagaaaagggcctcatcgatggaattggcatgcagtgccatatctccctggctaccgacatccggcagattgaggaagccatcaaaaagtttagcacaattcctgggatcgagattcacatcaccgaacttgatatttccgtttatagagactctacaagcaactactccgaggctccccgcaccgccctgatcgagcaggcgcataaaatggcccaactcttcaagatctttaagaaatattctaatgtgattacgaacgtcaccttctggggactgaaggatgactacagctggcgggctacaagacgcaatgattggcctctgatctttgacaaagattaccaggccaaacttgcttattgggccattgtggcgcccgaagttctcccgcctctgcccaaggagtccaagatcagcgaaggcgaggccgtggtcgtggggatgatggacgactcttacatgatgtccaagcctattgaaatctatgatgaggagggaaacgtgaaagctaccatccgggccatttggaaggacagcacaatctacgtctatggcgaagttcaggatgctaccaaaaagcccgccgaggacggggtggccattttcatcaatcctaacaatgaaagaacgccctacctgcagccggatgacacatatgtggtcctctggaccaactggaaatctgaggtgaatcgcgaagatgttgaggtgaagaagtttgtcggccctggattccggagatactcctttgagatgagcattacaatccccggcgtggagttcaaaaaggactcttacatcgggtttgatgttgctgtgattgacgatggaaaatggtatagctggtccgacaccaccaacagccaaaagacaaacacgatgaattacggcaccctgaaacttgaaggggtcatggtggcgacagccaagtatggaacccccgttatcgatggcgaaattgacgacatctggaacacaaccgaggagattgaaacgaagtctgtggctatggggtccctggagaaaaatgccacagccaaggtccgcgtgctctgggatgaagagaacctgtacgtgctggctatcgtcaaagaccctgttcttaataaggataacagcaatccgtgggaacaggactccgtggagatcttcattgatgagaacaatcacaaaaccggctattacgaagacgatgacgcccagtttcgggtgaactatatgaatgagcagtctttcggaaccggcgcgagcgctgccagattcaagacagccgtcaaactcatcgaagggggatacattgtggaggctgccatcaagtggaagaccattaaaccctcccctaacacagttatcggctttaatgtgcaagtcaacgatgcgaatgaaaaggggcagcgcgtgggaattatctcttggagcgaccccacgaacaactcctggcgggatccttctaaattcggcaatctgagactgatcaag

SEQ ID NO: 43747 - RNA, 3165 nt, synthetic construct; identical to SEQ ID NO: 43746
  misc_feature 1..3165: note = derived and/or modified sequence opt5 from anti-influenza_Chain
  source 1..3165: mol_type = other RNA

SEQ ID NO: 43748 - RNA, 3177 nt, synthetic construct
  misc_feature 1..3177: note = derived and/or modified sequence opt5 from anti-influenza_Chain
  source 1..3177: mol_type = other RNA
atgcaagtgagaaagcggcgcggcctgctcgacgtcagcaccgccgttctggtggggatccttgctggattcctgggcgtggtcctcgccgcgtccggggtgctgtcttttggaaaagaggctagctccaagggcgattctagccttgaaacagttctggccctctccttcgaggggacgaccgaaggagtggtcccctttggcaaagacgtggttctgacagcctctcaggatgtggctgccgacggcgagtacagcctgaaggtcgaaaacagaacctccccttgggatggggtggagattgacctcacaggaaaagtgaagtccggcgctgattatctgctttctttccaggtctaccagtccagcgacgccccgcagctgtttaatgttgtggcgcggaccgaggatgaaaagggggagcgctatgacgtgatcctcgataaagtcgtggtttctgaccactggaaggaaattctggtgcccttctcccctacatttgagggaacccccgccaaatacagccttatcattgtcgcttctaagaacacgaatttcaacttttatctggataaagtgcaagttctcgcccctaaggagtccggccccaaggtgatctacgaaaccagcttcgagaatggggtcggagactggcagcctagaggcgacgtgaacatcgaagctagctctgaggtcgcccatagcggcaaatccagcctgtttatttctaatcggcagaaggggtggcagggagcgcaaatcaacctgaaaggcattctcaagacagggaaaacctatgccttcgaggcttgggtgtaccaaaattccggacaggatcagacaatcattatgaccatgcagcgcaagtacagctctgacgccagcacgcagtatgaatggatcaaatccgctacagttccgtctggccagtgggtgcaactgagcgggacctacacaattcccgccggagtcaccgtggaggatcttaccctgtattttgaatcccagaaccctacactcgagttctacgttgacgatgtgaagatcgtcgacacgaccagcgccgaaatcaagattgagatggaacccgagaaagagatccctgctctgaaggaagtgcttaaagattatttcaaggtgggcgttgcgctgccctctaaagtctttctcaatccgaaggacattgagctgatcacaaagcacttcaactccattaccgccgaaaatgagatgaaacctgaaagcctgctcgctggcatcgagaacgggaagctgaaatttagattcgagacagccgataagtacatccagtttgtggaagagaatggaatggtgattcggggccatacccttgtctggcacaaccagacgcccgactggttctttaaagatgaaaacgggaatctgctctctaaggaggccatgacagagcgcctgaaggaatatatccataccgtggttggacacttcaaaggcaaggtgtacgcttgggacgtcgtgaacgaggccgttgaccctaatcaacccgatgggcttagacggtccacctggtaccagattatgggccccgactatatcgaactggcgtttaaattcgctcgcgaggccgatcctgacgccaagctcttttacaacgattataatacattcgaaccgagaaaacgggacattatctacaacctggtgaaggatctgaaggagaaaggactcatcgacggcattgggatgcagtgccacatcagcctggctaccgatattaagcagatcgaggaagccattaaaaagttttccacaatccccggaattgagatccatatcacggaacttgacatgtctgtctatcgcgatagctcctctaattaccctgaggctcccagaaccgccctgattgaacaagcgcacaaaatgatgcaactcttcgagatcttcaagaaatatagcaacgtgattacaaatgttaccttttggggcctgaaggacgattactcctggcgggccacaagacgcaacgactggcctctgatcttcgacaaggatcatcaggctaaacttgcctactgggctattgtggcccccgaggtcctcccgcctctgcccaaggaaagccggatctctgagggggaagcggtggtggtcggaatgatggacgattcctatctgatgagcaaacctatcgagattctcgacgaagagggcaatgttaaggccaccatcagagctgtgtggaaagattctacgatttacatctatggggaggtgcaggacaagaccaagaaacccgccgaagatggcgtcgctatttttatcaaccctaataacgagcgcacaccctacctgcagccggacgatacctatgccgtgctttggacaaattggaagaccgaagttaaccgggaggacgtgcaggtcaaaaagttcgtgggacctggctttagacgctactccttcgagatgagcatcacgattcccggggttgaatttaaaaaggattcttatatcggattcgacgccgctgtgattgatgacggcaagtggtacagctggtccgacacaaccaacagccagaaaacaaataccatgaactacgggaccctgaagctcgagggaatcatggtcgcgacagccaaatatggcacgcccgtgattgatggggaaatcgacgagatctggaataccacagaagagattgagaccaaggctgttgccatgggctctctggataaaaacgccacagctaaggtgcgggtcctgtgggacgaaaattacctttatgtgctcgccatcgtgaaggatcctgtcctgaacaaagacaattccaacccgtgggagcaggatagcgttgaaatttttatcgacgagaataaccacaagaccggatactatgaagatgacgatgcgcaattcagagtgaattacatgaacgagcagacgtttggcacagggggatcccccgctcgcttcaaaaccgccgtgaagctgattgagggcgggtatatcgtcgaagccgctattaaatggaagaccatcaaacctacacccaataccgtgatcggatttaacattcaggttaatgacgccaacgagaagggccaacgggtggggatcatttcttggagcgaccctacaaacaattcctggagagatccctctaagttcggcaacctccgcctgatcaaa

SEQ ID NO: 43749 - RNA, 3177 nt, synthetic construct; identical to SEQ ID NO: 43748
  misc_feature 1..3177: note = derived and/or modified sequence opt5 from anti-influenza_Chain
  source 1..3177: mol_type = other RNA

SEQ ID NO: 43750 - RNA, 318 nt, synthetic construct
  misc_feature 1..318: note = derived and/or modified sequence opt5 from anti-OX40_LightChain
  source 1..318: mol_type = other RNA
gagatcgtggtcacccagagccccgccacactgtccctctctcctggcgaaagagctacgctgagctgccgggcctcccaatctgttagctcctaccttgcgtggtatcagcagaagccggggcaggctccccgcctgctcatttacgacgcctctaacagagccaccggaatccctgctcggttcagcggctccgggagcggaacagattttaccctgacaatttcttcccttgagcccgaagacttcgccgtgtattactgtcaacagcgcagcaattggcctacctttggccaggggacaaaagtggagatcaag

SEQ ID NO: 43751 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccccctacctttggcgggggaacaaaagtggagattaag

SEQ ID NO: 43752 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacacacttccccctacctttgggcagggaacgaaagtggaaattaag

SEQ ID NO: 43753 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaaaccgttaagctgcttatttactatacatcccgcctgagatctggagtgccgagccggttctccggcagcgggtctggaaccgattttacactcaccatctccagcctgcaacccgaggacttcgccacatactattgtcagcagggccacacccttcctcccacgtttgggcagggaaccaaagtggaaattaag

SEQ ID NO: 43754 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaaaccgttaagctgcttatttactatacatcccgcctgagatctggagtgccgagccggttctccggcagcgggtctggaaaagattacaccctcacaatctccagcctgcaacccgaggactttgccacctatttctgtcagcagggccacacacttcctcccacctttgggcagggaacgaaggtggaaattaaa

SEQ ID NO: 43755 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacacacttcccgctacctttgggcagggaacgaaagtggaaattaag

SEQ ID NO: 43756 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacacagctccccctacctttgggcagggaacgaaagtggaaattaag

SEQ ID NO: 43757 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggcgctacacttccccctacctttgggcagggaacgaaagtggaaattaag

SEQ ID NO: 43758 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcttccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacgcccttccccctacatttgggcagggaaccaaagtggaaattaag

SEQ ID NO: 43759 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcaggctcacacacttccccctacctttggccaggggacgaaagtggaaattaag

SEQ ID NO: 43760 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacacacttgctcccacctttgggcagggaacgaaagtggaaattaag

SEQ ID NO: 43761 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctcccgcctgagatctggagttcccagccggttctccggcagcgggtctggaacagattttaccctcacaatctccagcctgcaacctgaggacttcgcgacctactattgtcaggctggccacacacttccccctacctttgggcagggaacgaaagtggaaattaag

SEQ ID NO: 43762 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcttccgtgggcgatagagtcacaattacgtgccgggcttctcaggacatcagcaactacctcaattggtatcagcagaagcctgggaaagccccgaagctgcttatttactatacctccaaactgcactctggagttcccagccgcttctccggcagcgggtctggaacagattacaccctcacaatctccagcctgcaacctgaggactttgcgacctattactgtcagcagggctctgcccttccctggacattcgggcagggaaccaaggtggaaattaaa

SEQ ID NO: 43763 - RNA, 321 nt, synthetic construct
  misc_feature 1..321: note = derived and/or modified sequence opt5 from anti-OX40_LightChain
  source 1..321: mol_type = other RNA
gacatccagatgacccaaagcccctcctctctgagcgcttccgtgggcgatagagtcacaattacgtgccgggcttctcaggacatcagcaactacctcaattggtatcagcagaagcctgggaaagccgttaagctgcttatttactatacctccaaactgcactctggagtgccgagccgcttctccggcagcgggtctagaacagattacaccctcacaatctccagcctgcaacccgaggactttgcgacctattactgtcagcagggatctgcccttccttggacattcggccaggggaccaaggtggaaattaaa

SEQ ID NO: 43764 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgtgctcgctccccgctggtatttctccgtctgggggcaaggaacactggtgaccgttagctct

SEQ ID NO: 43765 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccgttgacacatctaccagcacagcttacctggagctttccagcctgagatctgaagataccgccgtgtattactgtgtcctcgctccccggtggtatttctccgtgtgggggcaaggaacactggttaccgtgagctct

SEQ ID NO: 43766 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgctgaccgttgacacatctaccagcacagcttaccttgagctgtccagcctcagatctgaagataccgccgtgtattactgtgtcctggctccccggtggtatttctccgtgtgggggcaaggaacacttgttaccgtgagctct

SEQ ID NO: 43767 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagacgcgtatatgtcctgggtcagacaggctcctggccaggggctcgagtggatcggagatatgtacccggacaacggcgattctagctataatcagaagtttcgggaacgcgtgacgattaccagagacacatccacctctacagcctacctggagcttagctccctgcggagcgaagataccgccgtttattactgtgtgctcgctccccgctggtatttctctgtctgggggcaaggaacactggtgaccgtttccagc

SEQ ID NO: 43768 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagagtcctatatgtcttgggtcagacaggcgcctggccaggggctcgaatggatcggagacatgtacccggataacggcgacagctcctataatcagaagtttcgggagcgcgtgacgattaccagagatacatctaccagcacagcttacctggaactttccagcctgcggtctgaggacaccgccgtttattactgtgtgctcgctccccgctggtatttctccgtctgggggcaaggaacactggtgaccgttagctct

SEQ ID NO: 43769 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacgctgatagctcctataatcagaagtttcgggaacgcgtgacgattaccagagacacatctaccagcacagcctacctggagctttccagcctgcggtctgaagataccgccgtttattactgtgtgctcgctccccgctggtatttctccgtctggggccaagggacactggtgaccgttagctct

SEQ ID NO: 43770 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacaacgctgatgccagctataatcagaagtttcgggaacgcgtgacgattaccagagacacatccacctctacagcctacctggagcttagctccctgcggagcgaagataccgctgtttattactgtgtgctcgctccccgctggtatttctctgtctggggccaagggacactggtgaccgtttccagc

SEQ ID NO: 43771 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatgctagctataatcagaagtttcgggaacgcgtgacgattaccagagacacatccacctctacagcctacctggagcttagctccctgcggagcgaagataccgccgtttattactgtgtgctcgctccccgctggtatttctctgtctgggggcaaggaacactggtgaccgtttccagc

SEQ ID NO: 43772 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacagcggcgattcctcttataaccagaagtttcgggaacgcgtgacgattaccagagacacaagcacctccacagcttacctggagcttagctctctgcggtccgaagataccgccgtttattactgtgtgctcgctccccgctggtatttcagcgtctgggggcaaggaacactggtgaccgtttcttcc

SEQ ID NO: 43773 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcctccgtgaaggtgtcttgcaaagccagcggatacaccttcacagactcctatatgtcttgggtcagacaggcgcctggccaggggctcgagtggatcggagatatgtacccggacaacggcagctcctcttataatcagaagtttcgggaacgcgtgacgattaccagagatacaagcacctccacagcttacctggagcttagctctctgcggtccgaagacaccgccgtttattactgtgtgctcgctccccgctggtatttcagcgtctgggggcaaggaacactggtgaccgtttcttcc

SEQ ID NO: 43774 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagacgcgtatatgtcctgggtcagacaggctcctggccaggggctcgagtggatcggagatatgtacccggacaacgccgatgcctcttataatcagaagtttcgggaacgcgtgacgattaccagagacacaagcacctccacagcttacctggagctttctagcctgcggtccgaagataccgccgtttattactgtgtgctcgctccccgctggtatttcagcgtctggggccaagggacactggtgaccgtttcttcc

SEQ ID NO: 43775 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgtgctcgctccccgctggtatttctccgcctgggggcaaggaacactggtcaccgtgagctct

SEQ ID NO: 43776 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgtgctcgctccccgctggtatttcgccgtctgggggcaaggaacactggtgaccgtttccagc

SEQ ID NO: 43777 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgccctcgctccccgctggtatttctccgtgtgggggcaaggaacactggtcaccgtgagctct

SEQ ID NO: 43778 - RNA, 351 nt, synthetic construct
  misc_feature 1..351: note = derived and/or modified sequence opt5 from anti-OX40_HeavyChain
  source 1..351: mol_type = other RNA
gaggtgcagctggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgtggccgctccccgctggtatttctccgtctgggggcaaggaacactcgtgaccgttagctct

SEQ ID NO: 43779 - RNA, 354 nt, synthetic construct
  misc_feature 1..354: note = derived and/or modified sequence opt5 from anti-OX40_HeavyChain
  source 1..354: mol_type = other RNA
gaggtgcagctggtcgaaagcggcgggggactcgttcaacccggcgggtccctgagactttcttgcgccgctagcggattcaccttttcctcttacagcatgaattgggtgcggcaggcccctggcaaggggctggagtgggtgtcctatatctctagctccagctctacaattgactacgcggattccgtcaaaggacgcttcacgatcagcagagacaatgctaagaactctctctatctgcagatgaactcccttcgggatgaagacaccgccgtgtactattgtgcccgcgagagcggctggtacctgtttgattattggggccaggggacactcgttaccgtgtcttcc

SEQ ID NO: 43780 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagacagcacccgggaaaaggcctggaatggattgggtacatcagctataatggaattacgtaccataacccctccctcaagtctcggatcaccattaatcctgacacaagcaaaaaccaattttccctgcagcttaatagcgtgacccccgaggatacagctgtgtattactgtgcccgctatagatacgactacgatggcggccacgcgatggactattgggggcagggaaccctggtcacagtgtcttcc

SEQ ID NO: 43781 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatggattgggtacatcagctataatggaattacgtaccataacccctccctcaaatctcggatcaccattaatcgcgacacaagcaagaaccagttttccctgcaacttaatagcgtgacccctgaggatacagctgtgtattactgtgccagatatcggtacgactacgatggcggccacgcgatggactattgggggcagggaaccctggtcacagtgtcttcc

SEQ ID NO: 43782 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggagacagcttctcctctggctattggaactggatcagaaaacacccggggaagggactggaatacatgggctatattagctacaatgggatcacgtatcataacccctccctcaaatctcggattaccatcaatcgcgatacaagcaagaaccagtactccctgcaacttaatagcgtgacccctgaggacacagctgtgtatttttgtgccagataccggtacgattatgacggaggccacgcgatggattactggggccaggggaccctggtcacagtgtcttcc

SEQ ID NO: 43783 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggagacagcttctcctctggctattggaactggatcagaaaacacccggggaagggactggaatacattggctatatcagctacaatgggattacgtatcataacccctccctcaaatctcggatcaccattaatcgcgatacaagcaagaaccagtactccctgcaacttaatagcgtgacccctgaggacacagctgtgtatttttgtgccagataccggtacgattatgacggaggccacgcgatggattactggggccaggggaccctggtcacagtgtcttcc

SEQ ID NO: 43784 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggagacagcttctcctctggctattggaactggatcagaaaacacccggggaagggactggaatacattggctatatcagctacaatgggattacgtatcataacccctccctcaaatctcggatcaccattaatcgcgatacaagcaagaaccagttttccctgcaacttaatagcgtgacccctgaggacacagctgtgtacttctgtgccagatatcggtacgattacgacggaggccacgcgatggattattggggccaggggaccctggtcacagtgtcttcc

SEQ ID NO: 43785 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggagacagcttctcctctggctattggaactggatcagaaaacacccggggaagggactggaatacattggctatatcagctacaatgggattacgtatcataacccctccctcaaatctcggatcaccattaatcgcgatacaagcaagaaccagtactccctgcaacttaatagcgtgacccctgaggacacagctgtgtattactgtgccagataccggtatgattacgacggaggccacgcgatggattattggggccaggggaccctggtcacagtgtcttcc

SEQ ID NO: 43786 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggagacagcttctcctctggctattggaactggatcagaaaacacccggggaagggactggaatacattggctatatcagctacaatgggattacgtatcataacccctccctcaaatctcggatcaccattaatcgcgatacaagcaagaaccagttttccctgcaacttaatagcgtgacccctgaggacacagctgtgtactattgtgccagataccggtacgattatgacggaggccacgcgatggattactggggccaggggaccctggtcacagtgtcttcc

SEQ ID NO: 43787 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcctgacacaagcaagaaccagtactccctgcaacttaatagcgtgacccccgaggatacagctgtgtatttttgtgcccgctacagatacgactatgatggcggccacgcgatggactactgggggcagggaaccctggtcacagtgtcttcc

SEQ ID NO: 43788 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcgcgacacaagcaagaaccagtactccctgcaacttaatagcgtgacccctgaggatacagctgtgtatttttgtgccagataccggtacgactatgatggcggccacgcgatggactactgggggcagggaaccctggtcacagtgtcttcc

SEQ ID NO: 43789 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcgcgacacaagcaagaaccagtactccctgcaacttaatagcgtgacccctgaggatacagctgtgtattactgtgccagataccggtatgactacgatggcggccacgcgatggactattgggggcagggaaccctggtcacagtgtcttcc

SEQ ID NO: 43790 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcctgacacaagcaagaaccagtactccctgcaacttaatagcgtgacccccgaggatacagctgtgtattactgtgcccgctacagatatgactacgatggcggccacgcgatggactattgggggcagggaaccctggtcacagtgtcttcc

SEQ ID NO: 43791 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatgctattacgtatcataacccctccctcaaatctcggatcaccattaatcgcgacacaagcaagaaccagtactccctgcaacttaatagcgtgacccctgaggatacagccgtgtattactgtgcgagatacaaatatgactacgatgctggacacgccatggactattggggccagggcaccctggtcacagtgtcttcc

SEQ ID NO: 43792 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatgctattacgtatcataacccctccctcaaatctcggatcaccattaatcgcgacacaagcaagaaccagtactccctgcaacttaatagcgtgacccctgaggatacagccgtgtattactgtgcgagataccggtatgactacgatggaggccacgctatggactattggggccaggggaccctggtcacagtgtcttcc

SEQ ID NO: 43793 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcgcgacacaagcaagaaccagtactccctgcaacttaatagcgtgacccctgaggatacagctgtgtattactgtgccagatacaaatatgactacgatggcggccacgcgatggactattgggggcagggaaccctggtcacagtgtcttcc

SEQ ID NO: 43794 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctactccggaattacgtatcataatccctctctcaaaagccggatcaccattaaccgcgacacatccaagaatcagtacagcctgcaacttaactctgtgacccctgaggatacagctgtgtattactgtgccagataccggtatgactacgatggcggccacgcgatggactattgggggcagggaaccctggtcacagtgtccagc

SEQ ID NO: 43795 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctactccggaattacgtatcataatccctctctcaaaagccggatcaccattaaccgcgacacatccaagaatcagtacagcctgcaacttaactctgtgacccctgaggatacagctgtgtattactgtgccagatacaaatatgactacgatggcggccacgcgatggactattgggggcagggaaccctggtcacagtgtccagc

SEQ ID NO: 43796 - RNA, 363 nt, synthetic construct
  misc_feature 1..363: note = derived and/or modified sequence opt5 from anti-OX40_HeavyChain
  source 1..363: mol_type = other RNA
gaggtgcagctgcaagaaagcggcccctccctcgtcaagccttctcagaccctgagccttacatgctccgttacgggggactctttcaccagcggatactggaactggatcagaaaatttccgggcaatcggctggagtatatggggtacatttcctataacgccatcacataccacaatccctctctcaagagccgcatttccatcaccagagatacaagcaaaaaccattattacctgcagcttaattctgtgaccacagaagacaccgctacgtatttctgtgcccggtaccgctacgattatgacggaggccacgcgatggattactgggggcagggaaccctggtgacagtctccagc

SEQ ID NO: 43797 - RNA, 363 nt, synthetic construct
  misc_feature 1..363: note = derived and/or modified sequence opt5 from anti-OX40_HeavyChain
  source 1..363: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatgctattacgtatcataacccctccctcaaatctcggatcaccattaatcgcgacacaagcaagaaccagtactccctgcaacttaatagcgtgacccctgaggatacagccgtgtattactgtgcgagatacaaatatgactacgatggaggccacgctatggactattggggccaggggaccctggtcacagtgtcttcc

SEQ ID NO: 43798 - RNA, 372 nt, synthetic construct
  misc_feature 1..372: note = derived and/or modified sequence opt5 from anti-OX40_HeavyChain
  source 1..372: mol_type = other RNA
gaggtgcagctggtcgaaagcggcgggggactcgttcaacccggcagatccctgcggctttcttgcgccgctagcgggttcacctttgacgattacgccatgcactgggtgcgccaggcgcctggaaagggcctggagtgggtgtccgggatctcttggaacagcggatccattggctatgctgactctgtcaaaggcagattcacaatcagccgggataatgccaagaactccctctacctgcagatgaatagccttcgcgccgaagacacggctctgtattactgtgccaaagatcagtctaccgctgactattacttttattacgggatggatgtgtggggacaaggcacaaccgttacagtgtccagc

SEQ ID NO: 43799 - RNA, 381 nt, synthetic construct
  misc_feature 1..381: note = derived and/or modified sequence opt5 from anti-OX40_LightChain
  source 1..381: mol_type = other RNA
atggagacccccgcccagctcctgttcctgcttctgctctggctgcctgacacaacgggcgaaatcgtgcttacccaaagcccggggacactgtccctctctcccggagagagagctattctgagctgccgggcctcccagtctgtcagctcctcttttctggcgtggtaccagcagaagcctggccaagctccccgcctcctgatctatggggccttcagcagagccaccggcattcctgatcggttttccggaagcgggtctggaacagacttcacccttacaatctcccgcctggaacccgaggattttgctgtttactattgtcagcagtacgacagctctagaaccttcggccagggcacgaaagtggaaattaag

SEQ ID NO: 43800 - RNA, 381 nt, synthetic construct
  misc_feature 1..381: note = derived and/or modified sequence opt5 from anti-OX40_LightChain
  source 1..381: mol_type = other RNA
atggaggcccccgctcagctcctgttcctgcttctgctctggctgcctgacaccacaggcgaaatcgtgcttacgcaaagcccggccaccctgtccctctctcccggggagagagcgacactgagctgccgggcttcccagggagtctctagctacctggcctggtatcagcagaagcctggccaagctccccgcctcctgatttacgatgcctccaacagagccaccgggatccctgctcggttttctggaagcggccccgggacagacttcacccttacaatttccagcctggaacctgaggattttgccgtttattactgtcagcagcgctctaattggcacccgaccttcggacagggcacgaaagtggaaatcaag

SEQ ID NO: 43801 - RNA, 381 nt, synthetic construct
  misc_feature 1..381: note = derived and/or modified sequence opt5 from anti-OX40_LightChain
  source 1..381: mol_type = other RNA
atggaggcccccgctcagctcctgttcctgcttctgctctggctgcctgacaccacaggcgaaatcgtgcttacgcaaagcccggccaccctgtccctctctcccggggagagagcgacactgagctgccgggcttcccagtctgtcagctcctacctggcctggtatcagcagaagcctggacaagctccccgcctcctgatttacgatgcctctaacagagccaccggcatccctgctcggtttagcgggtccggaagcggcacagacttcacccttacaatttcttccctggaacccgaggattttgccgtttattactgtcagcagcgcagcaattggcctatcaccttcgggcagggaacgagactcgaaattaaa

SEQ ID NO: 43802 - RNA, 387 nt, synthetic construct
  misc_feature 1..387: note = derived and/or modified sequence opt5 from anti-OX40_LightChain
  source 1..387: mol_type = other RNA
atggagacccccgcccagctcctgttcctgcttctgctctggctgcctgacacaacgggcgaaatcgtgcttacccaaagcccggggacactgtccctctctcccggagagagagctaccctgagctgccgggcctcccagtctgtcagctcctcttacctggcgtggtatcagcagaagcctggccaagctccccgcctcctgatttacggggccagctccagagccacaggaatccctgatcggtttagcggctctgggtccggaaccgacttcacacttaccattagccgcctggaacccgaggattttgctgtttattactgtcagcagtatgactcttccctcacgttcggcggcgggaccaaagtggaaatcaagagaaca

SEQ ID NO: 43803 - RNA, 390 nt, synthetic construct
  misc_feature 1..390: note = derived and/or modified sequence opt5 from anti-OX40_LightChain
  source 1..390: mol_type = other RNA
atggacatgagagtgctggcccagctcctgggccttctgctcctgtgcttccccggggctcggtgtgatatccaaatgacccagagcccttcctctcttagcgcctccgtcggaaaccgcgttacaattacgtgcagagcgtctcaggacatcagctcctggctggcttggtaccagcaaaagccggagaaagcccccaagtctctcatttatgccgctagctccctgcagagcggcgtgccttctcggttttccgggagcggatctggcaccgatttcacactgaccatctccagcctccagcccgaagactttgccacatactattgtcagcaatacaattcttatcctctgaccttcgggcagggaacacgccttgagattaaaaga

SEQ ID NO: 43804 - RNA, 408 nt, synthetic construct
  misc_feature 1..408: note = derived and/or modified sequence opt5 from anti-OX40_HeavyChain
  source 1..408: mol_type = other RNA
atggacaccctgtgcagcacactcctgcttctgacgatcccctcctgggtgctctctcagattaccctgaaggagagcggccctacacttgtcaaaccgacccaaacactgaccctctcctgtacattctctgggtttagcctgtccacctctggagttggcgtggggtggatcagacagccccctggaaaggccctggaatggctcgctctgattcactgggatgacgccgagcggtacagcccctcccttaaaagccgcctgacgatcaccaaggatacatctaaaaaccaggtggtcctcaccatgacaaatatggacctggtggataccgcgacgtattactgcgctcatacaagaggcgccttcgacatttgggggcagggaaccatggttacagtgtccagc

SEQ ID NO: 43805 - RNA, 408 nt, synthetic construct
  misc_feature 1..408: note = derived and/or modified sequence opt5 from anti-OX40_HeavyChain
  source 1..408: mol_type = other RNA
atggacaccctgtgcagcacactcctgcttctgacgatcccctcctgggtgctctctcagattaccctgaaggagagcggccctacacttgtcaaaccgacccaaacactgaccctcacatgtaccttctccgggttttctctgagcacgtccggagttggcgtggggtggatcagacagccccctggaaaggccctggaatggctcgctctgatttactgggatgaccactctccctatagcccttcccttaaaagccggctgaccatcacaaaggatacctctaaaaaccaggtggtcctcacaatgaccaatatggaccccgtggatacggccacatactattgcgcgcgcaccagaggcgctttcgacatttgggggcagggaacaatggttaccgtgtccagc

SEQ ID NO: 43806 - RNA, 420 nt, synthetic construct
  misc_feature 1..420: note = derived and/or modified sequence opt5 from anti-OX40_HeavyChain
  source 1..420: mol_type = other RNA
atggagtggggcccctgctgggtgttcctggtcgttatcctcgaaggggtgcagtgtggagtgcaactggtcgagagcggcgggggacttgtgcagcctggcgggtccctgagactctcttgcgccgctagcggatttaccttctcctcttacagcatgaactgggttcggcaggccccgggcaagggcctggaatgggtgtcctatatttctagctccagctctacaatctactatgcggactccgtcaaagggcgctttacgattagcagagataatgctaagaactctctttacctgcagatgaactccctccgggacgaggataccgccgtgtattactgtgcccgcggagtttatcacaatggctggagcttctttgactactgggggcaaggaacactgctgaccgtgtcttcc

SEQ ID NO: 43807 - RNA, 423 nt, synthetic construct
  misc_feature 1..423: note = derived and/or modified sequence opt5 from anti-OX40_HeavyChain
  source 1..423: mol_type = other RNA
atggacaccctgtgcagcacactcctgcttctgacgatcccctcctgggtgctctctcagattaccctgaaggagagcggccctacacttgtcaaaccgaagcaaaccctgacactcacctgtacattctccgggttttctctgagcacctccggaatgggcgttgggtggatcagacagccccctggaaaagccctggaatggctcgctgtgatttactgggatgaccaccagctgtattctcccagccttaagtcccggctgacgatcaccaaagatacaagcaagaaccaggtggtcctcaccatgacaaatatggaccctgtggataccgccacgtactattgcgcgcatcgcagaggcgctttccaacactgggggcagggaacactggttaccgtgtcttccgccagcacaaagggc

SEQ ID NO: 43808 - RNA, 462 nt, synthetic construct
  misc_feature 1..462: note = derived and/or modified sequence opt5 from anti-OX40_HeavyChain
  source 1..462: mol_type = other RNA
atgaccatgatcacacccagcctggtgccttcctctgacccgctcgtcacggccgctagcgttctggagttcgcccttctgattagactcaccatcggccaggcggtggtgtccacacaatctaccgggggaggcctggtccagcccgggcggagccttcgcctgtcctgcgctgcctctggatttacactcgatgactacggcatgcactgggtgagacaggcccctgggaagggactggaatgggttagcggcatttcctggaatagcgattctatcggctatgtggactccgtcaaagggcggttcaccattagccgcgataatgctaagaactctctgtacctccagatgaactccctgagagtggaggacacagccctttattactgtgttaaagatatcagcggatggtattcttttgactactggggccaagggaccctggtgacggtctccagc

SEQ ID NO: 43809 - RNA, 639 nt, synthetic construct
  misc_feature 1..639: note = derived and/or modified sequence opt5 from anti-OX40_LightChain
  source 1..639: mol_type = other RNA
gagatcgtggtcacccagagccccgccacactgagcctctctcctggcgaaagagctacgctgagctgccgggcctcccaatctgttagctcctaccttgcgtggtatcagcagaagccggggcaggctccccgcctgctcatttacgacgcctctaacagagccaccggaatccctgctcggttcagcggctccgggagcggaacagattttaccctgacaatttcttcccttgagcccgaagacttcgccgtgtattactgtcaacagcgcagcaattggcctacctttggccaggggacaaaagtggagatcaagagaaccgtcgctgccccctctgtgttcatttttcctccgtccgatgaacagctgaaaagcggaacggcgtctgttgtgtgcctcctgaacaatttctatccccgggaggccaaggtccaatggaaagtggacaacgctctgcagtccggcaatagccaggagtccgttaccgaacaggattctaaggacagcacatactccctcagctctaccctgacactttccaaggccgattatgagaaacacaaggtgtacgcttgtgaagtcacccatcaaggcctgagctctcctgtgacgaaatcctttaaccgcggggagtgc

SEQ ID NO: 43810 - RNA, 1350 nt, synthetic construct
  misc_feature 1..1350: note = derived and/or modified sequence opt5 from anti-OX40_HeavyChain
  source 1..1350: mol_type = other RNA
gaggtgcagctggtcgaaagcggcgggggactcgttcaacccggcagatccctgcggctttcttgcgccgctagcgggttcacctttgacgattacgccatgcactgggtgcgccaggcgcctggaaagggcctggagtgggtgtccgggatctcttggaacagcggatccattggctatgctgactctgtcaaaggcagattcacaatcagccgggataatgccaagaactccctctacctgcagatgaatagccttcgcgccgaagacacggctctgtattactgtgccaaagatcagtctaccgctgactattacttttattacgggatggatgtgtggggacaaggcacaaccgttacagtgtccagcgcctctaccaaggggccgtccgtcttccccctcgcgccttgcagcagatctacatccgagagcaccgccgctctgggatgtctggtgaaagactactttcccgaacctgttacggtgtcctggaactctggcgccctcaccagcggggtccatacattccccgctgtgctgcagtccagcggactttattctctgtccagcgtggtcaccgttccttctagcaattttggcacacagacctacacgtgcaacgtggatcacaagccgtccaatacaaaggtggacaaaaccgtcgagcggaagtgttgcgtggagtgtcccccttgccccgcccctcccgttgcgggcccgtctgtgttcctctttcctcccaaacctaaggatacactgatgattagccgcacccccgaagtcacctgtgtggttgtggacgtctcccatgaggatcccgaagtgcagttcaactggtatgtcgacggggtggaggttcacaatgccaaaacaaagcctagagaggaacaatttaacagcacgttccgggtggtctctgtgcttaccgttgtgcatcaggactggctgaatggaaaggagtacaaatgcaaggtctccaacaaaggcctcccggctcccatcgaaaagacaattagcaaaaccaaggggcagcctcgcgagccccaggtgtatacactgcctccctctagagaagagatgaccaaaaatcaagtgtccctgacgtgtctcgttaagggattttacccgagcgatatcgccgtcgagtgggaatccaacggccagcctgagaataactataagacaacaccccctatgctggactctgatgggagcttcttcctttactccaaactgaccgtggacaagtctcggtggcagcaaggaaacgtgtttagctgctccgtcatgcacgaagctctccacaatcattacacccagaaaagcctgtctctttcccccggcaag

SEQ ID NO: 43811 - RNA, 21 nt, synthetic construct
  misc_feature 1..21: note = derived and/or modified sequence opt5 from anti-HIV_VRC01_VRC02_NIH45-46_LightChain_CDR
  source 1..21: mol_type = other RNA
tgccagcaatacgagttcttt

SEQ ID NO: 43812 - RNA, 42 nt, synthetic construct; identical to SEQ ID NO: 28528
  misc_feature 1..42: note = derived and/or modified sequence opt5 from anti-HIV_VRC01_HeavyChain_CDR
  source 1..42: mol_type = other RNA

SEQ ID NO: 43813 - RNA, 21 nt, synthetic construct
  misc_feature 1..21: note = derived and/or modified sequence opt5 from anti-HIV_3BNC60_LightChain_CDR
  source 1..21: mol_type = other RNA
tgccaggtgtacgagttcatc

SEQ ID NO: 43814 - RNA, 36 nt, synthetic construct
  misc_feature 1..36: note = derived and/or modified sequence opt5 from anti-HIV_3BNC60_HeavyChain_CDR
  source 1..36: mol_type = other RNA
gccagacagcggagcgacttctgggattttgacgtg

SEQ ID NO: 43815 - RNA, 36 nt, synthetic construct; identical to SEQ ID NO: 28531
  misc_feature 1..36: note = derived and/or modified sequence opt5 from anti-HIV_5H/I1-BMV-D5_HeavyChain_CDR
  source 1..36: mol_type = other RNA

SEQ ID NO: 43816 - RNA, 33 nt, synthetic construct; identical to SEQ ID NO: 28532
  misc_feature 1..33: note = derived and/or modified sequence opt5 from anti-HIV_8ANC195_LightChain_CDR
  source 1..33: mol_type = other RNA

SEQ ID NO: 43817 - RNA, 33 nt, synthetic construct; identical to SEQ ID NO: 28533
  misc_feature 1..33: note = derived and/or modified sequence opt5 from anti-HIV_CH01_CH02_CH03_LightChain_CDR
  source 1..33: mol_type = other RNA

SEQ ID NO: 43818 - RNA, 78 nt, synthetic construct
  misc_feature 1..78: note = derived and/or modified sequence opt5 from anti-HIV_CH01_HeavyChain_CDR
  source 1..78: mol_type = other RNA
gccagaggcaccgactacacaatcgatgacgctgggattcactatcagggaagcggcacgttctggtactttgatctg

SEQ ID NO: 43819 - RNA, 78 nt, synthetic construct
  misc_feature 1..78: note = derived and/or modified sequence opt5 from anti-HIV_CH02_HeavyChain_CDR
  source 1..78: mol_type = other RNA
gccagaggcaccgactacacaatcgatgaccaggggcggttctatcaaggaagcggcacgttttggtacttcgatttt

SEQ ID NO: 43820 - RNA, 78 nt, synthetic construct
  misc_feature 1..78: note = derived and/or modified sequence opt5 from anti-HIV_CH03_HeavyChain_CDR
  source 1..78: mol_type = other RNA
gccagaggcaccgactacacaatcgatgaccaggggattttctataagggaagcggcacgttttggtacttcgatctg

SEQ ID NO: 43821 - RNA, 33 nt, synthetic construct; identical to SEQ ID NO: 28537
  misc_feature 1..33: note = derived and/or modified sequence opt5 from anti-HIV_CH04_LightChain_CDR
  source 1..33: mol_type = other RNA

SEQ ID NO: 43822 - RNA, 78 nt, synthetic construct
  misc_feature 1..78: note = derived and/or modified sequence opt5 from anti-HIV_CH04_HeavyChain_CDR
  source 1..78: mol_type = other RNA
gccagaggcaccgactacacaatcgatgaccaggggattcggtatcaaggaagcggcacgttctggtactttgatgtg

SEQ ID NO: 43823 - RNA, 54 nt, synthetic construct
  misc_feature 1..54: note = derived and/or modified sequence opt5 from anti-HIV_NIH45-46_HeavyChain_CDR
  source 1..54: mol_type = other RNA
accagaggcaagtactgcacagcccgggactattacaactgggatttcgagcac

SEQ ID NO: 43824 - RNA, 90 nt, synthetic construct; identical to SEQ ID NO: 28540
  misc_feature 1..90: note = derived and/or modified sequence opt5 from anti-HIV_PG16_HeavyChain_CDR
  source 1..90: mol_type = other RNA

SEQ ID NO: 43825 - RNA, 36 nt, synthetic construct
  misc_feature 1..36: note = derived and/or modified sequence opt5 from anti-HIV_PGT122_LightChain_CDR
  source 1..36: mol_type = other RNA
cacatctgggacagcagacggcccaccaactgggtg

SEQ ID NO: 43826 - RNA, 72 nt, synthetic construct
  misc_feature 1..72: note = derived and/or modified sequence opt5 from anti-HIV_PGT122_HeavyChain_CDR
  source 1..72: mol_type = other RNA
accaagcacggcagacggatctacggggtggtcgccttcaaagagtggtttacatatttctacatggacgtt

SEQ ID NO: 43827 - RNA, 36 nt, synthetic construct; identical to SEQ ID NO: 28543
  misc_feature 1..36: note = derived and/or modified sequence opt5 from anti-HIV_PGT123_LightChain_CDR
  source 1..36: mol_type = other RNA

SEQ ID NO: 43828 - RNA, 72 nt, synthetic construct
  misc_feature 1..72: note = derived and/or modified sequence opt5 from anti-HIV_PGT123_HeavyChain_CDR
  source 1..72: mol_type = other RNA
gccctgcacggcaagagaatctacgggattgtggctctcggagagctgttcacctatttttacatggacgtc

SEQ ID NO: 43829 - RNA, 30 nt, synthetic construct; identical to SEQ ID NO: 13261
  misc_feature 1..30: note = derived and/or modified sequence opt5 from anti-HIV_PGT125_PGT128_LightChain_CDR
  source 1..30: mol_type = other RNA

SEQ ID NO: 43830 - RNA, 57 nt, synthetic construct; identical to SEQ ID NO: 28546
  misc_feature 1..57: note = derived and/or modified sequence opt5 from anti-HIV_PGT125_HeavyChain_CDR
  source 1..57: mol_type = other RNA

SEQ ID NO: 43831 - RNA, 30 nt, synthetic construct; identical to SEQ ID NO: 13263
  misc_feature 1..30: note = derived and/or modified sequence opt5 from anti-HIV_PGT126_PGT127_LightChain_CDR
  source 1..30: mol_type = other RNA

SEQ ID NO: 43832 - RNA, 57 nt, synthetic construct; identical to SEQ ID NO: 28548
  misc_feature 1..57: note = derived and/or modified sequence opt5 from anti-HIV_PGT126_HeavyChain_CDR
  source 1..57: mol_type = other RNA

SEQ ID NO: 43833 - RNA, 57 nt, synthetic construct; identical to SEQ ID NO: 28549
  misc_feature 1..57: note = derived and/or modified sequence opt5 from anti-HIV_PGT127_HeavyChain_CDR
  source 1..57: mol_type = other RNA

SEQ ID NO: 43834 - RNA, 57 nt, synthetic construct; identical to SEQ ID NO: 28550
  misc_feature 1..57: note = derived and/or modified sequence opt5 from anti-HIV_PGT128_HeavyChain_CDR
  source 1..57: mol_type = other RNA

SEQ ID NO: 43835 - RNA, 30 nt, synthetic construct; identical to SEQ ID NO: 28551
  misc_feature 1..30: note = derived and/or modified sequence opt5 from anti-HIV_PGT130_LightChain_CDR
  source 1..30: mol_type = other RNA

SEQ ID NO: 43836 - RNA, 57 nt, synthetic construct; identical to SEQ ID NO: 28552
  misc_feature 1..57: note = derived and/or modified sequence opt5 from anti-HIV_PGT130_HeavyChain_CDR
  source 1..57: mol_type = other RNA

SEQ ID NO: 43837 - RNA, 30 nt, synthetic construct; identical to SEQ ID NO: 28553
  misc_feature 1..30: note = derived and/or modified sequence opt5 from anti-HIV_PGT131_LightChain_CDR
  source 1..30: mol_type = other RNA

SEQ ID NO: 43838 - RNA, 57 nt, synthetic construct; identical to SEQ ID NO: 28554
  misc_feature 1..57: note = derived and/or modified sequence opt5 from anti-HIV_PGT131_HeavyChain_CDR
  source 1..57: mol_type = other RNA

SEQ ID NO: 43839 - RNA, 27 nt, synthetic construct
  misc_feature 1..27: note = derived and/or modified sequence opt5 from anti-HIV_PGT135_PGT136_PGT137_LightChain_CDR
  source 1..27: mol_type = other RNA
cagcaatacgaggaatggcccagaacc

SEQ ID NO: 43840 - RNA, 54 nt, synthetic construct; identical to SEQ ID NO: 28556
  misc_feature 1..54: note = derived and/or modified sequence opt5 from anti-HIV_PGT135_HeavyChain_CDR
  source 1..54: mol_type = other RNA

SEQ ID NO: 43841 - RNA, 54 nt, synthetic construct; identical to SEQ ID NO: 28557
  misc_feature 1..54: note = derived and/or modified sequence opt5 from anti-HIV_PGT136_HeavyChain_CDR
  source 1..54: mol_type = other RNA

SEQ ID NO: 43842 - RNA, 54 nt, synthetic construct; identical to SEQ ID NO: 28558
  misc_feature 1..54: note = derived and/or modified sequence opt5 from anti-HIV_PGT137_HeavyChain_CDR
  source 1..54: mol_type = other RNA

SEQ ID NO: 43843 - RNA, 27 nt, synthetic construct
  misc_feature 1..27: note = derived and/or modified sequence opt5 from anti-HIV_PGT141_PGT142_PGT143_PGT144_LightChain_CDR
  source 1..27: mol_type = other RNA
atgcagggcctgaacagaccctggacc

SEQ ID NO: 43844 - RNA, 96 nt, synthetic construct
  misc_feature 1..96: note = derived and/or modified sequence opt5 from anti-HIV_PGT141_HeavyChain_CDR
  source 1..96: mol_type = other RNA
ggcagcaagcacagactgcgggactacgtgctctatgatgactacgggctgatcaactatcaggaatggaatgattaccttgagttcctggacgtc

SEQ ID NO: 43845 - RNA, 96 nt, synthetic construct
  misc_feature 1..96: note = derived and/or modified sequence opt5 from anti-HIV_PGT144_HeavyChain_CDR
  source 1..96: mol_type = other RNA
ggcagcaagcacagactgcgggactacgtgctctatgatgactacgggctgatcaaccagcaagaatggaatgattatcttgagttcctggacgtc

SEQ ID NO: 43846 - RNA, 27 nt, synthetic construct
  misc_feature 1..27: note = derived and/or modified sequence opt5 from anti-HIV_PGT145_LightChain_CDR
  source 1..27: mol_type = other RNA
atgcagggcctgcacagcccctggacc

SEQ ID NO: 43847 - RNA, 93 nt, synthetic construct
  misc_feature 1..93: note = derived and/or modified sequence opt5 from anti-HIV_PGT145_HeavyChain_CDR
  source 1..93: mol_type = other RNA
ggcagcaagcacagactgcgggactacttcctctataacgagtacgggcccaattatgaagagtggggagattacctggccacccttgacgtg

SEQ ID NO: 43848 - RNA, 21 nt, synthetic construct
  misc_feature 1..21: note = derived and/or modified sequence opt5 from anti-HIV_VRC-CH30_VRC-CH31_VRC-CH32_VRC-CH33_VRC-CH34_Light Chain _CDR
  source 1..21: mol_type = other RNA
tgccagcaatacgagaccttc

SEQ ID NO: 43849 - RNA, 45 nt, synthetic construct
  misc_feature 1..45: note = derived and/or modified sequence opt5 from anti-HIV_VRC-CH30_VRC-CH31_VRC-CH32_VRC-CH34_HeavyChain_CDR
  source 1..45: mol_type = other RNA
gccagagctcagaagcggggccgcagcgagtgggcctacgcgcac

SEQ ID NO: 43850 - RNA, 45 nt, synthetic construct
  misc_feature 1..45: note = derived and/or modified sequence opt5 from anti-HIV_VRC-CH33_HeavyChain_CDR
  source 1..45: mol_type = other RNA
gccagagctcagaagcgggcccgcagcgagtgggcgtacgctcac

SEQ ID NO: 43851 - RNA, 21 nt, synthetic construct
  misc_feature 1..21: note = derived and/or modified sequence opt5 from anti-HIV_VRC-PG04_LightChain_CDR
  source 1..21: mol_type = other RNA
tgccagcaactggagttcttt

SEQ ID NO: 43852 - RNA, 48 nt, synthetic construct; identical to SEQ ID NO: 28568
  misc_feature 1..48: note = derived and/or modified sequence opt5 from anti-HIV_VRC-PG04_HeavyChain_CDR
  source 1..48: mol_type = other RNA

SEQ ID NO: 43853 - RNA, 21 nt, synthetic construct
  misc_feature 1..21: note = derived and/or modified sequence opt5 from anti-HIV_VRC-PG04b_LightChain_CDR
  source 1..21: mol_type = other RNA
tgccagcaagtggagttcttt

SEQ ID NO: 43854 - RNA, 48 nt, synthetic construct
  misc_feature 1..48: note = derived and/or modified sequence opt5 from anti-HIV_VRC-PG04b_HeavyChain_CDR
  source 1..48: mol_type = other RNA
gccagacagaagttcgagcggggcgggcaaggatggtactttgacctg

SEQ ID NO: 43855 - RNA, 21 nt, synthetic construct
  misc_feature 1..21: note = derived and/or modified sequence opt5 from anti-HIV_VRC03_LightChain_CDR
  source 1..21: mol_type = other RNA
tgccagcaattcgagtttttc

SEQ ID NO: 43856 - RNA, 48 nt, synthetic construct
  misc_feature 1..48: note = derived and/or modified sequence opt5 from anti-HIV_VRC03_HeavyChain_CDR
  source 1..48: mol_type = other RNA
gtgagacggggcagctgcgactactgtggggatttcccctggcagtat

SEQ ID NO: 43857 - RNA, 21 nt, synthetic construct
  misc_feature 1..21: note = derived and/or modified sequence opt5 from anti-HIV_1TJG_P-Chain
  source 1..21: mol_type = other RNA
gagctggacaagtgggccagc

SEQ ID NO: 43858 - RNA, 69 nt, synthetic construct
  misc_feature 1..69: note = derived and/or modified sequence opt5 from anti-HIV_2B1H_P-Chain
  source 1..69: mol_type = other RNA
aacaataccaagaaaagcatcaagattagaccccggcaggccttctacgctacaaacggcatcattggg

SEQ ID NO: 43859 - RNA, 69 nt, synthetic construct
  misc_feature 1..69: note = derived and/or modified sequence opt5 from anti-HIV_2B1A_P-Chain
  source 1..69: mol_type = other RNA
aacaataccagaaagagcatccacctgggccccgggcgggccttctacgctacaggagacattatcggc

SEQ ID NO: 43860 - RNA, 57 nt, synthetic construct
  misc_feature 1..57: note = derived and/or modified sequence opt5 from anti-HIV_2B0S_P-Chain
  source 1..57: mol_type = other RNA
aagagaaaacggatccacattggccccgggcgcgccttctacaccacaaagaacgct

SEQ ID NO: 43861 - RNA, 69 nt, synthetic construct
  misc_feature 1..69: note = derived and/or modified sequence opt5 from anti-HIV_3UJJ_P-Chain
  source 1..69: mol_type = other RNA
aacaataccagaaagagcatccggattggccccgggcaggccttctacgctacaggagacatcattggc

SEQ ID NO: 43862 - RNA, 69 nt, synthetic construct
  misc_feature 1..69: note = derived and/or modified sequence opt5 from anti-HIV_3UJI_P-Chain
  source 1..69: mol_type = other RNA
tacaacaagagaaaacggatccacattggccccgggcgcgccttctataccacaaagaatatcattgga

SEQ ID NO: 43863 - RNA, 75 nt, synthetic construct
  misc_feature 1..75: note = derived and/or modified sequence opt5 from anti-HIV_3MLZ_P-Chain
  source 1..75: mol_type = other RNA
agcaacaataccagaaagggcatccacattgggcccggacgggccttctacgctacaggccagatcacgggggac

SEQ ID NO: 43864 - RNA, 60 nt, synthetic construct
  misc_feature 1..60: note = derived and/or modified sequence opt5 from anti-HIV_3MLV_Q-Chain
  source 1..60: mol_type = other RNA
aacaataccagaaagcggatccgcgtgggccccgggcagacagtctacgccacgaacgct

SEQ ID NO: 43865 - RNA, 69 nt, synthetic construct
  misc_feature 1..69: note = derived and/or modified sequence opt5 from anti-HIV_3MLU_P-Chain
  source 1..69: mol_type = other RNA
aacaataccagaaagagcatccggattggccccgggcaggccttctacgctacaggaggcatcattggg

SEQ ID NO: 43866 - RNA, 60 nt, synthetic construct
  misc_feature 1..60: note = derived and/or modified sequence opt5 from anti-HIV_3MLR_P-Chain
  source 1..60: mol_type = other RNA
aacaataccaagaaaggcatcgccattgggcccggaagaacactgtacgctcgggagaag

SEQ ID NO: 43867 - RNA, 48 nt, synthetic construct; identical to SEQ ID NO: 28583
  misc_feature 1..48: note = derived and/or modified sequence opt5 from anti-HIV_4XCF_P-Chain
  source 1..48: mol_type = other RNA

SEQ ID NO: 43868 - RNA, 45 nt, synthetic construct; identical to SEQ ID NO: 28584
  misc_feature 1..45: note = derived and/or modified sequence opt5 from anti-HIV_4XBE_P-Chain
  source 1..45: mol_type = other RNA

SEQ ID NO: 43869 - RNA, 48 nt, synthetic construct; identical to SEQ ID NO: 28585
  misc_feature 1..48: note = derived and/or modified sequence opt5 from anti-HIV_4XAW_P-Chain
  source 1..48: mol_type = other RNA

SEQ ID NO: 43870 - RNA, 45 nt, synthetic construct
  misc_feature 1..45: note = derived and/or modified sequence opt5 from anti-HIV_2QSC_P-Chain
  source 1..45: mol_type = other RNA
agaaagcggatccacattggccccgggcgcgccttctacaccaca

SEQ ID NO: 43871 - RNA, 60 nt, synthetic construct
  misc_feature 1..60: note = derived and/or modified sequence opt5 from anti-HIV_3MLS_S-Chain
  source 1..60: mol_type = other RNA
gcctgccaggctttctacgccagctcccccagaaagtctatccacattggcgcgtgtgct

SEQ ID NO: 43872 - RNA, 42 nt, synthetic construct
  misc_feature 1..42: note = derived and/or modified sequence opt5 from anti-HIV_3GO1_P-Chain
  source 1..42: mol_type = other RNA
agaaagcggatccacattggccccgggcgcgccttctacacc

SEQ ID NO: 43873 - RNA, 42 nt, synthetic construct
  misc_feature 1..42: note = derived and/or modified sequence opt5 from anti-HIV_4M1D_Q-Chain
  source 1..42: mol_type = other RNA
tgcagaatccacattggccccgggcgggccttctacacctgt

SEQ ID NO: 43874 - RNA, 39 nt, synthetic construct; identical to SEQ ID NO: 28590
  misc_feature 1..39: note = derived and/or modified sequence opt5 from anti-HIV_3C2A_Q-Chain
  source 1..39: mol_type = other RNA

SEQ ID NO: 43875 - RNA, 12 nt, synthetic construct
  misc_feature 1..12: note = derived and/or modified sequence opt5 from anti-HIV_CDR
  source 1..12: mol_type = other RNA
cagagcaagacc

SEQ ID NO: 43876 - RNA, 12 nt, synthetic construct
  misc_feature 1..12: note = derived and/or modified sequence opt5 from anti-HIV_CDR
  source 1..12: mol_type = other RNA
gacctgatcgat

SEQ ID NO: 43877 - RNA, 15 nt, synthetic construct
  misc_feature 1..15: note = derived and/or modified sequence opt5 from anti-HIV_CDR
  source 1..15: mol_type = other RNA
gaccactactggagc

SEQ ID NO: 43878 - RNA, 15 nt, synthetic construct
  misc_feature 1..15: note = derived and/or modified sequence opt5 from anti-HIV_CDR
  source 1..15: mol_type = other RNA
ggcagattctggagc

SEQ ID NO: 43879 - RNA, 15 nt, synthetic construct
  misc_feature 1..15: note = derived and/or modified sequence opt5 from anti-HIV_CDR
  source 1..15: mol_type = other RNA
aactactattggacc

SEQ ID NO: 43880 - RNA, 15 nt, synthetic construct
  misc_feature 1..15: note = derived and/or modified sequence opt5 from anti-HIV_CDR
  source 1..15: mol_type = other RNA
gacgcctactggagc

SEQ ID NO: 43881 - RNA, 15 nt, synthetic construct
  misc_feature 1..15: note = derived and/or modified sequence opt5 from anti-HIV_CDR
  source 1..15: mol_type = other RNA
gacagctactggtcc

SEQ ID NO: 43882 - RNA, 15 nt, synthetic construct
  misc_feature 1..15: note = derived and/or modified sequence opt5 from anti-HIV_CDR
  source 1..15: mol_type = other RNA
gacaactactggagc

SEQ ID NO: 43883 - RNA, 15 nt, synthetic construct
  misc_feature 1..15: note = derived and/or modified sequence opt5 from anti-HIV_CDR
  source 1..15: mol_type = other RNA
aacagctactggacc

SEQ ID NO: 43884 - RNA, 15 nt, synthetic construct
  misc_feature 1..15: note = derived and/or modified sequence opt5 from anti-HIV_CDR
  source 1..15: mol_type = other RNA
agctactattggtcc

SEQ ID NO: 43885 - RNA, 15 nt, synthetic construct
  misc_feature 1..15: note = derived and/or modified sequence opt5 from anti-HIV_CDR
  source 1..15: mol_type = other RNA
agcttcggcatgcac

SEQ ID NO: 43886 - RNA, 15 nt, synthetic construct
  misc_feature 1..15: note = derived and/or modified sequence opt5 from anti-HIV_CDR
  source 1..15: mol_type = other RNA
gccgctttccagtgg

SEQ ID NO: 43887 - RNA, 15 nt, synthetic construct
  misc_feature 1..15: note = derived and/or modified sequence opt5 from anti-HIV_CDR
  source 1..15: mol_type = other RNA
cagcaactgagaacc

SEQ ID NO: 43888 - RNA, 15 nt, synthetic construct
  misc_feature 1..15: note = derived and/or modified sequence opt5 from anti-HIV_CDR
  source 1..15: mol_type = other RNA
cagcaatacgacagc

SEQ ID NO: 43889 - RNA, 15 nt, synthetic construct
  misc_feature 1..15: note = derived and/or modified sequence opt5 from anti-HIV_CDR
  source 1..15: mol_type = other RNA
cagcaactggccacc

SEQ ID NO: 43890 - RNA, 15 nt, synthetic construct
  misc_feature 1..15: note = derived and/or modified sequence opt5 from anti-HIV_CDR
  source 1..15: mol_type = other RNA
gagagcttccagtgg

SEQ ID NO: 43891 - RNA, 15 nt, synthetic construct
  misc_feature 1..15: note = derived and/or modified sequence opt5 from anti-HIV_CDR
  source 1..15: mol_type = other RNA
gaagtgtacgagttc

SEQ ID NO: 43892 - RNA, 15 nt, synthetic construct
  misc_feature 1..15: note = derived and/or modified sequence opt5 from anti-HIV_CDR
  source 1..15: mol_type = other RNA
gccagcctggagttc

SEQ ID NO: 43893 - RNA, 15 nt, synthetic construct
  misc_feature 1..15: note = derived and/or modified sequence opt5 from anti-HIV_CDR
  source 1..15: mol_type = other RNA
agcgtgtacgagttc

SEQ ID NO: 43894 - RNA, 15 nt, synthetic construct
  misc_feature 1..15: note = derived and/or modified sequence opt5 from anti-HIV_CDR
  source 1..15: mol_type = other RNA
gccgctctggagttc

SEQ ID NO: 43895 - RNA, 15 nt, synthetic construct
  misc_feature 1..15: note = derived and/or modified sequence opt5 from anti-HIV_CDR
  source 1..15: mol_type = other RNA
gccgtggtcgagttc

SEQ ID NO: 43896 - RNA, 15 nt, synthetic construct
  misc_feature 1..15: note = derived and/or modified sequence opt5 from anti-HIV_CDR
  source 1..15: mol_type = other RNA
cagctgttcgagttt

SEQ ID NO: 43897 - RNA, 15 nt, synthetic construct
  misc_feature 1..15: note = derived and/or modified sequence opt5 from anti-HIV_CDR
  source 1..15: mol_type = other RNA
gccgtgttccagtgg

SEQ ID NO: 43898 - RNA, 15 nt, synthetic construct
  misc_feature 1..15: note = derived and/or modified sequence opt5 from anti-HIV_CDR
  source 1..15: mol_type = other RNA
gccgtgctggagttc

SEQ ID NO: 43899 - RNA, 15 nt, synthetic construct
  misc_feature 1..15: note = derived and/or modified sequence opt5 from anti-HIV_CDR
  source 1..15: mol_type = other RNA
aacggcttcgacgtg

SEQ ID NO: 43900 - RNA, 15 nt, synthetic construct
  misc_feature 1..15: note = derived and/or modified sequence opt5 from anti-HIV_CDR
  source 1..15: mol_type = other RNA
cagcaatacgagttc

SEQ ID NO: 43901 - RNA, 15 nt, synthetic construct
  misc_feature 1..15: note = derived and/or modified sequence opt5 from anti-HIV_CDR
  source 1..15: mol_type = other RNA
cagcactacgagttc

SEQ ID NO: 43902 - RNA, 15 nt, synthetic construct
  misc_feature 1..15: note = derived and/or modified sequence opt5 from anti-HIV_CDR
  source 1..15: mol_type = other RNA
caggtgtacgaggtc

SEQ ID NO: 43903 - RNA, 15 nt, synthetic construct
  misc_feature 1..15: note = derived and/or modified sequence opt5 from anti-HIV_CDR
  source 1..15: mol_type = other RNA
caggtgtacgagttc

SEQ ID NO: 43904 - RNA, 15 nt, synthetic construct
  misc_feature 1..15: note = derived and/or modified sequence opt5 from anti-HIV_CDR
  source 1..15: mol_type = other RNA
ttcagcaaggagtcc

SEQ ID NO: 43905 - RNA, 15 nt, synthetic construct
  misc_feature 1..15: note = derived and/or modified sequence opt5 from anti-HIV_CDR
  source 1..15: mol_type = other RNA
ctgaagctcagctcc

SEQ ID NO: 43906 - RNA, 15 nt, synthetic construct
  misc_feature 1..15: note = derived and/or modified sequence opt5 from anti-HIV_CDR
  source 1..15: mol_type = other RNA
tacaaggtgagctcc

SEQ ID NO: 43907 - RNA, 15 nt, synthetic construct
  misc_feature 1..15: note = derived and/or modified sequence opt5 from anti-HIV_CDR
  source 1..15: mol_type = other RNA
ccccctcaggagagc

SEQ ID NO: 43908 - RNA, 15 nt, synthetic construct
  misc_feature 1..15: note = derived and/or modified sequence opt5 from anti-HIV_CDR
  source 1..15: mol_type = other RNA
accgccagagactac

SEQ ID NO: 43909 - RNA, 15 nt, synthetic construct
  misc_feature 1..15: note = derived and/or modified sequence opt5 from anti-HIV_CDR
  source 1..15: mol_type = other RNA
atgcagagcatccaa

SEQ ID NO: 43910 - RNA, 15 nt, synthetic construct
  misc_feature 1..15: note = derived and/or modified sequence opt5 from anti-HIV_CDR
  source 1..15: mol_type = other RNA
caccagctggacacc

SEQ ID NO: 43911 - RNA, 15 nt, synthetic construct
  misc_feature 1..15: note = derived and/or modified sequence opt5 from anti-HIV_CDR
  source 1..15: mol_type = other RNA
caccagctggacagc

SEQ ID NO: 43912 - RNA, 15 nt, synthetic construct
  misc_feature 1..15: note = derived and/or modified sequence opt5 from anti-HIV_CDR
  source 1..15: mol_type = other RNA
cagcaactgggcacc

SEQ ID NO: 43913 - RNA, 15 nt, synthetic construct
  misc_feature 1..15: note = derived and/or modified sequence opt5 from anti-HIV_CDR
  source 1..15: mol_type = other RNA
cagaaggccaccaca

SEQ ID NO: 43914 - RNA, 15 nt, synthetic construct
  misc_feature 1..15: note = derived and/or modified sequence opt5 from anti-HIV_CDR
  source 1..15: mol_type = other RNA
ctgttcgccggcacc

SEQ ID NO: 43915 - RNA, 18 nt, synthetic construct
  misc_feature 1..18: note = derived and/or modified sequence opt5 from anti-HIV_CDR
  source 1..18: mol_type = other RNA
gtgagaggcagctccccc

SEQ ID NO: 43916 - RNA, 18 nt, synthetic construct
  misc_feature 1..18: note = derived and/or modified sequence opt5 from anti-HIV_CDR
  source 1..18: mol_type = other RNA
ggcctcctgttcgtggtc

SEQ ID NO: 43917 - RNA, 18 nt, synthetic construct
  misc_feature 1..18: note = derived and/or modified sequence opt5 from anti-HIV_CDR
  source 1..18: mol_type = other RNA
atggactggacctggagc

SEQ ID NO: 43918 - RNA, 18 nt, synthetic construct
  misc_feature 1..18: note = derived and/or modified sequence opt5 from anti-HIV_CDR
  source 1..18: mol_type = other RNA
atggactggacctggaga

SEQ ID NO: 43919 - RNA, 18 nt, synthetic construct
  misc_feature 1..18: note = derived and/or modified sequence opt5 from anti-HIV_CDR
  source 1..18: mol_type = other RNA
atgaagcacctgtggttc

SEQ ID NO: 43920 - RNA, 18 nt, synthetic construct
  misc_feature 1..18: note = derived and/or modified sequence opt5 from anti-HIV_CDR
  source 1..18: mol_type = other RNA
atggactggatctggaga

SEQ ID NO: 43921 - RNA, 18 nt, synthetic construct
  misc_feature 1..18: note = derived and/or modified sequence opt5 from anti-HIV_CDR
  source 1..18: mol_type = other RNA
atggactggacctggaca

SEQ ID NO: 43922 - RNA, 18 nt, synthetic construct
  misc_feature 1..18: note = derived and/or modified sequence opt5 from anti-HIV_CDR
  source 1..18: mol_type = other RNA
atgaagcacctgttcctc

SEQ ID NO: 43923 - RNA, 18 nt, synthetic construct
  misc_feature 1..18: note = derived and/or modified sequence opt5 from anti-HIV_CDR
  source 1..18: mol_type = other RNA
cagctgctccaaagcaac

SEQ ID NO: 43924 - RNA, 18 nt, synthetic construct
  misc_feature 1..18: note = derived and/or modified sequence opt5 from anti-HIV_CDR
  source 1..18: mol_type = other RNA
ggcgggagccccgagcac

SEQ ID NO: 43925 - RNA, 18 nt, synthetic construct
  misc_feature 1..18: note = derived and/or modified sequence opt5 from anti-HIV_CDR
  source 1..18: mol_type = other RNA
ctggagggcaccgactac

SEQ ID NO: 43926 - RNA, 18 nt, synthetic construct
  misc_feature 1..18: note = derived and/or modified sequence opt5 from anti-HIV_CDR
  source 1..18: mol_type = other RNA
cagcaataccccagcacc

SEQ ID NO: 43927 - RNA, 21 nt, synthetic construct
  misc_feature 1..21: note = derived and/or modified sequence opt5 from anti-HIV_CDR
  source 1..21: mol_type = other RNA
aacaatcacgacagacccagc

SEQ ID NO: 43928 - RNA, 21 nt, synthetic construct
  misc_feature 1..21: note = derived and/or modified sequence opt5 from anti-HIV_CDR
  source 1..21: mol_type = other RNA
aacaatcaggacagacccgcc

SEQ ID NO: 43929 - RNA, 21 nt, synthetic construct
  misc_feature 1..21: note = derived and/or modified sequence opt5 from anti-HIV_CDR
  source 1..21: mol_type = other RNA
aacaataacgacagacccagc

SEQ ID NO: 43930 - RNA, 21 nt, synthetic construct
  misc_feature 1..21: note = derived and/or modified sequence opt5 from anti-HIV_CDR
  source 1..21: mol_type = other RNA
aacaatcaggacagacccagc

SEQ ID NO: 43931 - RNA, 21 nt, synthetic construct
  misc_feature 1..21: note = derived and/or modified sequence opt5 from anti-HIV_CDR
  source 1..21: mol_type = other RNA
gacgatagcgacagaccctcc

SEQ ID NO: 43932 - RNA, 21 nt, synthetic construct
  misc_feature 1..21: note = derived and/or modified sequence opt5 from anti-HIV_CDR
  source 1..21: mol_type = other RNA
tgggccagcaccagacacaca

SEQ ID NO: 43933 - RNA, 21 nt, synthetic construct
  misc_feature 1..21: note = derived and/or modified sequence opt5 from anti-HIV_CDR
  source 1..21: mol_type = other RNA
ggcgccaccgctagagacttc

SEQ ID NO: 43934 - RNA, 21 nt, synthetic construct
  misc_feature 1..21: note = derived and/or modified sequence opt5 from anti-HIV_CDR
  source 1..21: mol_type = other RNA
gccagcatcaagctggctctc

SEQ ID NO: 43935 - RNA, 21 nt, synthetic construct
  misc_feature 1..21: note = derived and/or modified sequence opt5 from anti-HIV_CDR
  source 1..21: mol_type = other RNA
cagcaatacggcagaagcccc

SEQ ID NO: 43936 - RNA, 21 nt, synthetic construct
  misc_feature 1..21: note = derived and/or modified sequence opt5 from anti-HIV_CDR
  source 1..21: mol_type = other RNA
cagcaatactatatcagcccc

SEQ ID NO: 43937 - RNA, 21 nt, synthetic construct
  misc_feature 1..21: note = derived and/or modified sequence opt5 from anti-HIV_CDR
  source 1..21: mol_type = other RNA
cagcaaagccactccccctct

SEQ ID NO: 43938 - RNA, 21 nt, synthetic construct
  misc_feature 1..21: note = derived and/or modified sequence opt5 from anti-HIV_CDR
  source 1..21: mol_type = other RNA
ggcagatgcgcccggcgctgg

SEQ ID NO: 43939 - RNA, 21 nt, synthetic construct
  misc_feature 1..21: note = derived and/or modified sequence opt5 from anti-HIV_CDR
  source 1..21: mol_type = other RNA
agattcctgtttgtggtcgcc

SEQ ID NO: 43940 - RNA, 21 nt, synthetic construct
  misc_feature 1..21: note = derived and/or modified sequence opt5 from anti-HIV_CDR
  source 1..21: mol_type = other RNA
atgagcgtgtccttcctgatc

SEQ ID NO: 43941 - RNA, 21 nt, synthetic construct
  misc_feature 1..21: note = derived and/or modified sequence opt5 from anti-HIV_CDR
  source 1..21: mol_type = other RNA
ggcagctccaacagatgcccc

SEQ ID NO: 43942 - RNA, 21 nt, synthetic construct
  misc_feature 1..21: note = derived and/or modified sequence opt5 from anti-HIV_CDR
  source 1..21: mol_type = other RNA
atgaagcacctgtggttcttt

SEQ ID NO: 43943 - RNA, 21 nt, synthetic construct
  misc_feature 1..21: note = derived and/or modified sequence opt5 from anti-HIV_CDR
  source 1..21: mol_type = other RNA
gccagctgggacttcgatttt

SEQ ID NO: 43944 - RNA, 21 nt, synthetic construct
  misc_feature 1..21: note = derived and/or modified sequence opt5 from anti-HIV_CDR
  source 1..21: mol_type = other RNA
gagatcggcgtggccgaacac

SEQ ID NO: 43945 - RNA, 21 nt, synthetic construct
  misc_feature 1..21: note = derived and/or modified sequence opt5 from anti-HIV_CDR
  source 1..21: mol_type = other RNA
cagaagtacgacaccgccccc

SEQ ID NO: 43946 - RNA, 21 nt, synthetic construct
  misc_feature 1..21: note = derived and/or modified sequence opt5 from anti-HIV_CDR
  source 1..21: mol_type = other RNA
cagcaaagctcctctaccccc

SEQ ID NO: 43947 - RNA, 21 nt, synthetic construct
  misc_feature 1..21: note = derived and/or modified sequence opt5 from anti-HIV_CDR
  source 1..21: mol_type = other RNA
cagcaaagcgccggcaccccc

SEQ ID NO: 43948 - RNA, 21 nt, synthetic construct
  misc_feature 1..21: note = derived and/or modified sequence opt5 from anti-HIV_CDR
  source 1..21: mol_type = other RNA
cagcaaagctcctctaagccc

SEQ ID NO: 43949 - RNA, 21 nt, synthetic construct
  misc_feature 1..21: note = derived and/or modified sequence opt5 from anti-HIV_CDR
  source 1..21: mol_type = other RNA
caggagtacaacacctataca

SEQ ID NO: 43950 - RNA, 21 nt, synthetic construct
  misc_feature 1..21: note = derived and/or modified sequence opt5 from anti-HIV_CDR
  source 1..21: mol_type = other RNA
caggagtacaacaattataac

SEQ ID NO: 43951 - RNA, 21 nt, synthetic construct
  misc_feature 1..21: note = derived and/or modified sequence opt5 from anti-HIV_CDR
  source 1..21: mol_type = other RNA
cactacgacgccctggattat

SEQ ID NO: 43952 - RNA, 24 nt, synthetic construct
  misc_feature 1..24: note = derived and/or modified sequence opt5 from anti-HIV_CDR
  source 1..24: mol_type = other RNA
gccatcttcaagggcgtgcagtgc

SEQ ID NO: 43953 - RNA, 24 nt, synthetic construct
  misc_feature 1..24: note = derived and/or modified sequence opt5 from anti-HIV_CDR
  source 1..24: mol_type = other RNA
ggccccctgggggactacgatttc

SEQ ID NO: 43954 - RNA, 24 nt, synthetic construct
  misc_feature 1..24: note = derived and/or modified sequence opt5 from anti-HIV_CDR
  source 1..24: mol_type = other RNA
cagcaatacggcagctccctgaga

SEQ ID NO: 43955 - RNA, 24 nt, synthetic construct
  misc_feature 1..24: note = derived and/or modified sequence opt5 from anti-HIV_CDR
  source 1..24: mol_type = other RNA
cagcaatacagccactatagaacc

SEQ ID NO: 43956 - RNA, 24 nt, synthetic construct
  misc_feature 1..24: note = derived and/or modified sequence opt5 from anti-HIV_CDR
  source 1..24: mol_type = other RNA
cagtactatggcatgagcgtgacc

SEQ ID NO: 43957 - RNA, 24 nt, synthetic construct
  misc_feature 1..24: note = derived and/or modified sequence opt5 from anti-HIV_CDR
  source 1..24: mol_type = other RNA
cagcaatacgagaactggctgacc

SEQ ID NO: 43958 - RNA, 24 nt, synthetic construct
  misc_feature 1..24: note = derived and/or modified sequence opt5 from anti-HIV_CDR
  source 1..24: mol_type = other RNA
agcggcgtgcactacatggacgtc

SEQ ID NO: 43959 - RNA, 24 nt, synthetic construct
  misc_feature 1..24: note = derived and/or modified sequence opt5 from anti-HIV_CDR
  source 1..24: mol_type = other RNA
cagcaatacagcggccccctgacc

SEQ ID NO: 43960 - RNA, 24 nt, synthetic construct
  misc_feature 1..24: note = derived and/or modified sequence opt5 from anti-HIV_CDR
  source 1..24: mol_type = other RNA
cagcaatactataccgtgcccagc

SEQ ID NO: 43961 - RNA, 24 nt, synthetic construct
  misc_feature 1..24: note = derived and/or modified sequence opt5 from anti-HIV_CDR
  source 1..24: mol_type = other RNA
cagcaatacggcagctccatcacc

SEQ ID NO: 43962 - RNA, 24 nt, synthetic construct
  misc_feature 1..24: note = derived and/or modified sequence opt5 from anti-HIV_CDR
  source 1..24: mol_type = other RNA
caccagtacaacaagtgggacacc

SEQ ID NO: 43963 - RNA, 24 nt, synthetic construct
  misc_feature 1..24: note = derived and/or modified sequence opt5 from anti-HIV_CDR
  source 1..24: mol_type = other RNA
cagcaaagctacaccacacccctg

SEQ ID NO: 43964 - RNA, 24 nt, synthetic construct
  misc_feature 1..24: note = derived and/or modified sequence opt5 from anti-HIV_CDR
  source 1..24: mol_type = other RNA
cagagatgggagaccatcgactac

SEQ ID NO: 43965 - RNA, 24 nt, synthetic construct
  misc_feature 1..24: note = derived and/or modified sequence opt5 from anti-HIV_CDR
  source 1..24: mol_type = other RNA
tgcagctacgccggctcctatacc

SEQ ID NO: 43966 - RNA, 24 nt, synthetic construct
  misc_feature 1..24: note = derived and/or modified sequence opt5 from anti-HIV_CDR
  source 1..24: mol_type = other RNA
cagcaatacgacaacctgcccacc

SEQ ID NO: 43967 - RNA, 24 nt, synthetic construct
  misc_feature 1..24: note = derived and/or modified sequence opt5 from anti-HIV_CDR
  source 1..24: mol_type = other RNA
cagcaatgcaccctgcccctcaca

SEQ ID NO: 43968 - RNA, 24 nt, synthetic construct
  misc_feature 1..24: note = derived and/or modified sequence opt5 from anti-HIV_CDR
  source 1..24: mol_type = other RNA
cagcaaagctactcctctgtgacc

SEQ ID NO: 43969 - RNA, 24 nt, synthetic construct
  misc_feature 1..24: note = derived and/or modified sequence opt5 from anti-HIV_CDR
  source 1..24: mol_type = other RNA
cagcaaagccacacctccgtgaca

SEQ ID NO: 43970 - RNA, 24 nt, synthetic construct
  misc_feature 1..24: note = derived and/or modified sequence opt5 from anti-HIV_CDR
  source 1..24: mol_type = other RNA
cagcaaacctacgccagcgtgaca

SEQ ID NO: 43971 - RNA, 24 nt, synthetic construct
  misc_feature 1..24: note = derived and/or modified sequence opt5 from anti-HIV_CDR
  source 1..24: mol_type = other RNA
cagcaatacaacagcgactatacc

SEQ ID NO: 43972 - RNA, 24 nt, synthetic construct
  misc_feature 1..24: note = derived and/or modified sequence opt5 from anti-HIV_CDR
  source 1..24: mol_type = other RNA
cacctgtacgtgagcagacccgtc

SEQ ID NO: 43973 - RNA, 24 nt, synthetic construct
  misc_feature 1..24: note = derived and/or modified sequence opt5 from anti-HIV_CDR
  source 1..24: mol_type = other RNA
cagcaatacggcagaagccccctg

SEQ ID NO: 43974 - RNA, 24 nt, synthetic construct
  misc_feature 1..24: note = derived and/or modified sequence opt5 from anti-HIV_CDR
  source 1..24: mol_type = other RNA
cagcaatacggctccagccccctg

SEQ ID NO: 43975 - RNA, 24 nt, synthetic construct
  misc_feature 1..24: note = derived and/or modified sequence opt5 from anti-HIV_CDR
  source 1..24: mol_type = other RNA
cagcaatacaacgactggcccgcc

SEQ ID NO: 43976 - RNA, 24 nt, synthetic construct
  misc_feature 1..24: note = derived and/or modified sequence opt5 from anti-HIV_CDR
  source 1..24: mol_type = other RNA
caccagtacggcagctcccaaaga

SEQ ID NO: 43977 - RNA, 24 nt, synthetic construct
  misc_feature 1..24: note = derived and/or modified sequence opt5 from anti-HIV_CDR
  source 1..24: mol_type = other RNA
cagcaaacctacagctccgtgaca

SEQ ID NO: 43978 - RNA, 24 nt, synthetic construct
  misc_feature 1..24: note = derived and/or modified sequence opt5 from anti-HIV_CDR
  source 1..24: mol_type = other RNA
cagcaaacctacagaagcgtgaca

SEQ ID NO: 43979 - RNA, 24 nt, synthetic construct
  misc_feature 1..24: note = derived and/or modified sequence opt5 from anti-HIV_CDR
  source 1..24: mol_type = other RNA
cagcaatacggcagctcctggacc

SEQ ID NO: 43980 - RNA, 24 nt, synthetic construct
  misc_feature 1..24: note = derived and/or modified sequence opt5 from anti-HIV_CDR
  source 1..24: mol_type = other RNA
agctcctacgccggcatcaacaat

SEQ ID NO: 43981 - RNA, 24 nt, synthetic construct
  misc_feature 1..24: note = derived and/or modified sequence opt5 from anti-HIV_CDR
  source 1..24: mol_type = other RNA
cagaagtacggcagctccctgacc

SEQ ID NO: 43982 - RNA, 24 nt, synthetic construct
  misc_feature 1..24: note = derived and/or modified sequence opt5 from anti-HIV_CDR
  source 1..24: mol_type = other RNA
atgcaggccctggagaccctcggc

SEQ ID NO: 43983 - RNA, 24 nt, synthetic construct
  misc_feature 1..24: note = derived and/or modified sequence opt5 from anti-HIV_CDR
  source 1..24: mol_type = other RNA
cagcaatacgccggcagcctgacc

SEQ ID NO: 43984 - RNA, 24 nt, synthetic construct
  misc_feature 1..24: note = derived and/or modified sequence opt5 from anti-HIV_CDR
  source 1..24: mol_type = other RNA
agaaactggggcaatttcgaccac

SEQ ID NO: 43985 - RNA, 27 nt, synthetic construct
  misc_feature 1..27: note = derived and/or modified sequence opt5 from anti-HIV_CDR
  source 1..27: mol_type = other RNA
cagcaacactacaccacaccctggacg

SEQ ID NO: 43986 - RNA, 27 nt, synthetic construct
  misc_feature 1..27: note = derived and/or modified sequence opt5 from anti-HIV_CDR
  source 1..27: mol_type = other RNA
caacagagcttcgccgtgccctacacc

SEQ ID NO: 43987 - RNA, 27 nt, synthetic construct
  misc_feature 1..27: note = derived and/or modified sequence opt5 from anti-HIV_CDR
  source 1..27: mol_type = other RNA
cagcaatacaagagctattccggcacc

SEQ ID NO: 43988 - RNA, 27 nt, synthetic construct
  misc_feature 1..27: note = derived and/or modified sequence opt5 from anti-HIV_CDR
  source 1..27: mol_type = other RNA
caccagtacgcctatagccccagaacc

SEQ ID NO: 43989 - RNA, 27 nt, synthetic construct
  misc_feature 1..27: note = derived and/or modified sequence opt5 from anti-HIV_CDR
  source 1..27: mol_type = other RNA
cagcaatacaacagcttccctcccacc

SEQ ID NO: 43990 - RNA, 27 nt, synthetic construct
  misc_feature 1..27: note = derived and/or modified sequence opt5 from anti-HIV_CDR
  source 1..27: mol_type = other RNA
cagcaaacctacagcaaccccagaatg

SEQ ID NO: 43991 - RNA, 27 nt, synthetic construct
  misc_feature 1..27: note = derived and/or modified sequence opt5 from anti-HIV_CDR
  source 1..27: mol_type = other RNA
cagcaatacgaggaccctccctggacc

SEQ ID NO: 43992 - RNA, 27 nt, synthetic construct
  misc_feature 1..27: note = derived and/or modified sequence opt5 from anti-HIV_CDR
  source 1..27: mol_type = other RNA
caccagtacttcaacacccccagaaca

SEQ ID NO: 43993 - RNA, 27 nt, synthetic construct
  misc_feature 1..27: note = derived and/or modified sequence opt5 from anti-HIV_CDR
  source 1..27: mol_type = other RNA
caccagtacttcagcacccccagaaca

SEQ ID NO: 43994 - RNA, 27 nt, synthetic construct
  misc_feature 1..27: note = derived and/or modified sequence opt5 from anti-HIV_CDR
  source 1..27: mol_type = other RNA
cagcacagaagcaactggccctggacc

SEQ ID NO: 43995 - RNA, 27 nt, synthetic construct
  misc_feature 1..27: note = derived and/or modified sequence opt5 from anti-HIV_CDR
  source 1..27: mol_type = other RNA
agaggccggcgccagatcggggactac

SEQ ID NO: 43996 - RNA, 27 nt, synthetic construct
  misc_feature 1..27: note = derived and/or modified sequence opt5 from anti-HIV_CDR
  source 1..27: mol_type = other RNA
cagcaatacggcctgagcccctggacc

SEQ ID NO: 43997 - RNA, 27 nt, synthetic construct
  misc_feature 1..27: note = derived and/or modified sequence opt5 from anti-HIV_CDR
  source 1..27: mol_type = other RNA
cagcaaacctacacaagccccatcacg

SEQ ID NO: 43998 - RNA, 27 nt, synthetic construct
  misc_feature 1..27: note = derived and/or modified sequence opt5 from anti-HIV_CDR
  source 1..27: mol_type = other RNA
cagcaatacggcagctcccctcccacc

SEQ ID NO: 43999 - RNA, 27 nt, synthetic construct
  misc_feature 1..27: note = derived and/or modified sequence opt5 from anti-HIV_CDR
  source 1..27: mol_type = other RNA
cagcaatacggcaccagctcctgcaca

SEQ ID NO: 44000 - RNA, 27 nt, synthetic construct
  misc_feature 1..27: note = derived and/or modified sequence opt5 from anti-HIV_CDR
  source 1..27: mol_type = other RNA
cagcaatacgacgatgcccccatcacc

SEQ ID NO: 44001 - RNA, 27 nt, synthetic construct
  misc_feature 1..27: note = derived and/or modified sequence opt5 from anti-HIV_CDR
  source 1..27: mol_type = other RNA
ggccccctgctcagatacctggacagc

SEQ ID NO: 44002 - RNA, 27 nt, synthetic construct
  misc_feature 1..27: note = derived and/or modified sequence opt5 from anti-HIV_CDR
  source 1..27: mol_type = other RNA
tgcctgaagaaaaccagctcctacgtg

SEQ ID NO: 44003 - RNA, 27 nt, synthetic construct
  misc_feature 1..27: note = derived and/or modified sequence opt5 from anti-HIV_CDR
  source 1..27: mol_type = other RNA
cagcaatacaaccactggccccagacc

SEQ ID NO: 44004 - RNA, 27 nt, synthetic construct
  misc_feature 1..27: note = derived and/or modified sequence opt5 from anti-HIV_CDR
  source 1..27: mol_type = other RNA
cagcaatacagcaacctgccctatacc

SEQ ID NO: 44005 - RNA, 27 nt, synthetic construct
  misc_feature 1..27: note = derived and/or modified sequence opt5 from anti-HIV_CDR
  source 1..27: mol_type = other RNA
cagcaatacgacacctatcccggcaca

SEQ ID NO: 44006 - RNA, 27 nt, synthetic construct
  misc_feature 1..27: note = derived and/or modified sequence opt5 from anti-HIV_CDR
  source 1..27: mol_type = other RNA
caggagtacagctccaccccctataac

SEQ ID NO: 44007 - RNA, 27 nt, synthetic construct
  misc_feature 1..27: note = derived and/or modified sequence opt5 from anti-HIV_CDR
  source 1..27: mol_type = other RNA
ggcgcctgggacgataccctgtacgtg

SEQ ID NO: 44008 - RNA, 27 nt, synthetic construct
  misc_feature 1..27: note = derived and/or modified sequence opt5 from anti-HIV_CDR
  source 1..27: mol_type = other RNA
gccgcttgggacgataccctgtacgtg

SEQ ID NO: 44009 - RNA, 27 nt, synthetic construct
  misc_feature 1..27: note = derived and/or modified sequence opt5 from anti-HIV_CDR
  source 1..27: mol_type = other RNA
cagcaatactatagcgactccatcacc

SEQ ID NO: 44010 - RNA, 27 nt, synthetic construct
  misc_feature 1..27: note = derived and/or modified sequence opt5 from anti-HIV_CDR
  source 1..27: mol_type = other RNA
cagcaatacggcagaagcccctatacc

SEQ ID NO: 44011 - RNA, 27 nt, synthetic construct
  misc_feature 1..27: note = derived and/or modified sequence opt5 from anti-HIV_CDR
  source 1..27: mol_type = other RNA
cagcaatacaccaactatccctggaca

SEQ ID NO: 44012 - RNA, 27 nt, synthetic construct
  misc_feature 1..27: note = derived and/or modified sequence opt5 from anti-HIV_CDR
  source 1..27: mol_type = other RNA
cagcaaagacacaactggcccatcagc

SEQ ID NO: 44013 - RNA, 27 nt, synthetic construct
  misc_feature 1..27: note = derived and/or modified sequence opt5 from anti-HIV_CDR
  source 1..27: mol_type = other RNA
cagcaataccacaactggcccagaacc

SEQ ID NO: 44014 - RNA, 27 nt, synthetic construct
  misc_feature 1..27: note = derived and/or modified sequence opt5 from anti-HIV_CDR
  source 1..27: mol_type = other RNA
cagcaaagaagcacctggccccctaca

SEQ ID NO: 44015 - RNA, 27 nt, synthetic construct
  misc_feature 1..27: note = derived and/or modified sequence opt5 from anti-HIV_CDR
  source 1..27: mol_type = other RNA
cagcaatacgacagcttctcctggacc

SEQ ID NO: 44016 - RNA, 27 nt, synthetic construct
  misc_feature 1..27: note = derived and/or modified sequence opt5 from anti-HIV_CDR
  source 1..27: mol_type = other RNA
cagcaatacaacaatctgcccgtgacc

SEQ ID NO: 44017 - RNA, 27 nt, synthetic construct
  misc_feature 1..27: note = derived and/or modified sequence opt5 from anti-HIV_CDR
  source 1..27: mol_type = other RNA
cagcaatacaacagatatagctacacc

SEQ ID NO: 44018 - RNA, 27 nt, synthetic construct
  misc_feature 1..27: note = derived and/or modified sequence opt5 from anti-HIV_CDR
  source 1..27: mol_type = other RNA
caggagtactatatcctgccctgcagc

SEQ ID NO: 44019 - RNA, 27 nt, synthetic construct
  misc_feature 1..27: note = derived and/or modified sequence opt5 from anti-HIV_CDR
  source 1..27: mol_type = other RNA
cagcaatacgacaacctgctcgcccac

SEQ ID NO: 44020 - RNA, 27 nt, synthetic construct
  misc_feature 1..27: note = derived and/or modified sequence opt5 from anti-HIV_CDR
  source 1..27: mol_type = other RNA
caccagtgcgacaacctgatcgccaga

SEQ ID NO: 44021 - RNA, 27 nt, synthetic construct
  misc_feature 1..27: note = derived and/or modified sequence opt5 from anti-HIV_CDR
  source 1..27: mol_type = other RNA
caacagagcttctccaccctgtggaca

SEQ ID NO: 44022 - RNA, 27 nt, synthetic construct
  misc_feature 1..27: note = derived and/or modified sequence opt5 from anti-HIV_CDR
  source 1..27: mol_type = other RNA
caccagagctactccacaccccctacc

SEQ ID NO: 44023 - RNA, 27 nt, synthetic construct
  misc_feature 1..27: note = derived and/or modified sequence opt5 from anti-HIV_CDR
  source 1..27: mol_type = other RNA
cagcaaggctacagcaccccctggaca

SEQ ID NO: 44024 - RNA, 27 nt, synthetic construct
  misc_feature 1..27: note = derived and/or modified sequence opt5 from anti-HIV_CDR
  source 1..27: mol_type = other RNA
cagcaatacagcaccacacccagaacg

SEQ ID NO: 44025 - RNA, 27 nt, synthetic construct
  misc_feature 1..27: note = derived and/or modified sequence opt5 from anti-HIV_CDR
  source 1..27: mol_type = other RNA
cagctgtacaacagcgtgccccaaacc

SEQ ID NO: 44026 - RNA, 27 nt, synthetic construct
  misc_feature 1..27: note = derived and/or modified sequence opt5 from anti-HIV_CDR
  source 1..27: mol_type = other RNA
cagcaaagaaccagctggccccagaca

SEQ ID NO: 44027 - RNA, 27 nt, synthetic construct
  misc_feature 1..27: note = derived and/or modified sequence opt5 from anti-HIV_CDR
  source 1..27: mol_type = other RNA
cagcaattcaacacctacagccagaca

SEQ ID NO: 44028 - RNA, 27 nt, synthetic construct
  misc_feature 1..27: note = derived and/or modified sequence opt5 from anti-HIV_CDR
  source 1..27: mol_type = other RNA
atgcagagcctgcaaacccccatcaca

SEQ ID NO: 44029 - RNA, 27 nt, synthetic construct
  misc_feature 1..27: note = derived and/or modified sequence opt5 from anti-HIV_CDR
  source 1..27: mol_type = other RNA
cagcaatacaacagctatcccctgacc

SEQ ID NO: 44030 - RNA, 27 nt, synthetic construct
  misc_feature 1..27: note = derived and/or modified sequence opt5 from anti-HIV_CDR
  source 1..27: mol_type = other RNA
cagcaatacaacagctattccggcacc

SEQ ID NO: 44031 - RNA, 27 nt, synthetic construct
  misc_feature 1..27: note = derived and/or modified sequence opt5 from anti-HIV_CDR
  source 1..27: mol_type = other RNA
cagagctacgactcctctctgagcggc

SEQ ID NO: 44032 - RNA, 27 nt, synthetic construct
  misc_feature 1..27: note = derived and/or modified sequence opt5 from anti-HIV_CDR
  source 1..27: mol_type = other RNA
agccagggcaacaccgccatcgactac

SEQ ID NO: 44033 - RNA, 27 nt, synthetic construct
  misc_feature 1..27: note = derived and/or modified sequence opt5 from anti-HIV_CDR
  source 1..27: mol_type = other RNA
gaggaacccagagacgccttcgatctg

SEQ ID NO: 44034 - RNA, 27 nt, synthetic construct
  misc_feature 1..27: note = derived and/or modified sequence opt5 from anti-HIV_CDR
  source 1..27: mol_type = other RNA
cagcaaagctacaccacacccgtgacg

SEQ ID NO: 44035 - RNA, 27 nt, synthetic construct
  misc_feature 1..27: note = derived and/or modified sequence opt5 from anti-HIV_CDR
  source 1..27: mol_type = other RNA
gccggcagagaggggtggttcgacccc

SEQ ID NO: 44036 - RNA, 27 nt, synthetic construct
  misc_feature 1..27: note = derived and/or modified sequence opt5 from anti-HIV_CDR
  source 1..27: mol_type = other RNA
cagcaatactatagcacaccccacacc

SEQ ID NO: 44037 - RNA, 27 nt, synthetic construct
  misc_feature 1..27: note = derived and/or modified sequence opt5 from anti-HIV_CDR
  source 1..27: mol_type = other RNA
cagcaaagctactccatcgccggcacc

SEQ ID NO: 44038 - RNA, 27 nt, synthetic construct
  misc_feature 1..27: note = derived and/or modified sequence opt5 from anti-HIV_CDR
  source 1..27: mol_type = other RNA
cagaactacaataagccccctagaacc

SEQ ID NO: 44039 - RNA, 27 nt, synthetic construct
  misc_feature 1..27: note = derived and/or modified sequence opt5 from anti-HIV_CDR
  source 1..27: mol_type = other RNA
atgcagagcatccaactgcccctcacc

SEQ ID NO: 44040 - RNA, 27 nt, synthetic construct
  misc_feature 1..27: note = derived and/or modified sequence opt5 from anti-HIV_CDR
  source 1..27: mol_type = other RNA
atgcaggccctgcaaaccagcctcaca

SEQ ID NO: 44041 - RNA, 27 nt, synthetic construct
  misc_feature 1..27: note = derived and/or modified sequence opt5 from anti-HIV_CDR
  source 1..27: mol_type = other RNA
cagcaatacagctcctctcccagaacc

SEQ ID NO: 44042 - RNA, 27 nt, synthetic construct
  misc_feature 1..27: note = derived and/or modified sequence opt5 from anti-HIV_CDR
  source 1..27: mol_type = other RNA
caggcctgggacagctccaccgctgtg

SEQ ID NO: 44043 - RNA, 27 nt, synthetic construct
  misc_feature 1..27: note = derived and/or modified sequence opt5 from anti-HIV_CDR
  source 1..27: mol_type = other RNA
cagcactacaacaattggccctatacc

SEQ ID NO: 44044 - RNA, 27 nt, synthetic construct
  misc_feature 1..27: note = derived and/or modified sequence opt5 from anti-HIV_CDR
  source 1..27: mol_type = other RNA
cagcaatacgacagactgcccatcacc

SEQ ID NO: 44045 - RNA, 27 nt, synthetic construct
  misc_feature 1..27: note = derived and/or modified sequence opt5 from anti-HIV_CDR
  source 1..27: mol_type = other RNA
cagcaatacggcagctcccccatcacc

SEQ ID NO: 44046 - RNA, 27 nt, synthetic construct
  misc_feature 1..27: note = derived and/or modified sequence opt5 from anti-HIV_CDR
  source 1..27: mol_type = other RNA
cagcaatacgacgtgtggcccctgacc

SEQ ID NO: 44047 - RNA, 27 nt, synthetic construct
  misc_feature 1..27: note = derived and/or modified sequence opt5 from anti-HIV_CDR
  source 1..27: mol_type = other RNA
caccagtacgccagctcccccagaacc

SEQ ID NO: 44048 - RNA, 27 nt, synthetic construct
  misc_feature 1..27: note = derived and/or modified sequence opt5 from anti-HIV_CDR
  source 1..27: mol_type = other RNA
atgcagagcctgcacctcccctacacc

SEQ ID NO: 44049 - RNA, 27 nt, synthetic construct
  misc_feature 1..27: note = derived and/or modified sequence opt5 from anti-HIV_CDR
  source 1..27: mol_type = other RNA
cagcaatactattccagccccctgacc

SEQ ID NO: 44050 - RNA, 27 nt, synthetic construct
  misc_feature 1..27: note = derived and/or modified sequence opt5 from anti-HIV_CDR
  source 1..27: mol_type = other RNA
cagcaacacgacaccttcccctttaca

SEQ ID NO: 44051 - RNA, 27 nt, synthetic construct
  misc_feature 1..27: note = derived and/or modified sequence opt5 from anti-HIV_CDR
  source 1..27: mol_type = other RNA
cagcaaagctactccaccccctataca

SEQ ID NO: 44052 - RNA, 27 nt, synthetic construct
  misc_feature 1..27: note = derived and/or modified sequence opt5 from anti-HIV_CDR
  source 1..27: mol_type = other RNA
cagcaatacaagacctatcccgtgaca

SEQ ID NO: 44053 - RNA, 27 nt, synthetic construct
  misc_feature 1..27: note = derived and/or modified sequence opt5 from anti-HIV_CDR
  source 1..27: mol_type = other RNA
cagcaatactatagcacccccgtgaca

SEQ ID NO: 44054 - RNA, 27 nt, synthetic construct
  misc_feature 1..27: note = derived and/or modified sequence opt5 from anti-HIV_CDR
  source 1..27: mol_type = other RNA
cagcaatacaactggccccctttcacc

SEQ ID NO: 44055 - RNA, 27 nt, synthetic construct
  misc_feature 1..27: note = derived and/or modified sequence opt5 from anti-HIV_CDR
  source 1..27: mol_type = other RNA
atgcagggcacccactggccctggaca

SEQ ID NO: 44056 - RNA, 27 nt, synthetic construct
  misc_feature 1..27: note = derived and/or modified sequence opt5 from anti-HIV_CDR
  source 1..27: mol_type = other RNA
caccagtgcggcagctcccccagaacc

SEQ ID NO: 44057 - RNA, 27 nt, synthetic construct
  misc_feature 1..27: note = derived and/or modified sequence opt5 from anti-HIV_CDR
  source 1..27: mol_type = other RNA
cagcaatacaacagctatttcagaacc

SEQ ID NO: 44058 - RNA, 27 nt, synthetic construct
  misc_feature 1..27: note = derived and/or modified sequence opt5 from anti-HIV_CDR
  source 1..27: mol_type = other RNA
cagcaataccacaactggccccctagc

SEQ ID NO: 44059 - RNA, 27 nt, synthetic construct
  misc_feature 1..27: note = derived and/or modified sequence opt5 from anti-HIV_CDR
  source 1..27: mol_type = other RNA
atgcagggcacctactggctgtggaca

SEQ ID NO: 44060 - RNA, 27 nt, synthetic construct
  misc_feature 1..27: note = derived and/or modified sequence opt5 from anti-HIV_CDR
  source 1..27: mol_type = other RNA
cagcaaggcttcagcgccccctttacc

SEQ ID NO: 44061 - RNA, 27 nt, synthetic construct
  misc_feature 1..27: note = derived and/or modified sequence opt5 from anti-HIV_CDR
  source 1..27: mol_type = other RNA
cagcaatacaacacctatcccctgaca

SEQ ID NO: 44062 - RNA, 27 nt, synthetic construct
  misc_feature 1..27: note = derived and/or modified sequence opt5 from anti-HIV_CDR
  source 1..27: mol_type = other RNA
atgcagggcacccactggcccagaaca

SEQ ID NO: 44063 - RNA, 27 nt, synthetic construct
  misc_feature 1..27: note = derived and/or modified sequence opt5 from anti-HIV_CDR
  source 1..27: mol_type = other RNA
ttcggcagaaccccctggtttgaccct

SEQ ID NO: 44064 - RNA, 27 nt, synthetic construct
  misc_feature 1..27: note = derived and/or modified sequence opt5 from anti-HIV_CDR
  source 1..27: mol_type = other RNA
cagcaatacttcaccagcgtgatcaca

SEQ ID NO: 44065 - RNA, 27 nt, synthetic construct
  misc_feature 1..27: note = derived and/or modified sequence opt5 from anti-HIV_CDR
  source 1..27: mol_type = other RNA
caccattacatgagcgacctgcagacc

SEQ ID NO: 44066 - RNA, 27 nt, synthetic construct
  misc_feature 1..27: note = derived and/or modified sequence opt5 from anti-HIV_CDR
  source 1..27: mol_type = other RNA
caccattacagctcctctagccacacc

SEQ ID NO: 44067 - RNA, 27 nt, synthetic construct
  misc_feature 1..27: note = derived and/or modified sequence opt5 from anti-HIV_CDR
  source 1..27: mol_type = other RNA
caccattacaagagcgactgccagacc

SEQ ID NO: 44068 - RNA, 27 nt, synthetic construct
  misc_feature 1..27: note = derived and/or modified sequence opt5 from anti-HIV_CDR
  source 1..27: mol_type = other RNA
cagcacagaagctcctggcccctgacc

SEQ ID NO: 44069 - RNA, 27 nt, synthetic construct
  misc_feature 1..27: note = derived and/or modified sequence opt5 from anti-HIV_CDR
  source 1..27: mol_type = other RNA
ctgcagcaccatagctacccctggacc

SEQ ID NO: 44070 - RNA, 27 nt, synthetic construct
  misc_feature 1..27: note = derived and/or modified sequence opt5 from anti-HIV_CDR
  source 1..27: mol_type = other RNA
cagcaatacggcaccagccccgggaca

SEQ ID NO: 44071 - RNA, 27 nt, synthetic construct
  misc_feature 1..27: note = derived and/or modified sequence opt5 from anti-HIV_CDR
  source 1..27: mol_type = other RNA
cagcaatacggcagctcccccaccaca

SEQ ID NO: 44072 - RNA, 27 nt, synthetic construct
  misc_feature 1..27: note = derived and/or modified sequence opt5 from anti-HIV_CDR
  source 1..27: mol_type = other RNA
cagcaatacggcaccagccccacaacg

SEQ ID NO: 44073 - RNA, 27 nt, synthetic construct
  misc_feature 1..27: note = derived and/or modified sequence opt5 from anti-HIV_CDR
  source 1..27: mol_type = other RNA
atgcaggccacccactggccccctggc

SEQ ID NO: 44074 - RNA, 27 nt, synthetic construct
  misc_feature 1..27: note = derived and/or modified sequence opt5 from anti-HIV_CDR
  source 1..27: mol_type = other RNA
cagagatacaaccgggacccctatatc

SEQ ID NO: 44075 - RNA, 27 nt, synthetic construct
  misc_feature 1..27: note = derived and/or modified sequence opt5 from anti-HIV_CDR
  source 1..27: mol_type = other RNA
cagcaatacgacaacctgcccctcgcc

SEQ ID NO: 44076 - RNA, 27 nt, synthetic construct
  misc_feature 1..27: note = derived and/or modified sequence opt5 from anti-HIV_CDR
  source 1..27: mol_type = other RNA
agctcctactctgccaccggcgtggct

SEQ ID NO: 44077 - RNA, 27 nt, synthetic construct
  misc_feature 1..27: note = derived and/or modified sequence opt5 from anti-HIV_CDR
  source 1..27: mol_type = other RNA
cagcactacggcaacagcagatggacc

SEQ ID NO: 44078 - RNA, 27 nt, synthetic construct
  misc_feature 1..27: note = derived and/or modified sequence opt5 from anti-HIV_CDR
  source 1..27: mol_type = other RNA
cagcaatacgagacctatccctggaca

SEQ ID NO: 44079 - RNA, 27 nt, synthetic construct
  misc_feature 1..27: note = derived and/or modified sequence opt5 from anti-HIV_CDR
  source 1..27: mol_type = other RNA
cagcaatacggcagctccccctctacc

SEQ ID NO: 44080 - RNA, 27 nt, synthetic construct
  misc_feature 1..27: note = derived and/or modified sequence opt5 from anti-HIV_CDR
  source 1..27: mol_type = other RNA
cagcaaagccagagaacaccccacacc

SEQ ID NO: 44081 - RNA, 27 nt, synthetic construct
  misc_feature 1..27: note = derived and/or modified sequence opt5 from anti-HIV_CDR
  source 1..27: mol_type = other RNA
cagcaatacgacatcctgcccctcacc

SEQ ID NO: 44082 - RNA, 27 nt, synthetic construct
  misc_feature 1..27: note = derived and/or modified sequence opt5 from anti-HIV_CDR
  source 1..27: mol_type = other RNA
cagcaaagcaactcctctccctggacc

SEQ ID NO: 44083 - RNA, 27 nt, synthetic construct
  misc_feature 1..27: note = derived and/or modified sequence opt5 from anti-HIV_CDR
  source 1..27: mol_type = other RNA
cagcaaagctacgacacccccagaaca

SEQ ID NO: 44084 - RNA, 27 nt, synthetic construct
  misc_feature 1..27: note = derived and/or modified sequence opt5 from anti-HIV_CDR
  source 1..27: mol_type = other RNA
cagcaattcggcagctcccccgggacc

SEQ ID NO: 44085 - RNA, 27 nt, synthetic construct
  misc_feature 1..27: note = derived and/or modified sequence opt5 from anti-HIV_CDR
  source 1..27: mol_type = other RNA
caccagtacggctccagcccccaaacc

SEQ ID NO: 44086 - RNA, 27 nt, synthetic construct
  misc_feature 1..27: note = derived and/or modified sequence opt5 from anti-HIV_CDR
  source 1..27: mol_type = other RNA
caccagtacggcagctctccccaatcc

SEQ ID NO: 44087 - RNA, 27 nt, synthetic construct
  misc_feature 1..27: note = derived and/or modified sequence opt5 from anti-HIV_CDR
  source 1..27: mol_type = other RNA
ctgcagcacaacagctaccccctcacc

SEQ ID NO: 44088 - RNA, 27 nt, synthetic construct
  misc_feature 1..27: note = derived and/or modified sequence opt5 from anti-HIV_CDR
  source 1..27: mol_type = other RNA
cagcaatacaacgactggcccatcacc

SEQ ID NO: 44089 - RNA, 27 nt, synthetic construct
  misc_feature 1..27: note = derived and/or modified sequence opt5 from anti-HIV_CDR
  source 1..27: mol_type = other RNA
cagcaaaccttcacatttccctacacg

SEQ ID NO: 44090 - RNA, 27 nt, synthetic construct
  misc_feature 1..27: note = derived and/or modified sequence opt5 from anti-HIV_CDR
  source 1..27: mol_type = other RNA
cagcaaagctacaccttcccctatatc

SEQ ID NO: 44091 - RNA, 27 nt, synthetic construct
  misc_feature 1..27: note = derived and/or modified sequence opt5 from anti-HIV_CDR
  source 1..27: mol_type = other RNA
cagtactatggcagctccccctacacc

SEQ ID NO: 44092 - RNA, 27 nt, synthetic construct
  misc_feature 1..27: note = derived and/or modified sequence opt5 from anti-HIV_CDR
  source 1..27: mol_type = other RNA
caacagagcttcggcacccccagaaca

SEQ ID NO: 44093 - RNA, 27 nt, synthetic construct
  misc_feature 1..27: note = derived and/or modified sequence opt5 from anti-HIV_CDR
  source 1..27: mol_type = other RNA
cagcaatacaacgactggcccagaacc

SEQ ID NO: 44094 - RNA, 27 nt, synthetic construct
  misc_feature 1..27: note = derived and/or modified sequence opt5 from anti-HIV_CDR
  source 1..27: mol_type = other RNA
cagcaatacggcagctcccccagaacc

SEQ ID NO: 44095 - RNA, 27 nt, synthetic construct
  misc_feature 1..27: note = derived and/or modified sequence opt5 from anti-HIV_CDR
  source 1..27: mol_type = other RNA
ctgcagcacaacagatacccctggacc

SEQ ID NO: 44096 - RNA, 27 nt, synthetic construct
  misc_feature 1..27: note = derived and/or modified sequence opt5 from anti-HIV_CDR
  source 1..27: mol_type = other RNA
ctgcagcacaacaattacccctggacc

SEQ ID NO: 44097 - RNA, 27 nt, synthetic construct
  misc_feature 1..27: note = derived and/or modified sequence opt5 from anti-HIV_CDR
  source 1..27: mol_type = other RNA
ctgcagtacagcacctatcccctcaca

SEQ ID NO: 44098 - RNA, 27 nt, synthetic construct
  misc_feature 1..27: note = derived and/or modified sequence opt5 from anti-HIV_CDR
  source 1..27: mol_type = other RNA
ctgcagtacaacgcctatcccctcacc

SEQ ID NO: 44099 - RNA, 27 nt, synthetic construct
  misc_feature 1..27: note = derived and/or modified sequence opt5 from anti-HIV_CDR
  source 1..27: mol_type = other RNA
cagcaatacgacagcgcccccgtgacc

SEQ ID NO: 44100 - RNA, 27 nt, synthetic construct
  misc_feature 1..27: note = derived and/or modified sequence opt5 from anti-HIV_CDR
  source 1..27: mol_type = other RNA
cagcaaacctacacattcccctatagc

SEQ ID NO: 44101 - RNA, 27 nt, synthetic construct
  misc_feature 1..27: note = derived and/or modified sequence opt5 from anti-HIV_CDR
  source 1..27: mol_type = other RNA
ggctacgacaacagcgggcccgattat

SEQ ID NO: 44102 - RNA, 27 nt, synthetic construct
  misc_feature 1..27: note = derived and/or modified sequence opt5 from anti-HIV_CDR
  source 1..27: mol_type = other RNA
cagcaatacaacaattggccccctgcc

SEQ ID NO: 44103 - RNA, 27 nt, synthetic construct
  misc_feature 1..27: note = derived and/or modified sequence opt5 from anti-HIV_CDR
  source 1..27: mol_type = other RNA
caccagtacgccctgagcccctggacc

SEQ ID NO: 44104 - RNA, 27 nt, synthetic construct
  misc_feature 1..27: note = derived and/or modified sequence opt5 from anti-HIV_CDR
  source 1..27: mol_type = other RNA
cagaagtacgacaccgatcccatgaca

SEQ ID NO: 44105 - RNA, 27 nt, synthetic construct
  misc_feature 1..27: note = derived and/or modified sequence opt5 from anti-HIV_CDR
  source 1..27: mol_type = other RNA
cagcaatacaactattaccccatcacc

SEQ ID NO: 44106 - RNA, 27 nt, synthetic construct
  misc_feature 1..27: note = derived and/or modified sequence opt5 from anti-HIV_CDR
  source 1..27: mol_type = other RNA
cagcaaaccttcacagaccccgtgacg

SEQ ID NO: 44107 - RNA, 27 nt, synthetic construct
  misc_feature 1..27: note = derived and/or modified sequence opt5 from anti-HIV_CDR
  source 1..27: mol_type = other RNA
gccgcttgggacgatagcctgcacgtg

SEQ ID NO: 44108 - RNA, 27 nt, synthetic construct
  misc_feature 1..27: note = derived and/or modified sequence opt5 from anti-HIV_CDR
  source 1..27: mol_type = other RNA
cagcaatacgccagctcccccttcacc

SEQ ID NO: 44109 - RNA, 27 nt, synthetic construct
  misc_feature 1..27: note = derived and/or modified sequence opt5 from anti-HIV_CDR
  source 1..27: mol_type = other RNA
cagcaaagctcctctacccccttcaca

SEQ ID NO: 44110 - RNA, 27 nt, synthetic construct
  misc_feature 1..27: note = derived and/or modified sequence opt5 from anti-HIV_CDR
  source 1..27: mol_type = other RNA
cagcaaagaagcaactgggccatcacc

SEQ ID NO: 44111 - RNA, 27 nt, synthetic construct
  misc_feature 1..27: note = derived and/or modified sequence opt5 from anti-HIV_CDR
  source 1..27: mol_type = other RNA
cagcaatacggcagctcccccttcacc

SEQ ID NO: 44112 - RNA, 27 nt, synthetic construct
  misc_feature 1..27: note = derived and/or modified sequence opt5 from anti-HIV_CDR
  source 1..27: mol_type = other RNA
cagaagtacaacggcgccccctggacc

SEQ ID NO: 44113 - RNA, 27 nt, synthetic construct
  misc_feature 1..27: note = derived and/or modified sequence opt5 from anti-HIV_CDR
  source 1..27: mol_type = other RNA
cagaagtacaacaatgccccctggacc

SEQ ID NO: 44114 - RNA, 27 nt, synthetic construct
  misc_feature 1..27: note = derived and/or modified sequence opt5 from anti-HIV_CDR
  source 1..27: mol_type = other RNA
cagcaaagagtgaactggccccctaat

SEQ ID NO: 44115 - RNA, 27 nt, synthetic construct
  misc_feature 1..27: note = derived and/or modified sequence opt5 from anti-HIV_CDR
  source 1..27: mol_type = other RNA
cagcaaagaggccactggcccctgacc

SEQ ID NO: 44116 - RNA, 27 nt, synthetic construct
  misc_feature 1..27: note = derived and/or modified sequence opt5 from anti-HIV_CDR
  source 1..27: mol_type = other RNA
cagcaatacagatatagcgtgatcatt

SEQ ID NO: 44117 - RNA, 27 nt, synthetic construct
  misc_feature 1..27: note = derived and/or modified sequence opt5 from anti-HIV_CDR
  source 1..27: mol_type = other RNA
cagcaaagcggcacctccctgctcaca

SEQ ID NO: 44118 - RNA, 27 nt, synthetic construct
  misc_feature 1..27: note = derived and/or modified sequence opt5 from anti-HIV_CDR
  source 1..27: mol_type = other RNA
atgaagtcccagcacagccccagaacc

SEQ ID NO: 44119 - RNA, 27 nt, synthetic construct
  misc_feature 1..27: note = derived and/or modified sequence opt5 from anti-HIV_CDR
  source 1..27: mol_type = other RNA
atgcagcccctgcaaaccccttacaca

SEQ ID NO: 44120 - RNA, 27 nt, synthetic construct
  misc_feature 1..27: note = derived and/or modified sequence opt5 from anti-HIV_CDR
  source 1..27: mol_type = other RNA
cagcaatacaccgcctatccctggaca

SEQ ID NO: 44121 - RNA, 27 nt, synthetic construct
  misc_feature 1..27: note = derived and/or modified sequence opt5 from anti-HIV_CDR
  source 1..27: mol_type = other RNA
ctgcagaaccacaattaccccagaacc

SEQ ID NO: 44122 - RNA, 27 nt, synthetic construct
  misc_feature 1..27: note = derived and/or modified sequence opt5 from anti-HIV_CDR
  source 1..27: mol_type = other RNA
ctgcagacccacagctaccccagaaca

SEQ ID NO: 44123 - RNA, 30 nt, synthetic construct; identical to SEQ ID NO: 28839
  misc_feature 1..30: note = derived and/or modified sequence opt5 from anti-HIV_CDR
  source 1..30: mol_type = other RNA

SEQ ID NO: 44124 - RNA, 30 nt, synthetic construct; identical to SEQ ID NO: 28840
  misc_feature 1..30: note = derived and/or modified sequence opt5 from anti-HIV_CDR
  source 1..30: mol_type = other RNA

SEQ ID NO: 44125 - RNA, 30 nt, synthetic construct
  misc_feature 1..30: note = derived and/or modified sequence opt5 from anti-HIV_CDR
  source 1..30: mol_type = other RNA
agctccttcacccccacaaacacgctggtg

SEQ ID NO: 44126 - RNA, 30 nt, synthetic construct; identical to SEQ ID NO: 28842
  misc_feature 1..30: note = derived and/or modified sequence opt5 from anti-HIV_CDR
  source 1..30: mol_type = other RNA

SEQ ID NO: 44127 - RNA, 30 nt, synthetic construct; identical to SEQ ID NO: 28843
  misc_feature 1..30: note = derived and/or modified sequence opt5 from anti-HIV_CDR
  source 1..30: mol_type = other RNA

SEQ ID NO: 44128 - RNA, 30 nt, synthetic construct; identical to SEQ ID NO: 28844
  misc_feature 1..30: note = derived and/or modified sequence opt5 from anti-HIV_CDR
  source 1..30: mol_type = other RNA

SEQ ID NO: 44129 - RNA, 30 nt, synthetic construct
  misc_feature 1..30: note = derived and/or modified sequence opt5 from anti-HIV_CDR
  source 1..30: mol_type = other RNA
cagcaaagagccaactggcggctgctcacc

SEQ ID NO: 44130 - RNA, 30 nt, synthetic construct; identical to SEQ ID NO: 28846
  misc_feature 1..30: note = derived and/or modified sequence opt5 from anti-HIV_CDR
  source 1..30: mol_type = other RNA

SEQ ID NO: 44131 - RNA, 30 nt, synthetic construct
  misc_feature 1..30: note = derived and/or modified sequence opt5 from anti-HIV_CDR
  source 1..30: mol_type = other RNA
agacggagcgactactgcgatttcgacgtg

SEQ ID NO: 44132 - RNA, 30 nt, synthetic construct; identical to SEQ ID NO: 28848
  misc_feature 1..30: note = derived and/or modified sequence opt5 from anti-HIV_CDR
  source 1..30: mol_type = other RNA

SEQ ID NO: 44133 - RNA, 30 nt, synthetic construct; identical to SEQ ID NO: 28849
  misc_feature 1..30: note = derived and/or modified sequence opt5 from anti-HIV_CDR
  source 1..30: mol_type = other RNA

SEQ ID NO: 44134 - RNA, 30 nt, synthetic construct; identical to SEQ ID NO: 28850
  misc_feature 1..30: note = derived and/or modified sequence opt5 from anti-HIV_CDR
  source 1..30: mol_type = other RNA

SEQ ID NO: 44135 - RNA, 30 nt, synthetic construct; identical to SEQ ID NO: 28851
  misc_feature 1..30: note = derived and/or modified sequence opt5 from anti-HIV_CDR
  source 1..30: mol_type = other RNA

SEQ ID NO: 44136 - RNA, 30 nt, synthetic construct; identical to SEQ ID NO: 28852
  misc_feature 1..30: note = derived and/or modified sequence opt5 from anti-HIV_CDR
  source 1..30: mol_type = other RNA

SEQ ID NO: 44137 - RNA, 30 nt, synthetic construct; identical to SEQ ID NO: 28853
  misc_feature 1..30: note = derived and/or modified sequence opt5 from anti-HIV_CDR
  source 1..30: mol_type = other RNA

SEQ ID NO: 44138 - RNA, 30 nt, synthetic construct; identical to SEQ ID NO: 28854
  misc_feature 1..30: note = derived and/or modified sequence opt5 from anti-HIV_CDR
  source 1..30: mol_type = other RNA

SEQ ID NO: 44139 - RNA, 30 nt, synthetic construct; identical to SEQ ID NO: 28855
  misc_feature 1..30: note = derived and/or modified sequence opt5 from anti-HIV_CDR
  source 1..30: mol_type = other RNA

SEQ ID NO: 44140 - RNA, 30 nt, synthetic construct; identical to SEQ ID NO: 28856
  misc_feature 1..30: note = derived and/or modified sequence opt5 from anti-HIV_CDR
  source 1..30: mol_type = other RNA

SEQ ID NO: 44141 - RNA, 30 nt, synthetic construct
  misc_feature 1..30: note = derived and/or modified sequence opt5 from anti-HIV_CDR
  source 1..30: mol_type = other RNA
cagcaaagaagcaactggccccggctgacc

SEQ ID NO: 44142 - RNA, 30 nt, synthetic construct; identical to SEQ ID NO: 28858
  misc_feature 1..30: note = derived and/or modified sequence opt5 from anti-HIV_CDR
  source 1..30: mol_type = other RNA

SEQ ID NO: 44143 - RNA, 30 nt, synthetic construct; identical to SEQ ID NO: 28859
  misc_feature 1..30: note = derived and/or modified sequence opt5 from anti-HIV_CDR
  source 1..30: mol_type = other RNA

SEQ ID NO: 44144 - RNA, 30 nt, synthetic construct; identical to SEQ ID NO: 28860
  misc_feature 1..30: note = derived and/or modified sequence opt5 from anti-HIV_CDR
  source 1..30: mol_type = other RNA

SEQ ID NO: 44145 - RNA, 30 nt, synthetic construct; identical to SEQ ID NO: 28861
  misc_feature 1..30: note = derived and/or modified sequence opt5 from anti-HIV_CDR
  source 1..30: mol_type = other RNA

SEQ ID NO: 44146 - RNA, 30 nt, synthetic construct; identical to SEQ ID NO: 28862
  misc_feature 1..30: note = derived and/or modified sequence opt5 from anti-HIV_CDR
  source 1..30: mol_type = other RNA

SEQ ID NO: 44147 - RNA, 30 nt, synthetic construct; identical to SEQ ID NO: 28863
  misc_feature 1..30: note = derived and/or modified sequence opt5 from anti-HIV_CDR
  source 1..30: mol_type = other RNA

SEQ ID NO: 44148 - RNA, 30 nt, synthetic construct
  misc_feature 1..30: note = derived and/or modified sequence opt5 from anti-HIV_CDR
  source 1..30: mol_type = other RNA
agctcctacaccatctctagccccagagtg

SEQ ID NO: 44149 - RNA, 30 nt, synthetic construct; identical to SEQ ID NO: 28865
  misc_feature 1..30: note = derived and/or modified sequence opt5 from anti-HIV_CDR
  source 1..30: mol_type = other RNA

SEQ ID NO: 44150 - RNA, 30 nt, synthetic construct; identical to SEQ ID NO: 13582
  misc_feature 1..30: note = derived and/or modified sequence opt5 from anti-HIV_CDR
  source 1..30: mol_type = other RNA

SEQ ID NO: 44151 - RNA, 30 nt, synthetic construct; identical to SEQ ID NO: 28867
  misc_feature 1..30: note = derived and/or modified sequence opt5 from anti-HIV_CDR
  source 1..30: mol_type = other RNA

SEQ ID NO: 44152 - RNA, 30 nt, synthetic construct
  misc_feature 1..30: note = derived and/or modified sequence opt5 from anti-HIV_CDR
  source 1..30: mol_type = other RNA
caggagtacggcagaagccctcccttcccg

SEQ ID NO: 44153 - RNA, 30 nt, synthetic construct; identical to SEQ ID NO: 28869
  misc_feature 1..30: note = derived and/or modified sequence opt5 from anti-HIV_CDR
  source 1..30: mol_type = other RNA

SEQ ID NO: 44154 - RNA, 30 nt, synthetic construct; identical to SEQ ID NO: 28870
  misc_feature 1..30: note = derived and/or modified sequence opt5 from anti-HIV_CDR
  source 1..30: mol_type = other RNA

SEQ ID NO: 44155 - RNA, 30 nt, synthetic construct; identical to SEQ ID NO: 28871
  misc_feature 1..30: note = derived and/or modified sequence opt5 from anti-HIV_CDR
  source 1..30: mol_type = other RNA

SEQ ID NO: 44156 - RNA, 30 nt, synthetic construct; identical to SEQ ID NO: 28872
  misc_feature 1..30: note = derived and/or modified sequence opt5 from anti-HIV_CDR
  source 1..30: mol_type = other RNA

SEQ ID NO: 44157 - RNA, 30 nt, synthetic construct; identical to SEQ ID NO: 28873
  misc_feature 1..30: note = derived and/or modified sequence opt5 from anti-HIV_CDR
  source 1..30: mol_type = other RNA

SEQ ID NO: 44158 - RNA, 30 nt, synthetic construct; identical to SEQ ID NO: 28874
  misc_feature 1..30: note = derived and/or modified sequence opt5 from anti-HIV_CDR
  source 1..30: mol_type = other RNA

SEQ ID NO: 44159 - RNA, 30 nt, synthetic construct; identical to SEQ ID NO: 28875
  misc_feature 1..30: note = derived and/or modified sequence opt5 from anti-HIV_CDR
  source 1..30: mol_type = other RNA

SEQ ID NO: 44160 - RNA, 30 nt, synthetic construct; identical to SEQ ID NO: 28876
  misc_feature 1..30: note = derived and/or modified sequence opt5 from anti-HIV_CDR
  source 1..30: mol_type = other RNA

SEQ ID NO: 44161 - RNA, 30 nt, synthetic construct; identical to SEQ ID NO: 28877
  misc_feature 1..30: note = derived and/or modified sequence opt5 from anti-HIV_CDR
  source 1..30: mol_type = other RNA

SEQ ID NO: 44162 - RNA, 30 nt, synthetic construct
  misc_feature 1..30: note = derived and/or modified sequence opt5 from anti-HIV_CDR
  source 1..30: mol_type = other RNA
cagcaatacggcagctccagacggtggacc

SEQ ID NO: 44163 - RNA, 30 nt, synthetic construct; identical to SEQ ID NO: 28879
  misc_feature 1..30: note = derived and/or modified sequence opt5 from anti-HIV_CDR
  source 1..30: mol_type = other RNA

SEQ ID NO: 44164 - RNA, 30 nt, synthetic construct; identical to SEQ ID NO: 28880
  misc_feature 1..30: note = derived and/or modified sequence opt5 from anti-HIV_CDR
  source 1..30: mol_type = other RNA

SEQ ID NO: 44165 - RNA, 30 nt, synthetic construct; identical to SEQ ID NO: 28881
  misc_feature 1..30: note = derived and/or modified sequence opt5 from anti-HIV_CDR
  source 1..30: mol_type = other RNA

SEQ ID NO: 44166 - RNA, 30 nt, synthetic construct
  misc_feature 1..30: note = derived and/or modified sequence opt5 from anti-HIV_CDR
  source 1..30: mol_type = other RNA
gtgagacggggcagctcctaccccgactat

SEQ ID NO: 44167 - RNA, 30 nt, synthetic construct; identical to SEQ ID NO: 28883
  misc_feature 1..30: note = derived and/or modified sequence opt5 from anti-HIV_CDR
  source 1..30: mol_type = other RNA

SEQ ID NO: 44168 - RNA, 30 nt, synthetic construct
  misc_feature 1..30: note = derived and/or modified sequence opt5 from anti-HIV_CDR
  source 1..30: mol_type = other RNA
cagagctacgactcctctgtgagcgtcgtt

SEQ ID NO: 44169 - RNA, 30 nt, synthetic construct
  misc_feature 1..30: note = derived and/or modified sequence opt5 from anti-HIV_CDR
  source 1..30: mol_type = other RNA
agctcctacacctctagcctgacactcgtg

SEQ ID NO: 44170 - RNA, 30 nt, synthetic construct; identical to SEQ ID NO: 28886
  misc_feature 1..30: note = derived and/or modified sequence opt5 from anti-HIV_CDR
  source 1..30: mol_type = other RNA

SEQ ID NO: 44171 - RNA, 30 nt, synthetic construct; identical to SEQ ID NO: 28887
  misc_feature 1..30: note = derived and/or modified sequence opt5 from anti-HIV_CDR
  source 1..30: mol_type = other RNA

SEQ ID NO: 44172 - RNA, 30 nt, synthetic construct; identical to SEQ ID NO: 28888
  misc_feature 1..30: note = derived and/or modified sequence opt5 from anti-HIV_CDR
  source 1..30: mol_type = other RNA

SEQ ID NO: 44173 - RNA, 30 nt, synthetic construct; identical to SEQ ID NO: 28889
  misc_feature 1..30: note = derived and/or modified sequence opt5 from anti-HIV_CDR
  source 1..30: mol_type = other RNA

SEQ ID NO: 44174 - RNA, 30 nt, synthetic construct
  misc_feature 1..30: note = derived and/or modified sequence opt5 from anti-HIV_CDR
  source 1..30: mol_type = other RNA
ggcgcctacaccacaacgagcaccctggtg

SEQ ID NO: 44175 - RNA, 30 nt, synthetic construct; identical to SEQ ID NO: 28891
  misc_feature 1..30: note = derived and/or modified sequence opt5 from anti-HIV_CDR
  source 1..30: mol_type = other RNA

SEQ ID NO: 44176 - RNA, 30 nt, synthetic construct; identical to SEQ ID NO: 28892
  misc_feature 1..30: note = derived and/or modified sequence opt5 from anti-HIV_CDR
  source 1..30: mol_type = other RNA

SEQ ID NO: 44177 - RNA, 30 nt, synthetic construct; identical to SEQ ID NO: 28893
  misc_feature 1..30: note = derived and/or modified sequence opt5 from anti-HIV_CDR
  source 1..30: mol_type = other RNA

SEQ ID NO: 44178 - RNA, 30 nt, synthetic construct; identical to SEQ ID NO: 28894
  misc_feature 1..30: note = derived and/or modified sequence opt5 from anti-HIV_CDR
  source 1..30: mol_type = other RNA

SEQ ID NO: 44179 - RNA, 30 nt, synthetic construct; identical to SEQ ID NO: 28895
  misc_feature 1..30: note = derived and/or modified sequence opt5 from anti-HIV_CDR
  source 1..30: mol_type = other RNA

SEQ ID NO: 44180 - RNA, 30 nt, synthetic construct; identical to SEQ ID NO: 28896
  misc_feature 1..30: note = derived and/or modified sequence opt5 from anti-HIV_CDR
  source 1..30: mol_type = other RNA

SEQ ID NO: 44181 - RNA, 30 nt, synthetic construct; identical to SEQ ID NO: 28897
  misc_feature 1..30: note = derived and/or modified sequence opt5 from anti-HIV_CDR
  source 1..30: mol_type = other RNA

SEQ ID NO: 44182 - RNA, 30 nt, synthetic construct; identical to SEQ ID NO: 28898
  misc_feature 1..30: note = derived and/or modified sequence opt5 from anti-HIV_CDR
  source 1..30: mol_type = other RNA

SEQ ID NO: 44183 - RNA, 30 nt, synthetic construct; identical to SEQ ID NO: 28899
  misc_feature 1..30: note = derived and/or modified sequence opt5 from anti-HIV_CDR
  source 1..30: mol_type = other RNA

SEQ ID NO: 44184 - RNA, 30 nt, synthetic construct; identical to SEQ ID NO: 28900
  misc_feature 1..30: note = derived and/or modified sequence opt5 from anti-HIV_CDR
  source 1..30: mol_type = other RNA

SEQ ID NO: 44185 - RNA, 30 nt, synthetic construct; identical to SEQ ID NO: 28901
  misc_feature 1..30: note = derived and/or modified sequence opt5 from anti-HIV_CDR
  source 1..30: mol_type = other RNA

SEQ ID NO: 44186 - RNA, 30 nt, synthetic construct; identical to SEQ ID NO: 28902
  misc_feature 1..30: note = derived and/or modified sequence opt5 from anti-HIV_CDR
  source 1..30: mol_type = other RNA

SEQ ID NO: 44187 - RNA, 30 nt, synthetic construct; identical to SEQ ID NO: 28903
  misc_feature 1..30: note = derived and/or modified sequence opt5 from anti-HIV_CDR
  source 1..30: mol_type = other RNA

SEQ ID NO: 44188 - RNA, 30 nt, synthetic construct
  misc_feature 1..30: note = derived and/or modified sequence opt5 from anti-HIV_CDR
  source 1..30: mol_type = other RNA
ggcagcttcaccacatccctgacgctcgtg

SEQ ID NO: 44189 - RNA, 30 nt, synthetic construct; identical to SEQ ID NO: 28905
  misc_feature 1..30: note = derived and/or modified sequence opt5 from anti-HIV_CDR
  source 1..30: mol_type = other RNA

SEQ ID NO: 44190 - RNA, 30 nt, synthetic construct; identical to SEQ ID NO: 28906
  misc_feature 1..30: note = derived and/or modified sequence opt5 from anti-HIV_CDR
  source 1..30: mol_type = other RNA

SEQ ID NO: 44191 - RNA, 30 nt, synthetic construct
  misc_feature 1..30: note = derived and/or modified sequence opt5 from anti-HIV_CDR
  source 1..30: mol_type = other RNA
agctcctactctagcaccaacacatatgtg

SEQ ID NO: 44192 - RNA, 30 nt, synthetic construct; identical to SEQ ID NO: 28908
  misc_feature 1..30: note = derived and/or modified sequence opt5 from anti-HIV_CDR
  source 1..30: mol_type = other RNA

SEQ ID NO: 44193 - RNA, 30 nt, synthetic construct; identical to SEQ ID NO: 28909
  misc_feature 1..30: note = derived and/or modified sequence opt5 from anti-HIV_CDR
  source 1..30: mol_type = other RNA

SEQ ID NO: 44194 - RNA, 30 nt, synthetic construct; identical to SEQ ID NO: 28910
  misc_feature 1..30: note = derived and/or modified sequence opt5 from anti-HIV_CDR
  source 1..30: mol_type = other RNA

SEQ ID NO: 44195 - RNA, 30 nt, synthetic construct; identical to SEQ ID NO: 28911
  misc_feature 1..30: note = derived and/or modified sequence opt5 from anti-HIV_CDR
  source 1..30: mol_type = other RNA

SEQ ID NO: 44196 - RNA, 30 nt, synthetic construct; identical to SEQ ID NO: 28912
  misc_feature 1..30: note = derived and/or modified sequence opt5 from anti-HIV_CDR
  source 1..30: mol_type = other RNA

SEQ ID NO: 44197 - RNA, 30 nt, synthetic construct; identical to SEQ ID NO: 13629
  misc_feature 1..30: note = derived and/or modified sequence opt5 from anti-HIV_CDR
  source 1..30: mol_type = other RNA

SEQ ID NO: 44198 - RNA, 30 nt, synthetic construct; identical to SEQ ID NO: 28914
  misc_feature 1..30: note = derived and/or modified sequence opt5 from anti-HIV_CDR
  source 1..30: mol_type = other RNA

SEQ ID NO: 44199 - RNA, 30 nt, synthetic construct; identical to SEQ ID NO: 28915
  misc_feature 1..30: note = derived and/or modified sequence opt5 from anti-HIV_CDR
  source 1..30: mol_type = other RNA

SEQ ID NO: 44200 - RNA, 30 nt, synthetic construct; identical to SEQ ID NO: 28916
  misc_feature 1..30: note = derived and/or modified sequence opt5 from anti-HIV_CDR
  source 1..30: mol_type = other RNA

SEQ ID NO: 44201 - RNA, 30 nt, synthetic construct
  misc_feature 1..30: note = derived and/or modified sequence opt5 from anti-HIV_CDR
  source 1..30: mol_type = other RNA
caggagttcggcagagcccctccctacccg

SEQ ID NO: 44202 - RNA, 30 nt, synthetic construct
  misc_feature 1..30: note = derived and/or modified sequence opt5 from anti-HIV_CDR
  source 1..30: mol_type = other RNA
caggagtacggcagaagccctccctatccg

SEQ ID NO: 44203 - RNA, 30 nt, synthetic construct
  misc_feature 1..30: note = derived and/or modified sequence opt5 from anti-HIV_CDR
  source 1..30: mol_type = other RNA
caggagtacggcagagcccctccctatccg

SEQ ID NO: 44204 - RNA, 30 nt, synthetic construct; identical to SEQ ID NO: 28920
  misc_feature 1..30: note = derived and/or modified sequence opt5 from anti-HIV_CDR
  source 1..30: mol_type = other RNA

SEQ ID NO: 44205 - RNA, 30 nt, synthetic construct; identical to SEQ ID NO: 28921
  misc_feature 1..30: note = derived and/or modified sequence opt5 from anti-HIV_CDR
  source 1..30: mol_type = other RNA

SEQ ID NO: 44206 - RNA, 30 nt, synthetic construct; identical to SEQ ID NO: 28922
  misc_feature 1..30: note = derived and/or modified sequence opt5 from anti-HIV_CDR
  source 1..30: mol_type = other RNA

SEQ ID NO: 44207 - RNA, 33 nt, synthetic construct
  misc_feature 1..33: note = derived and/or modified sequence opt5 from anti-HIV_CDR
  source 1..33: mol_type = other RNA
ggcgagaagtccagagggagccgggccgtgcag

SEQ ID NO: 44208 - RNA, 33 nt, synthetic construct; identical to SEQ ID NO: 28924
  misc_feature 1..33: note = derived and/or modified sequence opt5 from anti-HIV_CDR
  source 1..33: mol_type = other RNA

SEQ ID NO: 44209 - RNA, 33 nt, synthetic construct
  misc_feature 1..33: note = derived and/or modified sequence opt5 from anti-HIV_CDR
  source 1..33: mol_type = other RNA
ggcagacaggccctggggagccgggctgtgcaa

SEQ ID NO: 44210 - RNA, 33 nt, synthetic construct; identical to SEQ ID NO: 28926
  misc_feature 1..33: note = derived and/or modified sequence opt5 from anti-HIV_CDR
  source 1..33: mol_type = other RNA

SEQ ID NO: 44211 - RNA, 33 nt, synthetic construct; identical to SEQ ID NO: 28927
  misc_feature 1..33: note = derived and/or modified sequence opt5 from anti-HIV_CDR
  source 1..33: mol_type = other RNA

SEQ ID NO: 44212 - RNA, 33 nt, synthetic construct; identical to SEQ ID NO: 28928
  misc_feature 1..33: note = derived and/or modified sequence opt5 from anti-HIV_CDR
  source 1..33: mol_type = other RNA

SEQ ID NO: 44213 - RNA, 33 nt, synthetic construct; identical to SEQ ID NO: 28929
  misc_feature 1..33: note = derived and/or modified sequence opt5 from anti-HIV_CDR
  source 1..33: mol_type = other RNA

SEQ ID NO: 44214 - RNA, 33 nt, synthetic construct; identical to SEQ ID NO: 28930
  misc_feature 1..33: note = derived and/or modified sequence opt5 from anti-HIV_CDR
  source 1..33: mol_type = other RNA

SEQ ID NO: 44215 - RNA, 33 nt, synthetic construct
  misc_feature 1..33: note = derived and/or modified sequence opt5 from anti-HIV_CDR
  source 1..33: mol_type = other RNA
aaggccagccaggacgtgtccaccgctgtcgcc

SEQ ID NO: 44216 - RNA, 33 nt, synthetic construct
  misc_feature 1..33: note = derived and/or modified sequence opt5 from anti-HIV_CDR
  source 1..33: mol_type = other RNA
ggcagcagaaacctgtcccaccggctcctgtct

SEQ ID NO: 44217 - RNA, 33 nt, synthetic construct; identical to SEQ ID NO: 28933
  misc_feature 1..33: note = derived and/or modified sequence opt5 from anti-HIV_CDR
  source 1..33: mol_type = other RNA

SEQ ID NO: 44218 - RNA, 33 nt, synthetic construct; identical to SEQ ID NO: 28934
  misc_feature 1..33: note = derived and/or modified sequence opt5 from anti-HIV_CDR
  source 1..33: mol_type = other RNA

SEQ ID NO: 44219 - RNA, 33 nt, synthetic construct; identical to SEQ ID NO: 28935
  misc_feature 1..33: note = derived and/or modified sequence opt5 from anti-HIV_CDR
  source 1..33: mol_type = other RNA

SEQ ID NO: 44220 - RNA, 33 nt, synthetic construct; identical to SEQ ID NO: 28936
  misc_feature 1..33: note = derived and/or modified sequence opt5 from anti-HIV_CDR
  source 1..33: mol_type = other RNA

SEQ ID NO: 44221 - RNA, 33 nt, synthetic construct; identical to SEQ ID NO: 28937
  misc_feature 1..33: note = derived and/or modified sequence opt5 from anti-HIV_CDR
  source 1..33: mol_type = other RNA

SEQ ID NO: 44222 - RNA, 33 nt, synthetic construct
  misc_feature 1..33: note = derived and/or modified sequence opt5 from anti-HIV_CDR
  source 1..33: mol_type = other RNA
ctgctcctgccctactatggcgggccttggatc

SEQ ID NO: 44223 - RNA, 33 nt, synthetic construct; identical to SEQ ID NO: 28939
  misc_feature 1..33: note = derived and/or modified sequence opt5 from anti-HIV_CDR
  source 1..33: mol_type = other RNA

SEQ ID NO: 44224 - RNA, 33 nt, synthetic construct
  misc_feature 1..33: note = derived and/or modified sequence opt5 from anti-HIV_CDR
  source 1..33: mol_type = other RNA
cagagctacgacagatccctgcggggctctgtg

SEQ ID NO: 44225 - RNA, 33 nt, synthetic construct; identical to SEQ ID NO: 28941
  misc_feature 1..33: note = derived and/or modified sequence opt5 from anti-HIV_CDR
  source 1..33: mol_type = other RNA

SEQ ID NO: 44226 - RNA, 33 nt, synthetic construct; identical to SEQ ID NO: 28942
  misc_feature 1..33: note = derived and/or modified sequence opt5 from anti-HIV_CDR
  source 1..33: mol_type = other RNA

SEQ ID NO: 44227 - RNA, 33 nt, synthetic construct; identical to SEQ ID NO: 28943
  misc_feature 1..33: note = derived and/or modified sequence opt5 from anti-HIV_CDR
  source 1..33: mol_type = other RNA

SEQ ID NO: 44228 - RNA, 33 nt, synthetic construct; identical to SEQ ID NO: 28944
  misc_feature 1..33: note = derived and/or modified sequence opt5 from anti-HIV_CDR
  source 1..33: mol_type = other RNA

SEQ ID NO: 44229 - RNA, 33 nt, synthetic construct
  misc_feature 1..33: note = derived and/or modified sequence opt5 from anti-HIV_CDR
  source 1..33: mol_type = other RNA
ggcacctacgacacaagcctgtccctcagactg

SEQ ID NO: 44230 - RNA, 33 nt, synthetic construct
  misc_feature 1..33: note = derived and/or modified sequence opt5 from anti-HIV_CDR
  source 1..33: mol_type = other RNA
gccgctttcgacagcgccctgtccctccccctg

SEQ ID NO: 44231 - RNA, 33 nt, synthetic construct; identical to SEQ ID NO: 28947
  misc_feature 1..33: note = derived and/or modified sequence opt5 from anti-HIV_CDR
  source 1..33: mol_type = other RNA

SEQ ID NO: 44232 - RNA, 33 nt, synthetic construct; identical to SEQ ID NO: 28948
  misc_feature 1..33: note = derived and/or modified sequence opt5 from anti-HIV_CDR
  source 1..33: mol_type = other RNA

SEQ ID NO: 44233 - RNA, 33 nt, synthetic construct
  misc_feature 1..33: note = derived and/or modified sequence opt5 from anti-HIV_CDR
  source 1..33: mol_type = other RNA
gccacctacgacacaggcctgagcctcagactg

SEQ ID NO: 44234 - RNA, 33 nt, synthetic construct
  misc_feature 1..33: note = derived and/or modified sequence opt5 from anti-HIV_CDR
  source 1..33: mol_type = other RNA
gccgcttacgacagcaccctgtccctcagactg

SEQ ID NO: 44235 - RNA, 33 nt, synthetic construct
  misc_feature 1..33: note = derived and/or modified sequence opt5 from anti-HIV_CDR
  source 1..33: mol_type = other RNA
gccgcttacgacagcgccgtgtccctgcccgtc

SEQ ID NO: 44236 - RNA, 33 nt, synthetic construct
  misc_feature 1..33: note = derived and/or modified sequence opt5 from anti-HIV_CDR
  source 1..33: mol_type = other RNA
gccacctacgacacagatctgagcctcagactg

SEQ ID NO: 44237 - RNA, 33 nt, synthetic construct
  misc_feature 1..33: note = derived and/or modified sequence opt5 from anti-HIV_CDR
  source 1..33: mol_type = other RNA
gccgcttacgacagctccctgtctctcagactg

SEQ ID NO: 44238 - RNA, 33 nt, synthetic construct; identical to SEQ ID NO: 28954
  misc_feature 1..33: note = derived and/or modified sequence opt5 from anti-HIV_CDR
  source 1..33: mol_type = other RNA

SEQ ID NO: 44239 - RNA, 33 nt, synthetic construct; identical to SEQ ID NO: 28955
  misc_feature 1..33: note = derived and/or modified sequence opt5 from anti-HIV_CDR
  source 1..33: mol_type = other RNA

SEQ ID NO: 44240 - RNA, 33 nt, synthetic construct
  misc_feature 1..33: note = derived and/or modified sequence opt5 from anti-HIV_CDR
  source 1..33: mol_type = other RNA
gccacctacgacagccagagatccatccggctg

SEQ ID NO: 44241 - RNA, 33 nt, synthetic construct
  misc_feature 1..33: note = derived and/or modified sequence opt5 from anti-HIV_CDR
  source 1..33: mol_type = other RNA
gccgtgtacgacagctccctgtctctcggcctg

SEQ ID NO: 44242 - RNA, 33 nt, synthetic construct; identical to SEQ ID NO: 28958
  misc_feature 1..33: note = derived and/or modified sequence opt5 from anti-HIV_CDR
  source 1..33: mol_type = other RNA

SEQ ID NO: 44243 - RNA, 33 nt, synthetic construct; identical to SEQ ID NO: 28959
  misc_feature 1..33: note = derived and/or modified sequence opt5 from anti-HIV_CDR
  source 1..33: mol_type = other RNA

SEQ ID NO: 44244 - RNA, 33 nt, synthetic construct; identical to SEQ ID NO: 28960
  misc_feature 1..33: note = derived and/or modified sequence opt5 from anti-HIV_CDR
  source 1..33: mol_type = other RNA

SEQ ID NO: 44245 - RNA, 33 nt, synthetic construct; identical to SEQ ID NO: 28961
  misc_feature 1..33: note = derived and/or modified sequence opt5 from anti-HIV_CDR
  source 1..33: mol_type = other RNA

SEQ ID NO: 44246 - RNA, 33 nt, synthetic construct; identical to SEQ ID NO: 28962
  misc_feature 1..33: note = derived and/or modified sequence opt5 from anti-HIV_CDR
  source 1..33: mol_type = other RNA

SEQ ID NO: 44247 - RNA, 33 nt, synthetic construct; identical to SEQ ID NO: 28963
  misc_feature 1..33: note = derived and/or modified sequence opt5 from anti-HIV_CDR
  source 1..33: mol_type = other RNA

SEQ ID NO: 44248 - RNA, 33 nt, synthetic construct
  misc_feature 1..33: note = derived and/or modified sequence opt5 from anti-HIV_CDR
  source 1..33: mol_type = other RNA
ggcacctgggacgggagcctgacaacgggagtg

SEQ ID NO: 44249 - RNA, 33 nt, synthetic construct; identical to SEQ ID NO: 28965
  misc_feature 1..33: note = derived and/or modified sequence opt5 from anti-HIV_CDR
  source 1..33: mol_type = other RNA

SEQ ID NO: 44250 - RNA, 33 nt, synthetic construct; identical to SEQ ID NO: 28966
  misc_feature 1..33: note = derived and/or modified sequence opt5 from anti-HIV_CDR
  source 1..33: mol_type = other RNA

SEQ ID NO: 44251 - RNA, 33 nt, synthetic construct; identical to SEQ ID NO: 28967
  misc_feature 1..33: note = derived and/or modified sequence opt5 from anti-HIV_CDR
  source 1..33: mol_type = other RNA

SEQ ID NO: 44252 - RNA, 33 nt, synthetic construct; identical to SEQ ID NO: 28968
  misc_feature 1..33: note = derived and/or modified sequence opt5 from anti-HIV_CDR
  source 1..33: mol_type = other RNA

SEQ ID NO: 44253 - RNA, 33 nt, synthetic construct; identical to SEQ ID NO: 28969
  misc_feature 1..33: note = derived and/or modified sequence opt5 from anti-HIV_CDR
  source 1..33: mol_type = other RNA

SEQ ID NO: 44254 - RNA, 33 nt, synthetic construct
  misc_feature 1..33: note = derived and/or modified sequence opt5 from anti-HIV_CDR
  source 1..33: mol_type = other RNA
cagagctacgactcctctctgagcggctgggtg

SEQ ID NO: 44255 - RNA, 33 nt, synthetic construct; identical to SEQ ID NO: 28971
  misc_feature 1..33: note = derived and/or modified sequence opt5 from anti-HIV_CDR
  source 1..33: mol_type = other RNA

SEQ ID NO: 44256 - RNA, 33 nt, synthetic construct
  misc_feature 1..33: note = derived and/or modified sequence opt5 from anti-HIV_CDR
  source 1..33: mol_type = other RNA
ctgagcgccgactcctctagcacctaccaggtg

SEQ ID NO: 44257 - RNA, 33 nt, synthetic construct; identical to SEQ ID NO: 28973
  misc_feature 1..33: note = derived and/or modified sequence opt5 from anti-HIV_CDR
  source 1..33: mol_type = other RNA

SEQ ID NO: 44258 - RNA, 33 nt, synthetic construct; identical to SEQ ID NO: 28974
  misc_feature 1..33: note = derived and/or modified sequence opt5 from anti-HIV_CDR
  source 1..33: mol_type = other RNA

SEQ ID NO: 44259 - RNA, 33 nt, synthetic construct; identical to SEQ ID NO: 28975
  misc_feature 1..33: note = derived and/or modified sequence opt5 from anti-HIV_CDR
  source 1..33: mol_type = other RNA

SEQ ID NO: 44260 - RNA, 33 nt, synthetic construct
  misc_feature 1..33: note = derived and/or modified sequence opt5 from anti-HIV_CDR
  source 1..33: mol_type = other RNA
gagatggccgctaccagcgacgccttcgatatc

SEQ ID NO: 44261 - RNA, 33 nt, synthetic construct; identical to SEQ ID NO: 28977
  misc_feature 1..33: note = derived and/or modified sequence opt5 from anti-HIV_CDR
  source 1..33: mol_type = other RNA

SEQ ID NO: 44262 - RNA, 33 nt, synthetic construct; identical to SEQ ID NO: 28978
  misc_feature 1..33: note = derived and/or modified sequence opt5 from anti-HIV_CDR
  source 1..33: mol_type = other RNA

SEQ ID NO: 44263 - RNA, 33 nt, synthetic construct; identical to SEQ ID NO: 28979
  misc_feature 1..33: note = derived and/or modified sequence opt5 from anti-HIV_CDR
  source 1..33: mol_type = other RNA

SEQ ID NO: 44264 - RNA, 33 nt, synthetic construct; identical to SEQ ID NO: 28980
  misc_feature 1..33: note = derived and/or modified sequence opt5 from anti-HIV_CDR
  source 1..33: mol_type = other RNA

SEQ ID NO: 44265 - RNA, 33 nt, synthetic construct
  misc_feature 1..33: note = derived and/or modified sequence opt5 from anti-HIV_CDR
  source 1..33: mol_type = other RNA
cagcaaagaaccacatggccccctgagtacacg

SEQ ID NO: 44266 - RNA, 33 nt, synthetic construct; identical to SEQ ID NO: 28982
  misc_feature 1..33: note = derived and/or modified sequence opt5 from anti-HIV_CDR
  source 1..33: mol_type = other RNA

SEQ ID NO: 44267 - RNA, 33 nt, synthetic construct
  misc_feature 1..33: note = derived and/or modified sequence opt5 from anti-HIV_CDR
  source 1..33: mol_type = other RNA
agacggcgcagcgcctggtcccccttcgactct

SEQ ID NO: 44268 - RNA, 33 nt, synthetic construct; identical to SEQ ID NO: 28984
  misc_feature 1..33: note = derived and/or modified sequence opt5 from anti-HIV_CDR
  source 1..33: mol_type = other RNA

SEQ ID NO: 44269 - RNA, 33 nt, synthetic construct; identical to SEQ ID NO: 28985
  misc_feature 1..33: note = derived and/or modified sequence opt5 from anti-HIV_CDR
  source 1..33: mol_type = other RNA

SEQ ID NO: 44270 - RNA, 33 nt, synthetic construct; identical to SEQ ID NO: 28986
  misc_feature 1..33: note = derived and/or modified sequence opt5 from anti-HIV_CDR
  source 1..33: mol_type = other RNA

SEQ ID NO: 44271 - RNA, 33 nt, synthetic construct; identical to SEQ ID NO: 28987
  misc_feature 1..33: note = derived and/or modified sequence opt5 from anti-HIV_CDR
  source 1..33: mol_type = other RNA

SEQ ID NO: 44272 - RNA, 33 nt, synthetic construct; identical to SEQ ID NO: 28988
  misc_feature 1..33: note = derived and/or modified sequence opt5 from anti-HIV_CDR
  source 1..33: mol_type = other RNA

SEQ ID NO: 44273 - RNA, 33 nt, synthetic construct; identical to SEQ ID NO: 28989
  misc_feature 1..33: note = derived and/or modified sequence opt5 from anti-HIV_CDR
  source 1..33: mol_type = other RNA

SEQ ID NO: 44274 - RNA, 33 nt, synthetic construct; identical to SEQ ID NO: 28990
  misc_feature 1..33: note = derived and/or modified sequence opt5 from anti-HIV_CDR
  source 1..33: mol_type = other RNA

SEQ ID NO: 44275 - RNA, 33 nt, synthetic construct; identical to SEQ ID NO: 28991
  misc_feature 1..33: note = derived and/or modified sequence opt5 from anti-HIV_CDR
  source 1..33: mol_type = other RNA

SEQ ID NO: 44276 - RNA, 33 nt, synthetic construct; identical to SEQ ID NO: 28992
  misc_feature 1..33: note = derived and/or modified sequence opt5 from anti-HIV_CDR
  source 1..33: mol_type = other RNA

SEQ ID NO: 44277 - RNA, 33 nt, synthetic construct; identical to SEQ ID NO: 28993
  misc_feature 1..33: note = derived and/or modified sequence opt5 from anti-HIV_CDR
  source 1..33: mol_type = other RNA

SEQ ID NO: 44278 - RNA, 33 nt, synthetic construct; identical to SEQ ID NO: 28994
  misc_feature 1..33: note = derived and/or modified sequence opt5 from anti-HIV_CDR
  source 1..33: mol_type = other RNA

SEQ ID NO: 44279 - RNA, 33 nt, synthetic construct
  misc_feature 1..33: note = derived and/or modified sequence opt5 from anti-HIV_CDR
  source 1..33: mol_type = other RNA
ggcgggggataccccagaggcaacatggacgtg

SEQ ID NO: 44280 - RNA, 33 nt, synthetic construct
  misc_feature 1..33: note = derived and/or modified sequence opt5 from anti-HIV_CDR
  source 1..33: mol_type = other RNA
ctgctcctgctttactatggcgggccctggatc

SEQ ID NO: 44281 - RNA, 33 nt, synthetic construct; identical to SEQ ID NO: 28997
  misc_feature 1..33: note = derived and/or modified sequence opt5 from anti-HIV_CDR
  source 1..33: mol_type = other RNA

SEQ ID NO: 44282 - RNA, 33 nt, synthetic construct; identical to SEQ ID NO: 28998
  misc_feature 1..33: note = derived and/or modified sequence opt5 from anti-HIV_CDR
  source 1..33: mol_type = other RNA

SEQ ID NO: 44283 - RNA, 33 nt, synthetic construct; identical to SEQ ID NO: 28999
  misc_feature 1..33: note = derived and/or modified sequence opt5 from anti-HIV_CDR
  source 1..33: mol_type = other RNA

SEQ ID NO: 44284 - RNA, 33 nt, synthetic construct
  misc_feature 1..33: note = derived and/or modified sequence opt5 from anti-HIV_CDR
  source 1..33: mol_type = other RNA
cagcaaagaaccacacggccccctgagtacacg

SEQ ID NO: 44285 - RNA, 33 nt, synthetic construct
  misc_feature 1..33: note = derived and/or modified sequence opt5 from anti-HIV_CDR
  source 1..33: mol_type = other RNA
cagcaaagaaccacacggccccctgactacacg

SEQ ID NO: 44286 - RNA, 33 nt, synthetic construct
  misc_feature 1..33: note = derived and/or modified sequence opt5 from anti-HIV_CDR
  source 1..33: mol_type = other RNA
cagggcagaaccacacggccccctgactacacg

SEQ ID NO: 44287 - RNA, 33 nt, synthetic construct
  misc_feature 1..33: note = derived and/or modified sequence opt5 from anti-HIV_CDR
  source 1..33: mol_type = other RNA
cagcaaagaagcaccacaccccctgagtacacg

SEQ ID NO: 44288 - RNA, 33 nt, synthetic construct; identical to SEQ ID NO: 29004
  misc_feature 1..33: note = derived and/or modified sequence opt5 from anti-HIV_CDR
  source 1..33: mol_type = other RNA

SEQ ID NO: 44289 - RNA, 33 nt, synthetic construct; identical to SEQ ID NO: 29005
  misc_feature 1..33: note = derived and/or modified sequence opt5 from anti-HIV_CDR
  source 1..33: mol_type = other RNA

SEQ ID NO: 44290 - RNA, 36 nt, synthetic construct; identical to SEQ ID NO: 29006
  misc_feature 1..36: note = derived and/or modified sequence opt5 from anti-HIV_CDR
  source 1..36: mol_type = other RNA

SEQ ID NO: 44291 - RNA, 36 nt, synthetic construct; identical to SEQ ID NO: 29007
  misc_feature 1..36: note = derived and/or modified sequence opt5 from anti-HIV_CDR
  source 1..36: mol_type = other RNA

SEQ ID NO: 44292 - RNA, 36 nt, synthetic construct
  misc_feature 1..36: note = derived and/or modified sequence opt5 from anti-HIV_CDR
  source 1..36: mol_type = other RNA
cacatgtgggacagcagatccggcttctcttggagc

SEQ ID NO: 44293 - RNA, 36 nt, synthetic construct; identical to SEQ ID NO: 29009
  misc_feature 1..36: note = derived and/or modified sequence opt5 from anti-HIV_CDR
  source 1..36: mol_type = other RNA

SEQ ID NO: 44294 - RNA, 36 nt, synthetic construct; identical to SEQ ID NO: 29010
  misc_feature 1..36: note = derived and/or modified sequence opt5 from anti-HIV_CDR
  source 1..36: mol_type = other RNA

SEQ ID NO: 44295 - RNA, 36 nt, synthetic construct
  misc_feature 1..36: note = derived and/or modified sequence opt5 from anti-HIV_CDR
  source 1..36: mol_type = other RNA
cacatctacgacgccagacggcccaccaactgggtg

SEQ ID NO: 44296 - RNA, 36 nt, synthetic construct
  misc_feature 1..36: note = derived and/or modified sequence opt5 from anti-HIV_CDR
  source 1..36: mol_type = other RNA
ctggacggcgaggccttcagatactatctcgatctg

SEQ ID NO: 44297 - RNA, 36 nt, synthetic construct; identical to SEQ ID NO: 29013
  misc_feature 1..36: note = derived and/or modified sequence opt5 from anti-HIV_CDR
  source 1..36: mol_type = other RNA

SEQ ID NO: 44298 - RNA, 36 nt, synthetic construct
  misc_feature 1..36: note = derived and/or modified sequence opt5 from anti-HIV_CDR
  source 1..36: mol_type = other RNA
cccgagcctagctccatcgtggccccgctgtactat

SEQ ID NO: 44299 - RNA, 36 nt, synthetic construct
  misc_feature 1..36: note = derived and/or modified sequence opt5 from anti-HIV_CDR
  source 1..36: mol_type = other RNA
ggcgggggagacggcagaaactggcatctgcacccc

SEQ ID NO: 44300 - RNA, 36 nt, synthetic construct; identical to SEQ ID NO: 29016
  misc_feature 1..36: note = derived and/or modified sequence opt5 from anti-HIV_CDR
  source 1..36: mol_type = other RNA

SEQ ID NO: 44301 - RNA, 36 nt, synthetic construct
  misc_feature 1..36: note = derived and/or modified sequence opt5 from anti-HIV_CDR
  source 1..36: mol_type = other RNA
cccagaggcgggcgggacaactggagcttccacgtg

SEQ ID NO: 44302 - RNA, 36 nt, synthetic construct; identical to SEQ ID NO: 29018
  misc_feature 1..36: note = derived and/or modified sequence opt5 from anti-HIV_CDR
  source 1..36: mol_type = other RNA

SEQ ID NO: 44303 - RNA, 36 nt, synthetic construct; identical to SEQ ID NO: 29019
  misc_feature 1..36: note = derived and/or modified sequence opt5 from anti-HIV_CDR
  source 1..36: mol_type = other RNA

SEQ ID NO: 44304 - RNA, 36 nt, synthetic construct; identical to SEQ ID NO: 29020
  misc_feature 1..36: note = derived and/or modified sequence opt5 from anti-HIV_CDR
  source 1..36: mol_type = other RNA

SEQ ID NO: 44305 - RNA, 36 nt, synthetic construct; identical to SEQ ID NO: 29021
  misc_feature 1..36: note = derived and/or modified sequence opt5 from anti-HIV_CDR
  source 1..36: mol_type = other RNA

SEQ ID NO: 44306 - RNA, 36 nt, synthetic construct; identical to SEQ ID NO: 29022
  misc_feature 1..36: note = derived and/or modified sequence opt5 from anti-HIV_CDR
  source 1..36: mol_type = other RNA

SEQ ID NO: 44307 - RNA, 36 nt, synthetic construct; identical to SEQ ID NO: 29023
  misc_feature 1..36: note = derived and/or modified sequence opt5 from anti-HIV_CDR
  source 1..36: mol_type = other RNA

SEQ ID NO: 44308 - RNA, 36 nt, synthetic construct; identical to SEQ ID NO: 29024
  misc_feature 1..36: note = derived and/or modified sequence opt5 from anti-HIV_CDR
  source 1..36: mol_type = other RNA

SEQ ID NO: 44309 - RNA, 36 nt, synthetic construct; identical to SEQ ID NO: 29025
  misc_feature 1..36: note = derived and/or modified sequence opt5 from anti-HIV_CDR
  source 1..36: mol_type = other RNA

SEQ ID NO: 44310 - RNA, 36 nt, synthetic construct; identical to SEQ ID NO: 29026
  misc_feature 1..36: note = derived and/or modified sequence opt5 from anti-HIV_CDR
  source 1..36: mol_type = other RNA

SEQ ID NO: 44311 - RNA, 36 nt, synthetic construct; identical to SEQ ID NO: 13743
  misc_feature 1..36: note = derived and/or modified sequence opt5 from anti-HIV_CDR
  source 1..36: mol_type = other RNA

SEQ ID NO: 44312 - RNA, 36 nt, synthetic construct; identical to SEQ ID NO: 13744
  misc_feature 1..36: note = derived and/or modified sequence opt5 from anti-HIV_CDR
  source 1..36: mol_type = other RNA

SEQ ID NO: 44313 - RNA, 36 nt, synthetic construct
  misc_feature 1..36: note = derived and/or modified sequence opt5 from anti-HIV_CDR
  source 1..36: mol_type = other RNA
gtgaagcagttcctggagtggctctacctggactat

SEQ ID NO: 44314 - RNA, 36 nt, synthetic construct; identical to SEQ ID NO: 29030
  misc_feature 1..36: note = derived and/or modified sequence opt5 from anti-HIV_CDR
  source 1..36: mol_type = other RNA

SEQ ID NO: 44315 - RNA, 36 nt, synthetic construct; identical to SEQ ID NO: 29031
  misc_feature 1..36: note = derived and/or modified sequence opt5 from anti-HIV_CDR
  source 1..36: mol_type = other RNA

SEQ ID NO: 44316 - RNA, 36 nt, synthetic construct; identical to SEQ ID NO: 29032
  misc_feature 1..36: note = derived and/or modified sequence opt5 from anti-HIV_CDR
  source 1..36: mol_type = other RNA

SEQ ID NO: 44317 - RNA, 36 nt, synthetic construct
  misc_feature 1..36: note = derived and/or modified sequence opt5 from anti-HIV_CDR
  source 1..36: mol_type = other RNA
agaggcatcgccgctgccgggttctactttcagcac

SEQ ID NO: 44318 - RNA, 36 nt, synthetic construct
  misc_feature 1..36: note = derived and/or modified sequence opt5 from anti-HIV_CDR
  source 1..36: mol_type = other RNA
agaggcatcgccgctgccgcgttctactttcagacc

SEQ ID NO: 44319 - RNA, 36 nt, synthetic construct
  misc_feature 1..36: note = derived and/or modified sequence opt5 from anti-HIV_CDR
  source 1..36: mol_type = other RNA
agaggcatcgccgctgccgggttctactttcagaac

SEQ ID NO: 44320 - RNA, 36 nt, synthetic construct
  misc_feature 1..36: note = derived and/or modified sequence opt5 from anti-HIV_CDR
  source 1..36: mol_type = other RNA
cagagctacgacacctccctgacagatacgggcgtg

SEQ ID NO: 44321 - RNA, 36 nt, synthetic construct; identical to SEQ ID NO: 29037
  misc_feature 1..36: note = derived and/or modified sequence opt5 from anti-HIV_CDR
  source 1..36: mol_type = other RNA

SEQ ID NO: 44322 - RNA, 36 nt, synthetic construct; identical to SEQ ID NO: 29038
  misc_feature 1..36: note = derived and/or modified sequence opt5 from anti-HIV_CDR
  source 1..36: mol_type = other RNA

SEQ ID NO: 44323 - RNA, 36 nt, synthetic construct; identical to SEQ ID NO: 29039
  misc_feature 1..36: note = derived and/or modified sequence opt5 from anti-HIV_CDR
  source 1..36: mol_type = other RNA

SEQ ID NO: 44324 - RNA, 36 nt, synthetic construct
  misc_feature 1..36: note = derived and/or modified sequence opt5 from anti-HIV_CDR
  source 1..36: mol_type = other RNA
tgctacagcggcagatcccggtatttctttgactct

SEQ ID NO: 44325 - RNA, 36 nt, synthetic construct; identical to SEQ ID NO: 29041
  misc_feature 1..36: note = derived and/or modified sequence opt5 from anti-HIV_CDR
  source 1..36: mol_type = other RNA

SEQ ID NO: 44326 - RNA, 36 nt, synthetic construct
  misc_feature 1..36: note = derived and/or modified sequence opt5 from anti-HIV_CDR
  source 1..36: mol_type = other RNA
ctgagacggggctactatgacagcggggaggattac

SEQ ID NO: 44327 - RNA, 36 nt, synthetic construct
  misc_feature 1..36: note = derived and/or modified sequence opt5 from anti-HIV_CDR
  source 1..36: mol_type = other RNA
ctgagacggggctacttcgacagcgggggagatcac

SEQ ID NO: 44328 - RNA, 36 nt, synthetic construct
  misc_feature 1..36: note = derived and/or modified sequence opt5 from anti-HIV_CDR
  source 1..36: mol_type = other RNA
agctcctacacctctagctccacactgggcgtggtc

SEQ ID NO: 44329 - RNA, 36 nt, synthetic construct; identical to SEQ ID NO: 29045
  misc_feature 1..36: note = derived and/or modified sequence opt5 from anti-HIV_CDR
  source 1..36: mol_type = other RNA

SEQ ID NO: 44330 - RNA, 36 nt, synthetic construct
  misc_feature 1..36: note = derived and/or modified sequence opt5 from anti-HIV_CDR
  source 1..36: mol_type = other RNA
agacggggccagcgcctgctcgcctacttcgactat

SEQ ID NO: 44331 - RNA, 36 nt, synthetic construct; identical to SEQ ID NO: 29047
  misc_feature 1..36: note = derived and/or modified sequence opt5 from anti-HIV_CDR
  source 1..36: mol_type = other RNA

SEQ ID NO: 44332 - RNA, 36 nt, synthetic construct; identical to SEQ ID NO: 29048
  misc_feature 1..36: note = derived and/or modified sequence opt5 from anti-HIV_CDR
  source 1..36: mol_type = other RNA

SEQ ID NO: 44333 - RNA, 36 nt, synthetic construct
  misc_feature 1..36: note = derived and/or modified sequence opt5 from anti-HIV_CDR
  source 1..36: mol_type = other RNA
ggcagacgggaggggctgaacttcctcctggactac

SEQ ID NO: 44334 - RNA, 36 nt, synthetic construct; identical to SEQ ID NO: 29050
  misc_feature 1..36: note = derived and/or modified sequence opt5 from anti-HIV_CDR
  source 1..36: mol_type = other RNA

SEQ ID NO: 44335 - RNA, 36 nt, synthetic construct; identical to SEQ ID NO: 29051
  misc_feature 1..36: note = derived and/or modified sequence opt5 from anti-HIV_CDR
  source 1..36: mol_type = other RNA

SEQ ID NO: 44336 - RNA, 36 nt, synthetic construct; identical to SEQ ID NO: 29052
  misc_feature 1..36: note = derived and/or modified sequence opt5 from anti-HIV_CDR
  source 1..36: mol_type = other RNA

SEQ ID NO: 44337 - RNA, 36 nt, synthetic construct
  misc_feature 1..36: note = derived and/or modified sequence opt5 from anti-HIV_CDR
  source 1..36: mol_type = other RNA
gactacaccgccagaggccggcacttctttgattat

SEQ ID NO: 44338 - RNA, 36 nt, synthetic construct; identical to SEQ ID NO: 29054
  misc_feature 1..36: note = derived and/or modified sequence opt5 from anti-HIV_CDR
  source 1..36: mol_type = other RNA

SEQ ID NO: 44339 - RNA, 36 nt, synthetic construct
  misc_feature 1..36: note = derived and/or modified sequence opt5 from anti-HIV_CDR
  source 1..36: mol_type = other RNA
cagagctacgactcctctctgagcggctcctgggtg

SEQ ID NO: 44340 - RNA, 36 nt, synthetic construct; identical to SEQ ID NO: 29056
  misc_feature 1..36: note = derived and/or modified sequence opt5 from anti-HIV_CDR
  source 1..36: mol_type = other RNA

SEQ ID NO: 44341 - RNA, 36 nt, synthetic construct; identical to SEQ ID NO: 29057
  misc_feature 1..36: note = derived and/or modified sequence opt5 from anti-HIV_CDR
  source 1..36: mol_type = other RNA

SEQ ID NO: 44342 - RNA, 36 nt, synthetic construct; identical to SEQ ID NO: 29058
  misc_feature 1..36: note = derived and/or modified sequence opt5 from anti-HIV_CDR
  source 1..36: mol_type = other RNA

SEQ ID NO: 44343 - RNA, 36 nt, synthetic construct
  misc_feature 1..36: note = derived and/or modified sequence opt5 from anti-HIV_CDR
  source 1..36: mol_type = other RNA
ggcgccatcaacagctccccctcttacttcgacagc

SEQ ID NO: 44344 - RNA, 36 nt, synthetic construct; identical to SEQ ID NO: 29060
  misc_feature 1..36: note = derived and/or modified sequence opt5 from anti-HIV_CDR
  source 1..36: mol_type = other RNA

SEQ ID NO: 44345 - RNA, 39 nt, synthetic construct; identical to SEQ ID NO: 29061
  misc_feature 1..39: note = derived and/or modified sequence opt5 from anti-HIV_CDR
  source 1..39: mol_type = other RNA

SEQ ID NO: 44346 - RNA, 39 nt, synthetic construct; identical to SEQ ID NO: 29062
  misc_feature 1..39: note = derived and/or modified sequence opt5 from anti-HIV_CDR
  source 1..39: mol_type = other RNA

SEQ ID NO: 44347 - RNA, 39 nt, synthetic construct; identical to SEQ ID NO: 29063
  misc_feature 1..39: note = derived and/or modified sequence opt5 from anti-HIV_CDR
  source 1..39: mol_type = other RNA

SEQ ID NO: 44348 - RNA, 39 nt, synthetic construct; identical to SEQ ID NO: 29064
  misc_feature 1..39: note = derived and/or modified sequence opt5 from anti-HIV_CDR
  source 1..39: mol_type = other RNA

SEQ ID NO: 44349 - RNA, 39 nt, synthetic construct
  misc_feature 1..39: note = derived and/or modified sequence opt5 from anti-HIV_CDR
  source 1..39: mol_type = other RNA
gacagacgggatgacggcctggattggctcctggacccc

SEQ ID NO: 44350 - RNA, 39 nt, synthetic construct; identical to SEQ ID NO: 29066
  misc_feature 1..39: note = derived and/or modified sequence opt5 from anti-HIV_CDR
  source 1..39: mol_type = other RNA

SEQ ID NO: 44351 - RNA, 39 nt, synthetic construct; identical to SEQ ID NO: 29067
  misc_feature 1..39: note = derived and/or modified sequence opt5 from anti-HIV_CDR
  source 1..39: mol_type = other RNA

SEQ ID NO: 44352 - RNA, 39 nt, synthetic construct; identical to SEQ ID NO: 29068
  misc_feature 1..39: note = derived and/or modified sequence opt5 from anti-HIV_CDR
  source 1..39: mol_type = other RNA

SEQ ID NO: 44353 - RNA, 39 nt, synthetic construct; identical to SEQ ID NO: 29069
  misc_feature 1..39: note = derived and/or modified sequence opt5 from anti-HIV_CDR
  source 1..39: mol_type = other RNA

SEQ ID NO: 44354 - RNA, 39 nt, synthetic construct
  misc_feature 1..39: note = derived and/or modified sequence opt5 from anti-HIV_CDR
  source 1..39: mol_type = other RNA
gacagacgggatgacgatcgcgcctggctgctcgacccc

SEQ ID NO: 44355 - RNA, 39 nt, synthetic construct; identical to SEQ ID NO: 29071
  misc_feature 1..39: note = derived and/or modified sequence opt5 from anti-HIV_CDR
  source 1..39: mol_type = other RNA

SEQ ID NO: 44356 - RNA, 39 nt, synthetic construct; identical to SEQ ID NO: 29072
  misc_feature 1..39: note = derived and/or modified sequence opt5 from anti-HIV_CDR
  source 1..39: mol_type = other RNA

SEQ ID NO: 44357 - RNA, 39 nt, synthetic construct; identical to SEQ ID NO: 29073
  misc_feature 1..39: note = derived and/or modified sequence opt5 from anti-HIV_CDR
  source 1..39: mol_type = other RNA

SEQ ID NO: 44358 - RNA, 39 nt, synthetic construct; identical to SEQ ID NO: 29074
  misc_feature 1..39: note = derived and/or modified sequence opt5 from anti-HIV_CDR
  source 1..39: mol_type = other RNA

SEQ ID NO: 44359 - RNA, 39 nt, synthetic construct; identical to SEQ ID NO: 29075
  misc_feature 1..39: note = derived and/or modified sequence opt5 from anti-HIV_CDR
  source 1..39: mol_type = other RNA

SEQ ID NO: 44360 - RNA, 39 nt, synthetic construct; identical to SEQ ID NO: 29076
  misc_feature 1..39: note = derived and/or modified sequence opt5 from anti-HIV_CDR
  source 1..39: mol_type = other RNA

SEQ ID NO: 44361 - RNA, 39 nt, synthetic construct; identical to SEQ ID NO: 29077
  misc_feature 1..39: note = derived and/or modified sequence opt5 from anti-HIV_CDR
  source 1..39: mol_type = other RNA

SEQ ID NO: 44362 - RNA, 39 nt, synthetic construct; identical to SEQ ID NO: 29078
  misc_feature 1..39: note = derived and/or modified sequence opt5 from anti-HIV_CDR
  source 1..39: mol_type = other RNA

SEQ ID NO: 44363 - RNA, 39 nt, synthetic construct; identical to SEQ ID NO: 29079
  misc_feature 1..39: note = derived and/or modified sequence opt5 from anti-HIV_CDR
  source 1..39: mol_type = other RNA

SEQ ID NO: 44364 - RNA, 39 nt, synthetic construct; identical to SEQ ID NO: 29080
  misc_feature 1..39: note = derived and/or modified sequence opt5 from anti-HIV_CDR
  source 1..39: mol_type = other RNA

SEQ ID NO: 44365 - RNA, 39 nt, synthetic construct; identical to SEQ ID NO: 29081
  misc_feature 1..39: note = derived and/or modified sequence opt5 from anti-HIV_CDR
  source 1..39: mol_type = other RNA

SEQ ID NO: 44366 - RNA, 39 nt, synthetic construct; identical to SEQ ID NO: 29082
  misc_feature 1..39: note = derived and/or modified sequence opt5 from anti-HIV_CDR
  source 1..39: mol_type = other RNA

SEQ ID NO: 44367 - RNA, 39 nt, synthetic construct
  misc_feature 1..39: note = derived and/or modified sequence opt5 from anti-HIV_CDR
  source 1..39: mol_type = other RNA
aacggccacagctccctgggagggggctacttcccccat

SEQ ID NO: 44368 - RNA, 39 nt, synthetic construct; identical to SEQ ID NO: 29084
  misc_feature 1..39: note = derived and/or modified sequence opt5 from anti-HIV_CDR
  source 1..39: mol_type = other RNA

SEQ ID NO: 44369 - RNA, 39 nt, synthetic construct
  misc_feature 1..39: note = derived and/or modified sequence opt5 from anti-HIV_CDR
  source 1..39: mol_type = other RNA
gccgctagacgggccttctactattactatatggacgtg

SEQ ID NO: 44370 - RNA, 39 nt, synthetic construct; identical to SEQ ID NO: 29086
  misc_feature 1..39: note = derived and/or modified sequence opt5 from anti-HIV_CDR
  source 1..39: mol_type = other RNA

SEQ ID NO: 44371 - RNA, 39 nt, synthetic construct
  misc_feature 1..39: note = derived and/or modified sequence opt5 from anti-HIV_CDR
  source 1..39: mol_type = other RNA
cacagcagacccggcgcccctccgcattacttcgactat

SEQ ID NO: 44372 - RNA, 39 nt, synthetic construct; identical to SEQ ID NO: 29088
  misc_feature 1..39: note = derived and/or modified sequence opt5 from anti-HIV_CDR
  source 1..39: mol_type = other RNA

SEQ ID NO: 44373 - RNA, 39 nt, synthetic construct
  misc_feature 1..39: note = derived and/or modified sequence opt5 from anti-HIV_CDR
  source 1..39: mol_type = other RNA
agagaccggtacaactggaagtattactatctggatgtg

SEQ ID NO: 44374 - RNA, 39 nt, synthetic construct; identical to SEQ ID NO: 29090
  misc_feature 1..39: note = derived and/or modified sequence opt5 from anti-HIV_CDR
  source 1..39: mol_type = other RNA

SEQ ID NO: 44375 - RNA, 39 nt, synthetic construct; identical to SEQ ID NO: 29091
  misc_feature 1..39: note = derived and/or modified sequence opt5 from anti-HIV_CDR
  source 1..39: mol_type = other RNA

SEQ ID NO: 44376 - RNA, 39 nt, synthetic construct; identical to SEQ ID NO: 29092
  misc_feature 1..39: note = derived and/or modified sequence opt5 from anti-HIV_CDR
  source 1..39: mol_type = other RNA

SEQ ID NO: 44377 - RNA, 39 nt, synthetic construct; identical to SEQ ID NO: 29093
  misc_feature 1..39: note = derived and/or modified sequence opt5 from anti-HIV_CDR
  source 1..39: mol_type = other RNA

SEQ ID NO: 44378 - RNA, 39 nt, synthetic construct
  misc_feature 1..39: note = derived and/or modified sequence opt5 from anti-HIV_CDR
  source 1..39: mol_type = other RNA
gacagcagaccccaggccctggtggctgccctcgatgtc

SEQ ID NO: 44379 - RNA, 39 nt, synthetic construct; identical to SEQ ID NO: 29095
  misc_feature 1..39: note = derived and/or modified sequence opt5 from anti-HIV_CDR
  source 1..39: mol_type = other RNA

SEQ ID NO: 44380 - RNA, 39 nt, synthetic construct
  misc_feature 1..39: note = derived and/or modified sequence opt5 from anti-HIV_CDR
  source 1..39: mol_type = other RNA
agcgaccccgccatcgctgccgcgggctccctggatctc

SEQ ID NO: 44381 - RNA, 39 nt, synthetic construct
  misc_feature 1..39: note = derived and/or modified sequence opt5 from anti-HIV_CDR
  source 1..39: mol_type = other RNA
ccctacgtgcagaccgtcgccacaacgaccttcgacttt

SEQ ID NO: 44382 - RNA, 39 nt, synthetic construct; identical to SEQ ID NO: 29098
  misc_feature 1..39: note = derived and/or modified sequence opt5 from anti-HIV_CDR
  source 1..39: mol_type = other RNA

SEQ ID NO: 44383 - RNA, 39 nt, synthetic construct
  misc_feature 1..39: note = derived and/or modified sequence opt5 from anti-HIV_CDR
  source 1..39: mol_type = other RNA
ggcgccctgtggttcgggcagctcagaggactggacccc

SEQ ID NO: 44384 - RNA, 39 nt, synthetic construct
  misc_feature 1..39: note = derived and/or modified sequence opt5 from anti-HIV_CDR
  source 1..39: mol_type = other RNA
gacctgagacccatgcggggcaactgggccatgcacgtg

SEQ ID NO: 44385 - RNA, 39 nt, synthetic construct
  misc_feature 1..39: note = derived and/or modified sequence opt5 from anti-HIV_CDR
  source 1..39: mol_type = other RNA
gacccccaggtgaacagacggggcaattgcttcgatcac

SEQ ID NO: 44386 - RNA, 39 nt, synthetic construct
  misc_feature 1..39: note = derived and/or modified sequence opt5 from anti-HIV_CDR
  source 1..39: mol_type = other RNA
gacccccagatcgagattagaggcaacgccttcgatatc

SEQ ID NO: 44387 - RNA, 39 nt, synthetic construct
  misc_feature 1..39: note = derived and/or modified sequence opt5 from anti-HIV_CDR
  source 1..39: mol_type = other RNA
gtgcccagaaccacagccacgcggaacgctttcgacatc

SEQ ID NO: 44388 - RNA, 39 nt, synthetic construct
  misc_feature 1..39: note = derived and/or modified sequence opt5 from anti-HIV_CDR
  source 1..39: mol_type = other RNA
cacaagagcgtgctgctctggttcagagagctggactac

SEQ ID NO: 44389 - RNA, 39 nt, synthetic construct; identical to SEQ ID NO: 29105
  misc_feature 1..39: note = derived and/or modified sequence opt5 from anti-HIV_CDR
  source 1..39: mol_type = other RNA

SEQ ID NO: 44390 - RNA, 39 nt, synthetic construct
  misc_feature 1..39: note = derived and/or modified sequence opt5 from anti-HIV_CDR
  source 1..39: mol_type = other RNA
ctgcccagaaccacaggcatccggaacgccttcgacatt

SEQ ID NO: 44391 - RNA, 39 nt, synthetic construct
  misc_feature 1..39: note = derived and/or modified sequence opt5 from anti-HIV_CDR
  source 1..39: mol_type = other RNA
ctgcccagaaccacaggcatccggaacgccttcgacttt

SEQ ID NO: 44392 - RNA, 42 nt, synthetic construct
  misc_feature 1..42: note = derived and/or modified sequence opt5 from anti-HIV_CDR
  source 1..42: mol_type = other RNA
ggcaccctgtggttcggggagagcggactcagactggaccac

SEQ ID NO: 44393 - RNA, 42 nt, synthetic construct; identical to SEQ ID NO: 29109
  misc_feature 1..42: note = derived and/or modified sequence opt5 from anti-HIV_CDR
  source 1..42: mol_type = other RNA

SEQ ID NO: 44394 - RNA, 42 nt, synthetic construct; identical to SEQ ID NO: 29110
  misc_feature 1..42: note = derived and/or modified sequence opt5 from anti-HIV_CDR
  source 1..42: mol_type = other RNA

SEQ ID NO: 44395 - RNA, 42 nt, synthetic construct; identical to SEQ ID NO: 29111
  misc_feature 1..42: note = derived and/or modified sequence opt5 from anti-HIV_CDR
  source 1..42: mol_type = other RNA

SEQ ID NO: 44396 - RNA, 42 nt, synthetic construct; identical to SEQ ID NO: 29112
  misc_feature 1..42: note = derived and/or modified sequence opt5 from anti-HIV_CDR
  source 1..42: mol_type = other RNA

SEQ ID NO: 44397 - RNA, 42 nt, synthetic construct; identical to SEQ ID NO: 29113
  misc_feature 1..42: note = derived and/or modified sequence opt5 from anti-HIV_CDR
  source 1..42: mol_type = other RNA

SEQ ID NO: 44398 - RNA, 42 nt, synthetic construct; identical to SEQ ID NO: 29114
  misc_feature 1..42: note = derived and/or modified sequence opt5 from anti-HIV_CDR
  source 1..42: mol_type = other RNA

SEQ ID NO: 44399 - RNA, 42 nt, synthetic construct; identical to SEQ ID NO: 29115
  misc_feature 1..42: note = derived and/or modified sequence opt5 from anti-HIV_CDR
  source 1..42: mol_type = other RNA

SEQ ID NO: 44400 - RNA, 42 nt, synthetic construct
  misc_feature 1..42: note = derived and/or modified sequence opt5 from anti-HIV_CDR
  source 1..42: mol_type = other RNA
ggcagcctgtggttcggggagtccggactcagactggaccac

SEQ ID NO: 44401 - RNA, 42 nt, synthetic construct; identical to SEQ ID NO: 29117
  misc_feature 1..42: note = derived and/or modified sequence opt5 from anti-HIV_CDR
  source 1..42: mol_type = other RNA

SEQ ID NO: 44402 - RNA, 42 nt, synthetic construct; identical to SEQ ID NO: 29118
  misc_feature 1..42: note = derived and/or modified sequence opt5 from anti-HIV_CDR
  source 1..42: mol_type = other RNA

SEQ ID NO: 44403 - RNA, 42 nt, synthetic construct; identical to SEQ ID NO: 29119
  misc_feature 1..42: note = derived and/or modified sequence opt5 from anti-HIV_CDR
  source 1..42: mol_type = other RNA

SEQ ID NO: 44404 - RNA, 42 nt, synthetic construct; identical to SEQ ID NO: 29120
  misc_feature 1..42: note = derived and/or modified sequence opt5 from anti-HIV_CDR
  source 1..42: mol_type = other RNA

SEQ ID NO: 44405 - RNA, 42 nt, synthetic construct; identical to SEQ ID NO: 29121
  misc_feature 1..42: note = derived and/or modified sequence opt5 from anti-HIV_CDR
  source 1..42: mol_type = other RNA

SEQ ID NO: 44406 - RNA, 42 nt, synthetic construct; identical to SEQ ID NO: 29122
  misc_feature 1..42: note = derived and/or modified sequence opt5 from anti-HIV_CDR
  source 1..42: mol_type = other RNA

SEQ ID NO: 44407 - RNA, 42 nt, synthetic construct; identical to SEQ ID NO: 29123
  misc_feature 1..42: note = derived and/or modified sequence opt5 from anti-HIV_CDR
  source 1..42: mol_type = other RNA

SEQ ID NO: 44408 - RNA, 42 nt, synthetic construct; identical to SEQ ID NO: 29124
  misc_feature 1..42: note = derived and/or modified sequence opt5 from anti-HIV_CDR
  source 1..42: mol_type = other RNA

SEQ ID NO: 44409 - RNA, 42 nt, synthetic construct; identical to SEQ ID NO: 29125
  misc_feature 1..42: note = derived and/or modified sequence opt5 from anti-HIV_CDR
  source 1..42: mol_type = other RNA

SEQ ID NO: 44410 - RNA, 42 nt, synthetic construct
  misc_feature 1..42: note = derived and/or modified sequence opt5 from anti-HIV_CDR
  source 1..42: mol_type = other RNA
agagagatccggttcggcgaactgagcttttacttcgactat

SEQ ID NO: 44411 - RNA, 42 nt, synthetic construct
  misc_feature 1..42: note = derived and/or modified sequence opt5 from anti-HIV_CDR
  source 1..42: mol_type = other RNA
ccccacagccctaccaacatcccgtccagacccctggactac

SEQ ID NO: 44412 - RNA, 42 nt, synthetic construct; identical to SEQ ID NO: 29128
  misc_feature 1..42: note = derived and/or modified sequence opt5 from anti-HIV_CDR
  source 1..42: mol_type = other RNA

SEQ ID NO: 44413 - RNA, 42 nt, synthetic construct
  misc_feature 1..42: note = derived and/or modified sequence opt5 from anti-HIV_CDR
  source 1..42: mol_type = other RNA
agcacccctctggtgtggcccccggccaacggcctcgacgtc

SEQ ID NO: 44414 - RNA, 42 nt, synthetic construct; identical to SEQ ID NO: 29130
  misc_feature 1..42: note = derived and/or modified sequence opt5 from anti-HIV_CDR
  source 1..42: mol_type = other RNA

SEQ ID NO: 44415 - RNA, 45 nt, synthetic construct; identical to SEQ ID NO: 29131
  misc_feature 1..45: note = derived and/or modified sequence opt5 from anti-HIV_CDR
  source 1..45: mol_type = other RNA

SEQ ID NO: 44416 - RNA, 45 nt, synthetic construct
  misc_feature 1..45: note = derived and/or modified sequence opt5 from anti-HIV_CDR
  source 1..45: mol_type = other RNA
ggcagcgggagatggaccatcggagcccggatttacttcgacaac

SEQ ID NO: 44417 - RNA, 45 nt, synthetic construct; identical to SEQ ID NO: 29133
  misc_feature 1..45: note = derived and/or modified sequence opt5 from anti-HIV_CDR
  source 1..45: mol_type = other RNA

SEQ ID NO: 44418 - RNA, 45 nt, synthetic construct; identical to SEQ ID NO: 29134
  misc_feature 1..45: note = derived and/or modified sequence opt5 from anti-HIV_CDR
  source 1..45: mol_type = other RNA

SEQ ID NO: 44419 - RNA, 45 nt, synthetic construct; identical to SEQ ID NO: 29135
  misc_feature 1..45: note = derived and/or modified sequence opt5 from anti-HIV_CDR
  source 1..45: mol_type = other RNA

SEQ ID NO: 44420 - RNA, 45 nt, synthetic construct; identical to SEQ ID NO: 29136
  misc_feature 1..45: note = derived and/or modified sequence opt5 from anti-HIV_CDR
  source 1..45: mol_type = other RNA

SEQ ID NO: 44421 - RNA, 45 nt, synthetic construct; identical to SEQ ID NO: 29137
  misc_feature 1..45: note = derived and/or modified sequence opt5 from anti-HIV_CDR
  source 1..45: mol_type = other RNA

SEQ ID NO: 44422 - RNA, 45 nt, synthetic construct; identical to SEQ ID NO: 29138
  misc_feature 1..45: note = derived and/or modified sequence opt5 from anti-HIV_CDR
  source 1..45: mol_type = other RNA

SEQ ID NO: 44423 - RNA, 45 nt, synthetic construct; identical to SEQ ID NO: 29139
  misc_feature 1..45: note = derived and/or modified sequence opt5 from anti-HIV_CDR
  source 1..45: mol_type = other RNA

SEQ ID NO: 44424 - RNA, 45 nt, synthetic construct
  misc_feature 1..45: note = derived and/or modified sequence opt5 from anti-HIV_CDR
  source 1..45: mol_type = other RNA
gcccccagactggacctcggcgagctgagctccgggttccacttt

SEQ ID NO: 44425 - RNA, 45 nt, synthetic construct
  misc_feature 1..45: note = derived and/or modified sequence opt5 from anti-HIV_CDR
  source 1..45: mol_type = other RNA
gcccccagactggagctcggcgaactgagctccgggttccactac

SEQ ID NO: 44426 - RNA, 45 nt, synthetic construct
  misc_feature 1..45: note = derived and/or modified sequence opt5 from anti-HIV_CDR
  source 1..45: mol_type = other RNA
ggccggctgctcatgcagtggccccctagagggggattcgacccg

SEQ ID NO: 44427 - RNA, 45 nt, synthetic construct
  misc_feature 1..45: note = derived and/or modified sequence opt5 from anti-HIV_CDR
  source 1..45: mol_type = other RNA
ggccggctgttcatgcagtggccccctagagggggatttgacccg

SEQ ID NO: 44428 - RNA, 45 nt, synthetic construct
  misc_feature 1..45: note = derived and/or modified sequence opt5 from anti-HIV_CDR
  source 1..45: mol_type = other RNA
ggcagactgttcgtgcagtggccccctcaagggggatttgacccg

SEQ ID NO: 44429 - RNA, 45 nt, synthetic construct
  misc_feature 1..45: note = derived and/or modified sequence opt5 from anti-HIV_CDR
  source 1..45: mol_type = other RNA
ggcagactgttcatgcagtggccccctcaagggggatttgacccg

SEQ ID NO: 44430 - RNA, 45 nt, synthetic construct; identical to SEQ ID NO: 29146
  misc_feature 1..45: note = derived and/or modified sequence opt5 from anti-HIV_CDR
  source 1..45: mol_type = other RNA

SEQ ID NO: 44431 - RNA, 45 nt, synthetic construct
  misc_feature 1..45: note = derived and/or modified sequence opt5 from anti-HIV_CDR
  source 1..45: mol_type = other RNA
aacaataacaccagaaagagcatcaatattggccccgggcgggcc

SEQ ID NO: 44432 - RNA, 45 nt, synthetic construct; identical to SEQ ID NO: 29148
  misc_feature 1..45: note = derived and/or modified sequence opt5 from anti-HIV_CDR
  source 1..45: mol_type = other RNA

SEQ ID NO: 44433 - RNA, 45 nt, synthetic construct
  misc_feature 1..45: note = derived and/or modified sequence opt5 from anti-HIV_CDR
  source 1..45: mol_type = other RNA
gacctgctccccgattaccctgtgagctccgccccggaggacttc

SEQ ID NO: 44434 - RNA, 45 nt, synthetic construct; identical to SEQ ID NO: 29150
  misc_feature 1..45: note = derived and/or modified sequence opt5 from anti-HIV_CDR
  source 1..45: mol_type = other RNA

SEQ ID NO: 44435 - RNA, 45 nt, synthetic construct
  misc_feature 1..45: note = derived and/or modified sequence opt5 from anti-HIV_CDR
  source 1..45: mol_type = other RNA
agatactgcagctccaccacatgttatcggggccacttcgactac

SEQ ID NO: 44436 - RNA, 45 nt, synthetic construct; identical to SEQ ID NO: 29152
  misc_feature 1..45: note = derived and/or modified sequence opt5 from anti-HIV_CDR
  source 1..45: mol_type = other RNA

SEQ ID NO: 44437 - RNA, 45 nt, synthetic construct; identical to SEQ ID NO: 29153
  misc_feature 1..45: note = derived and/or modified sequence opt5 from anti-HIV_CDR
  source 1..45: mol_type = other RNA

SEQ ID NO: 44438 - RNA, 45 nt, synthetic construct; identical to SEQ ID NO: 29154
  misc_feature 1..45: note = derived and/or modified sequence opt5 from anti-HIV_CDR
  source 1..45: mol_type = other RNA

SEQ ID NO: 44439 - RNA, 45 nt, synthetic construct
  misc_feature 1..45: note = derived and/or modified sequence opt5 from anti-HIV_CDR
  source 1..45: mol_type = other RNA
gctccccctccgggcagcaccgagtgggcctactatttcgactac

SEQ ID NO: 44440 - RNA, 45 nt, synthetic construct; identical to SEQ ID NO: 29156
  misc_feature 1..45: note = derived and/or modified sequence opt5 from anti-HIV_CDR
  source 1..45: mol_type = other RNA

SEQ ID NO: 44441 - RNA, 45 nt, synthetic construct; identical to SEQ ID NO: 29157
  misc_feature 1..45: note = derived and/or modified sequence opt5 from anti-HIV_CDR
  source 1..45: mol_type = other RNA

SEQ ID NO: 44442 - RNA, 45 nt, synthetic construct; identical to SEQ ID NO: 29158
  misc_feature 1..45: note = derived and/or modified sequence opt5 from anti-HIV_CDR
  source 1..45: mol_type = other RNA

SEQ ID NO: 44443 - RNA, 45 nt, synthetic construct; identical to SEQ ID NO: 29159
  misc_feature 1..45: note = derived and/or modified sequence opt5 from anti-HIV_CDR
  source 1..45: mol_type = other RNA

SEQ ID NO: 44444 - RNA, 45 nt, synthetic construct; identical to SEQ ID NO: 29160
  misc_feature 1..45: note = derived and/or modified sequence opt5 from anti-HIV_CDR
  source 1..45: mol_type = other RNA

SEQ ID NO: 44445 - RNA, 45 nt, synthetic construct; identical to SEQ ID NO: 29161
  misc_feature 1..45: note = derived and/or modified sequence opt5 from anti-HIV_CDR
  source 1..45: mol_type = other RNA

SEQ ID NO: 44446 - RNA, 45 nt, synthetic construct; identical to SEQ ID NO: 29162
  misc_feature 1..45: note = derived and/or modified sequence opt5 from anti-HIV_CDR
  source 1..45: mol_type = other RNA

SEQ ID NO: 44447 - RNA, 45 nt, synthetic construct
  misc_feature 1..45: note = derived and/or modified sequence opt5 from anti-HIV_CDR
  source 1..45: mol_type = other RNA
ggcgggggatacgccgtggtcggccccaagtatgggctggacgtt

SEQ ID NO: 44448 - RNA, 45 nt, synthetic construct; identical to SEQ ID NO: 29164
  misc_feature 1..45: note = derived and/or modified sequence opt5 from anti-HIV_CDR
  source 1..45: mol_type = other RNA

SEQ ID NO: 44449 - RNA, 45 nt, synthetic construct; identical to SEQ ID NO: 29165
  misc_feature 1..45: note = derived and/or modified sequence opt5 from anti-HIV_CDR
  source 1..45: mol_type = other RNA

SEQ ID NO: 44450 - RNA, 45 nt, synthetic construct; identical to SEQ ID NO: 29166
  misc_feature 1..45: note = derived and/or modified sequence opt5 from anti-HIV_CDR
  source 1..45: mol_type = other RNA

SEQ ID NO: 44451 - RNA, 45 nt, synthetic construct; identical to SEQ ID NO: 29167
  misc_feature 1..45: note = derived and/or modified sequence opt5 from anti-HIV_CDR
  source 1..45: mol_type = other RNA

SEQ ID NO: 44452 - RNA, 45 nt, synthetic construct; identical to SEQ ID NO: 29168
  misc_feature 1..45: note = derived and/or modified sequence opt5 from anti-HIV_CDR
  source 1..45: mol_type = other RNA

SEQ ID NO: 44453 - RNA, 45 nt, synthetic construct
  misc_feature 1..45: note = derived and/or modified sequence opt5 from anti-HIV_CDR
  source 1..45: mol_type = other RNA
gacagacggcgcttcctggagtggagcctctacggcatggatgtg

SEQ ID NO: 44454 - RNA, 45 nt, synthetic construct
  misc_feature 1..45: note = derived and/or modified sequence opt5 from anti-HIV_CDR
  source 1..45: mol_type = other RNA
ggccccagagtgttctttgagagctccgggtactatttccgggac

SEQ ID NO: 44455 - RNA, 45 nt, synthetic construct
  misc_feature 1..45: note = derived and/or modified sequence opt5 from anti-HIV_CDR
  source 1..45: mol_type = other RNA
ggccccagagtgctgttcgagagctccgggcactacctccgggac

SEQ ID NO: 44456 - RNA, 45 nt, synthetic construct
  misc_feature 1..45: note = derived and/or modified sequence opt5 from anti-HIV_CDR
  source 1..45: mol_type = other RNA
ggccccagagtgttctttgagagctccgggtactatttccggaac

SEQ ID NO: 44457 - RNA, 45 nt, synthetic construct
  misc_feature 1..45: note = derived and/or modified sequence opt5 from anti-HIV_CDR
  source 1..45: mol_type = other RNA
gagggcgggagcctgtggttcggaggcgccaactggctcgacccc

SEQ ID NO: 44458 - RNA, 45 nt, synthetic construct; identical to SEQ ID NO: 29174
  misc_feature 1..45: note = derived and/or modified sequence opt5 from anti-HIV_CDR
  source 1..45: mol_type = other RNA

SEQ ID NO: 44459 - RNA, 45 nt, synthetic construct; identical to SEQ ID NO: 29175
  misc_feature 1..45: note = derived and/or modified sequence opt5 from anti-HIV_CDR
  source 1..45: mol_type = other RNA

SEQ ID NO: 44460 - RNA, 45 nt, synthetic construct
  misc_feature 1..45: note = derived and/or modified sequence opt5 from anti-HIV_CDR
  source 1..45: mol_type = other RNA
gacaacagagatcagtggctggtgctccggagctggttcgacccc

SEQ ID NO: 44461 - RNA, 45 nt, synthetic construct; identical to SEQ ID NO: 29177
  misc_feature 1..45: note = derived and/or modified sequence opt5 from anti-HIV_CDR
  source 1..45: mol_type = other RNA

SEQ ID NO: 44462 - RNA, 48 nt, synthetic construct
  misc_feature 1..48: note = derived and/or modified sequence opt5 from anti-HIV_CDR
  source 1..48: mol_type = other RNA
tacttcagcgacaccgatagatccgagtattctcccagcctgcggtcc

SEQ ID NO: 44463 - RNA, 48 nt, synthetic construct
  misc_feature 1..48: note = derived and/or modified sequence opt5 from anti-HIV_CDR
  source 1..48: mol_type = other RNA
tacatcagcgacagagagtccgccacctataacccctctctgaatagc

SEQ ID NO: 44464 - RNA, 48 nt, synthetic construct
  misc_feature 1..48: note = derived and/or modified sequence opt5 from anti-HIV_CDR
  source 1..48: mol_type = other RNA
tacttcagcgacaccgagaagtccaactataatccctctctgagaagc

SEQ ID NO: 44465 - RNA, 48 nt, synthetic construct
  misc_feature 1..48: note = derived and/or modified sequence opt5 from anti-HIV_CDR
  source 1..48: mol_type = other RNA
tacatcagcgacagagcctccgctacctataacccctctctgaatagc

SEQ ID NO: 44466 - RNA, 48 nt, synthetic construct; identical to SEQ ID NO: 29182
  misc_feature 1..48: note = derived and/or modified sequence opt5 from anti-HIV_CDR
  source 1..48: mol_type = other RNA

SEQ ID NO: 44467 - RNA, 48 nt, synthetic construct
  misc_feature 1..48: note = derived and/or modified sequence opt5 from anti-HIV_CDR
  source 1..48: mol_type = other RNA
tacgtgcacaagagcggcgacaccaactattccccctctctgaaaagc

SEQ ID NO: 44468 - RNA, 48 nt, synthetic construct; identical to SEQ ID NO: 29184
  misc_feature 1..48: note = derived and/or modified sequence opt5 from anti-HIV_CDR
  source 1..48: mol_type = other RNA

SEQ ID NO: 44469 - RNA, 48 nt, synthetic construct
  misc_feature 1..48: note = derived and/or modified sequence opt5 from anti-HIV_CDR
  source 1..48: mol_type = other RNA
tacatcagcaagtccgagtctgccaactataatcccagcctgaactcc

SEQ ID NO: 44470 - RNA, 48 nt, synthetic construct
  misc_feature 1..48: note = derived and/or modified sequence opt5 from anti-HIV_CDR
  source 1..48: mol_type = other RNA
tacatctattacagcggcagcaccaactataatccctctctgaagtcc

SEQ ID NO: 44471 - RNA, 48 nt, synthetic construct; identical to SEQ ID NO: 29187
  misc_feature 1..48: note = derived and/or modified sequence opt5 from anti-HIV_CDR
  source 1..48: mol_type = other RNA

SEQ ID NO: 44472 - RNA, 48 nt, synthetic construct; identical to SEQ ID NO: 29188
  misc_feature 1..48: note = derived and/or modified sequence opt5 from anti-HIV_CDR
  source 1..48: mol_type = other RNA

SEQ ID NO: 44473 - RNA, 48 nt, synthetic construct
  misc_feature 1..48: note = derived and/or modified sequence opt5 from anti-HIV_CDR
  source 1..48: mol_type = other RNA
ggcttcagagggagccccttttcctctggaagcctgtacttcgactcc

SEQ ID NO: 44474 - RNA, 48 nt, synthetic construct
  misc_feature 1..48: note = derived and/or modified sequence opt5 from anti-HIV_CDR
  source 1..48: mol_type = other RNA
gtgatcagcggcagaattaccatcttctactataactacattgacgtc

SEQ ID NO: 44475 - RNA, 48 nt, synthetic construct; identical to SEQ ID NO: 29191
  misc_feature 1..48: note = derived and/or modified sequence opt5 from anti-HIV_CDR
  source 1..48: mol_type = other RNA

SEQ ID NO: 44476 - RNA, 48 nt, synthetic construct; identical to SEQ ID NO: 29192
  misc_feature 1..48: note = derived and/or modified sequence opt5 from anti-HIV_CDR
  source 1..48: mol_type = other RNA

SEQ ID NO: 44477 - RNA, 48 nt, synthetic construct; identical to SEQ ID NO: 29193
  misc_feature 1..48: note = derived and/or modified sequence opt5 from anti-HIV_CDR
  source 1..48: mol_type = other RNA

SEQ ID NO: 44478 - RNA, 48 nt, synthetic construct
  misc_feature 1..48: note = derived and/or modified sequence opt5 from anti-HIV_CDR
  source 1..48: mol_type = other RNA
gacggcctgggggaggtggcccccgcttacctctatggaatcgatgcc

SEQ ID NO: 44479 - RNA, 48 nt, synthetic construct; identical to SEQ ID NO: 29195
  misc_feature 1..48: note = derived and/or modified sequence opt5 from anti-HIV_CDR
  source 1..48: mol_type = other RNA

SEQ ID NO: 44480 - RNA, 48 nt, synthetic construct; identical to SEQ ID NO: 29196
  misc_feature 1..48: note = derived and/or modified sequence opt5 from anti-HIV_CDR
  source 1..48: mol_type = other RNA

SEQ ID NO: 44481 - RNA, 48 nt, synthetic construct; identical to SEQ ID NO: 29197
  misc_feature 1..48: note = derived and/or modified sequence opt5 from anti-HIV_CDR
  source 1..48: mol_type = other RNA

SEQ ID NO: 44482 - RNA, 48 nt, synthetic construct; identical to SEQ ID NO: 29198
  misc_feature 1..48: note = derived and/or modified sequence opt5 from anti-HIV_CDR
  source 1..48: mol_type = other RNA

SEQ ID NO: 44483 - RNA, 48 nt, synthetic construct
  misc_feature 1..48: note = derived and/or modified sequence opt5 from anti-HIV_CDR
  source 1..48: mol_type = other RNA
gccgtggctggcctgtggttcgaggacgcctacaactggtttgggccc

SEQ ID NO: 44484 - RNA, 48 nt, synthetic construct; identical to SEQ ID NO: 29200
  misc_feature 1..48: note = derived and/or modified sequence opt5 from anti-HIV_CDR
  source 1..48: mol_type = other RNA

SEQ ID NO: 44485 - RNA, 48 nt, synthetic construct
  misc_feature 1..48: note = derived and/or modified sequence opt5 from anti-HIV_CDR
  source 1..48: mol_type = other RNA
gccgaggctgccagcgactcccactctagacccatcatgttcgatcat

SEQ ID NO: 44486 - RNA, 48 nt, synthetic construct; identical to SEQ ID NO: 29202
  misc_feature 1..48: note = derived and/or modified sequence opt5 from anti-HIV_CDR
  source 1..48: mol_type = other RNA

SEQ ID NO: 44487 - RNA, 48 nt, synthetic construct
  misc_feature 1..48: note = derived and/or modified sequence opt5 from anti-HIV_CDR
  source 1..48: mol_type = other RNA
gccgaggctgaaagccagtcccactctagacccatcatgttcgacagc

SEQ ID NO: 44488 - RNA, 48 nt, synthetic construct; identical to SEQ ID NO: 29204
  misc_feature 1..48: note = derived and/or modified sequence opt5 from anti-HIV_CDR
  source 1..48: mol_type = other RNA

SEQ ID NO: 44489 - RNA, 48 nt, synthetic construct
  misc_feature 1..48: note = derived and/or modified sequence opt5 from anti-HIV_CDR
  source 1..48: mol_type = other RNA
gacaaccccctgctccagagcggcgagttctcctctagcctggaaaat

SEQ ID NO: 44490 - RNA, 48 nt, synthetic construct
  misc_feature 1..48: note = derived and/or modified sequence opt5 from anti-HIV_CDR
  source 1..48: mol_type = other RNA
gacaaccccctgctccagagcggcgagttctcctctagcctggataat

SEQ ID NO: 44491 - RNA, 48 nt, synthetic construct
  misc_feature 1..48: note = derived and/or modified sequence opt5 from anti-HIV_CDR
  source 1..48: mol_type = other RNA
ggcagagactacaacttctggggagggggcgggaagatcaattttccc

SEQ ID NO: 44492 - RNA, 48 nt, synthetic construct; identical to SEQ ID NO: 29208
  misc_feature 1..48: note = derived and/or modified sequence opt5 from anti-HIV_CDR
  source 1..48: mol_type = other RNA

SEQ ID NO: 44493 - RNA, 48 nt, synthetic construct
  misc_feature 1..48: note = derived and/or modified sequence opt5 from anti-HIV_CDR
  source 1..48: mol_type = other RNA
gccggccactgcagctccacctctagcgtgtactgtcccttcgacatg

SEQ ID NO: 44494 - RNA, 48 nt, synthetic construct
  misc_feature 1..48: note = derived and/or modified sequence opt5 from anti-HIV_CDR
  source 1..48: mol_type = other RNA
caggtgagctcctactctagctccggctatagacgggagttcgactac

SEQ ID NO: 44495 - RNA, 48 nt, synthetic construct; identical to SEQ ID NO: 29211
  misc_feature 1..48: note = derived and/or modified sequence opt5 from anti-HIV_CDR
  source 1..48: mol_type = other RNA

SEQ ID NO: 44496 - RNA, 48 nt, synthetic construct
  misc_feature 1..48: note = derived and/or modified sequence opt5 from anti-HIV_CDR
  source 1..48: mol_type = other RNA
gagggcgggtacagcgacttctggtccggatattctggctttgattac

SEQ ID NO: 44497 - RNA, 48 nt, synthetic construct
  misc_feature 1..48: note = derived and/or modified sequence opt5 from anti-HIV_CDR
  source 1..48: mol_type = other RNA
ctgtactataacttcggcagcgggtacgacaccggaatcggcgatcac

SEQ ID NO: 44498 - RNA, 48 nt, synthetic construct
  misc_feature 1..48: note = derived and/or modified sequence opt5 from anti-HIV_CDR
  source 1..48: mol_type = other RNA
gccagagagggccggtggttcagcgacaactactatgctatggatgtg

SEQ ID NO: 44499 - RNA, 48 nt, synthetic construct
  misc_feature 1..48: note = derived and/or modified sequence opt5 from anti-HIV_CDR
  source 1..48: mol_type = other RNA
gacagagtgggccggcgcctgggggagctcagcgccggattcgattac

SEQ ID NO: 44500 - RNA, 48 nt, synthetic construct
  misc_feature 1..48: note = derived and/or modified sequence opt5 from anti-HIV_CDR
  source 1..48: mol_type = other RNA
gccagaccccggagcccttgggactccaccggctggtctgtggggtac

SEQ ID NO: 44501 - RNA, 48 nt, synthetic construct; identical to SEQ ID NO: 29217
  misc_feature 1..48: note = derived and/or modified sequence opt5 from anti-HIV_CDR
  source 1..48: mol_type = other RNA

SEQ ID NO: 44502 - RNA, 48 nt, synthetic construct; identical to SEQ ID NO: 29218
  misc_feature 1..48: note = derived and/or modified sequence opt5 from anti-HIV_CDR
  source 1..48: mol_type = other RNA

SEQ ID NO: 44503 - RNA, 48 nt, synthetic construct
  misc_feature 1..48: note = derived and/or modified sequence opt5 from anti-HIV_CDR
  source 1..48: mol_type = other RNA
gacaaccccgtgctgcagctcggcgagctgagctcctctcttgattac

SEQ ID NO: 44504 - RNA, 48 nt, synthetic construct
  misc_feature 1..48: note = derived and/or modified sequence opt5 from anti-HIV_CDR
  source 1..48: mol_type = other RNA
ggcttcagagggagccccttttcctctggaagcatgtacttcgactcc

SEQ ID NO: 44505 - RNA, 48 nt, synthetic construct
  misc_feature 1..48: note = derived and/or modified sequence opt5 from anti-HIV_CDR
  source 1..48: mol_type = other RNA
ggcttcagagggagccccctgtcctctggaagcctctactttgactcc

SEQ ID NO: 44506 - RNA, 48 nt, synthetic construct; identical to SEQ ID NO: 29222
  misc_feature 1..48: note = derived and/or modified sequence opt5 from anti-HIV_CDR
  source 1..48: mol_type = other RNA

SEQ ID NO: 44507 - RNA, 48 nt, synthetic construct; identical to SEQ ID NO: 29223
  misc_feature 1..48: note = derived and/or modified sequence opt5 from anti-HIV_CDR
  source 1..48: mol_type = other RNA

SEQ ID NO: 44508 - RNA, 48 nt, synthetic construct; identical to SEQ ID NO: 29224
  misc_feature 1..48: note = derived and/or modified sequence opt5 from anti-HIV_CDR
  source 1..48: mol_type = other RNA

SEQ ID NO: 44509 - RNA, 48 nt, synthetic construct; identical to SEQ ID NO: 29225
  misc_feature 1..48: note = derived and/or modified sequence opt5 from anti-HIV_CDR
  source 1..48: mol_type = other RNA

SEQ ID NO: 44510 - RNA, 51 nt, synthetic construct
  misc_feature 1..51: note = derived and/or modified sequence opt5 from anti-HIV_CDR
  source 1..51: mol_type = other RNA
tacatcagctccggctctagcaccctgcactatgccgacacagtgaagggg

SEQ ID NO: 44511 - RNA, 51 nt, synthetic construct
  misc_feature 1..51: note = derived and/or modified sequence opt5 from anti-HIV_CDR
  source 1..51: mol_type = other RNA
agatacctggactggagccccatcggccgggatacctatgggacagacgtg

SEQ ID NO: 44512 - RNA, 51 nt, synthetic construct
  misc_feature 1..51: note = derived and/or modified sequence opt5 from anti-HIV_CDR
  source 1..51: mol_type = other RNA
agatacttcgactggagcccctttcggcgcgatacctatggcacagacgtg

SEQ ID NO: 44513 - RNA, 51 nt, synthetic construct
  misc_feature 1..51: note = derived and/or modified sequence opt5 from anti-HIV_CDR
  source 1..51: mol_type = other RNA
ggcagagactacaacttctggagcgggggaggccggtattactttgatttc

SEQ ID NO: 44514 - RNA, 51 nt, synthetic construct
  misc_feature 1..51: note = derived and/or modified sequence opt5 from anti-HIV_CDR
  source 1..51: mol_type = other RNA
ggcatccaggaggactacgatttctggagagaatatcgggagctggactac

SEQ ID NO: 44515 - RNA, 51 nt, synthetic construct
  misc_feature 1..51: note = derived and/or modified sequence opt5 from anti-HIV_CDR
  source 1..51: mol_type = other RNA
gtgctgaacaataacaccagaaagagcatcaatattggccccgggcgggcc

SEQ ID NO: 44516 - RNA, 51 nt, synthetic construct; identical to SEQ ID NO: 29232
  misc_feature 1..51: note = derived and/or modified sequence opt5 from anti-HIV_CDR
  source 1..51: mol_type = other RNA

SEQ ID NO: 44517 - RNA, 51 nt, synthetic construct
  misc_feature 1..51: note = derived and/or modified sequence opt5 from anti-HIV_CDR
  source 1..51: mol_type = other RNA
cacggcagaaccgtgttcggggtcgttcggaactactattacatggacgtg

SEQ ID NO: 44518 - RNA, 51 nt, synthetic construct; identical to SEQ ID NO: 29234
  misc_feature 1..51: note = derived and/or modified sequence opt5 from anti-HIV_CDR
  source 1..51: mol_type = other RNA

SEQ ID NO: 44519 - RNA, 51 nt, synthetic construct; identical to SEQ ID NO: 29235
  misc_feature 1..51: note = derived and/or modified sequence opt5 from anti-HIV_CDR
  source 1..51: mol_type = other RNA

SEQ ID NO: 44520 - RNA, 51 nt, synthetic construct; identical to SEQ ID NO: 29236
  misc_feature 1..51: note = derived and/or modified sequence opt5 from anti-HIV_CDR
  source 1..51: mol_type = other RNA

SEQ ID NO: 44521 - RNA, 51 nt, synthetic construct
  misc_feature 1..51: note = derived and/or modified sequence opt5 from anti-HIV_CDR
  source 1..51: mol_type = other RNA
gaccagggcgggtaccccgtgagccctgtcggaccgaagtggttcgatccc

SEQ ID NO: 44522 - RNA, 51 nt, synthetic construct
  misc_feature 1..51: note = derived and/or modified sequence opt5 from anti-HIV_CDR
  source 1..51: mol_type = other RNA
agagacaagtaccagtatatcgatagctccggcgactaccccttcgatcgg

SEQ ID NO: 44523 - RNA, 51 nt, synthetic construct
  misc_feature 1..51: note = derived and/or modified sequence opt5 from anti-HIV_CDR
  source 1..51: mol_type = other RNA
cagctgagagcccccaccacacggttccgccacggcgggtactttgagaac

SEQ ID NO: 44524 - RNA, 51 nt, synthetic construct
  misc_feature 1..51: note = derived and/or modified sequence opt5 from anti-HIV_CDR
  source 1..51: mol_type = other RNA
caggtgagagcccccaccctgcggttccgccacggcgggtactttgagaca

SEQ ID NO: 44525 - RNA, 51 nt, synthetic construct; identical to SEQ ID NO: 29241
  misc_feature 1..51: note = derived and/or modified sequence opt5 from anti-HIV_CDR
  source 1..51: mol_type = other RNA

SEQ ID NO: 44526 - RNA, 51 nt, synthetic construct; identical to SEQ ID NO: 29242
  misc_feature 1..51: note = derived and/or modified sequence opt5 from anti-HIV_CDR
  source 1..51: mol_type = other RNA

SEQ ID NO: 44527 - RNA, 51 nt, synthetic construct
  misc_feature 1..51: note = derived and/or modified sequence opt5 from anti-HIV_CDR
  source 1..51: mol_type = other RNA
agcctgaccggcagactccacctgggggagctttcctctggaatcggcccc

SEQ ID NO: 44528 - RNA, 51 nt, synthetic construct; identical to SEQ ID NO: 29244
  misc_feature 1..51: note = derived and/or modified sequence opt5 from anti-HIV_CDR
  source 1..51: mol_type = other RNA

SEQ ID NO: 44529 - RNA, 51 nt, synthetic construct; identical to SEQ ID NO: 29245
  misc_feature 1..51: note = derived and/or modified sequence opt5 from anti-HIV_CDR
  source 1..51: mol_type = other RNA

SEQ ID NO: 44530 - RNA, 51 nt, synthetic construct; identical to SEQ ID NO: 29246
  misc_feature 1..51: note = derived and/or modified sequence opt5 from anti-HIV_CDR
  source 1..51: mol_type = other RNA

SEQ ID NO: 44531 - RNA, 51 nt, synthetic construct; identical to SEQ ID NO: 29247
  misc_feature 1..51: note = derived and/or modified sequence opt5 from anti-HIV_CDR
  source 1..51: mol_type = other RNA

SEQ ID NO: 44532 - RNA, 54 nt, synthetic construct; identical to SEQ ID NO: 29248
  misc_feature 1..54: note = derived and/or modified sequence opt5 from anti-HIV_CDR
  source 1..54: mol_type = other RNA

SEQ ID NO: 44533 - RNA, 54 nt, synthetic construct
  misc_feature 1..54: note = derived and/or modified sequence opt5 from anti-HIV_CDR
  source 1..54: mol_type = other RNA
aacagacgggtggccatgcccgaggctatgatcctgagcttctacatggacgtc

SEQ ID NO: 44534 - RNA, 54 nt, synthetic construct
  misc_feature 1..54: note = derived and/or modified sequence opt5 from anti-HIV_CDR
  source 1..54: mol_type = other RNA
ggcctgtgcagagggggaaactgtcggctcggccccagcgggtggctggaccct

SEQ ID NO: 44535 - RNA, 54 nt, synthetic construct
  misc_feature 1..54: note = derived and/or modified sequence opt5 from anti-HIV_CDR
  source 1..54: mol_type = other RNA
acaccccctcactacgacgtgctgaccggctatccgagctccgtcctcgagttc

SEQ ID NO: 44536 - RNA, 54 nt, synthetic construct; identical to SEQ ID NO: 29252
  misc_feature 1..54: note = derived and/or modified sequence opt5 from anti-HIV_CDR
  source 1..54: mol_type = other RNA

SEQ ID NO: 44537 - RNA, 54 nt, synthetic construct; identical to SEQ ID NO: 29253
  misc_feature 1..54: note = derived and/or modified sequence opt5 from anti-HIV_CDR
  source 1..54: mol_type = other RNA

SEQ ID NO: 44538 - RNA, 54 nt, synthetic construct; identical to SEQ ID NO: 29254
  misc_feature 1..54: note = derived and/or modified sequence opt5 from anti-HIV_CDR
  source 1..54: mol_type = other RNA

SEQ ID NO: 44539 - RNA, 54 nt, synthetic construct; identical to SEQ ID NO: 29255
  misc_feature 1..54: note = derived and/or modified sequence opt5 from anti-HIV_CDR
  source 1..54: mol_type = other RNA

SEQ ID NO: 44540 - RNA, 54 nt, synthetic construct
  misc_feature 1..54: note = derived and/or modified sequence opt5 from anti-HIV_CDR
  source 1..54: mol_type = other RNA
ggcagacagaccttccgggccatctggagcgggccccctgctgtgtttgacatt

SEQ ID NO: 44541 - RNA, 54 nt, synthetic construct
  misc_feature 1..54: note = derived and/or modified sequence opt5 from anti-HIV_CDR
  source 1..54: mol_type = other RNA
ggcagacagaccttccgggccatctggagcgggccccctgtggtctttgacatt

SEQ ID NO: 44542 - RNA, 54 nt, synthetic construct
  misc_feature 1..54: note = derived and/or modified sequence opt5 from anti-HIV_CDR
  source 1..54: mol_type = other RNA
agcagaggcgactacaacttctggtccgggtatcccgagtaccactttgatcgg

SEQ ID NO: 44543 - RNA, 54 nt, synthetic construct
  misc_feature 1..54: note = derived and/or modified sequence opt5 from anti-HIV_CDR
  source 1..54: mol_type = other RNA
ctgcccaagagcagaatggtgggcggggaccacctccctttctacccggatttt

SEQ ID NO: 44544 - RNA, 54 nt, synthetic construct; identical to SEQ ID NO: 29260
  misc_feature 1..54: note = derived and/or modified sequence opt5 from anti-HIV_CDR
  source 1..54: mol_type = other RNA

SEQ ID NO: 44545 - RNA, 54 nt, synthetic construct
  misc_feature 1..54: note = derived and/or modified sequence opt5 from anti-HIV_CDR
  source 1..54: mol_type = other RNA
ggcgggagcatgatcagaggagtgccctcccctttctactatggcatggacgtc

SEQ ID NO: 44546 - RNA, 54 nt, synthetic construct; identical to SEQ ID NO: 29262
  misc_feature 1..54: note = derived and/or modified sequence opt5 from anti-HIV_CDR
  source 1..54: mol_type = other RNA

SEQ ID NO: 44547 - RNA, 54 nt, synthetic construct
  misc_feature 1..54: note = derived and/or modified sequence opt5 from anti-HIV_CDR
  source 1..54: mol_type = other RNA
gacagatacgaggccgcttggttcggcgccgataaggtgtatgggatggacgtc

SEQ ID NO: 44548 - RNA, 54 nt, synthetic construct
  misc_feature 1..54: note = derived and/or modified sequence opt5 from anti-HIV_CDR
  source 1..54: mol_type = other RNA
gagcacagactgccccctccgaccggccggcgcacaagaaactggttcgacccc

SEQ ID NO: 44549 - RNA, 54 nt, synthetic construct
  misc_feature 1..54: note = derived and/or modified sequence opt5 from anti-HIV_CDR
  source 1..54: mol_type = other RNA
ggcagagggagcttccagggatttcaacagtacgagtattacggcatggacgtg

SEQ ID NO: 44550 - RNA, 54 nt, synthetic construct
  misc_feature 1..54: note = derived and/or modified sequence opt5 from anti-HIV_CDR
  source 1..54: mol_type = other RNA
ggcagagggtacagccacggattccagcaatataactactatggcatggacgtg

SEQ ID NO: 44551 - RNA, 54 nt, synthetic construct
  misc_feature 1..54: note = derived and/or modified sequence opt5 from anti-HIV_CDR
  source 1..54: mol_type = other RNA
ggcagagggagcttcaccggatttgaccagtaccactattacggcatggatgtg

SEQ ID NO: 44552 - RNA, 54 nt, synthetic construct; identical to SEQ ID NO: 29268
  misc_feature 1..54: note = derived and/or modified sequence opt5 from anti-HIV_CDR
  source 1..54: mol_type = other RNA

SEQ ID NO: 44553 - RNA, 54 nt, synthetic construct; identical to SEQ ID NO: 29269
  misc_feature 1..54: note = derived and/or modified sequence opt5 from anti-HIV_CDR
  source 1..54: mol_type = other RNA

SEQ ID NO: 44554 - RNA, 54 nt, synthetic construct
  misc_feature 1..54: note = derived and/or modified sequence opt5 from anti-HIV_CDR
  source 1..54: mol_type = other RNA
agaggccggctgaacatccccagcccttccgccattctcaccgctttcgacgtg

SEQ ID NO: 44555 - RNA, 54 nt, synthetic construct
  misc_feature 1..54: note = derived and/or modified sequence opt5 from anti-HIV_CDR
  source 1..54: mol_type = other RNA
ggccccgggagcatggtgagaggactgatcgtcacctcctacggcatggacgtt

SEQ ID NO: 44556 - RNA, 54 nt, synthetic construct
  misc_feature 1..54: note = derived and/or modified sequence opt5 from anti-HIV_CDR
  source 1..54: mol_type = other RNA
aagagagtgaccatcttcggcgtcgttgacacaccccgggggtactttgattat

SEQ ID NO: 44557 - RNA, 54 nt, synthetic construct
  misc_feature 1..54: note = derived and/or modified sequence opt5 from anti-HIV_CDR
  source 1..54: mol_type = other RNA
ggccagagaaacgtgctgcacttcctcgagcggaagaatgacgcctttgatatc

SEQ ID NO: 44558 - RNA, 54 nt, synthetic construct; identical to SEQ ID NO: 29274
  misc_feature 1..54: note = derived and/or modified sequence opt5 from anti-HIV_CDR
  source 1..54: mol_type = other RNA

SEQ ID NO: 44559 - RNA, 57 nt, synthetic construct
  misc_feature 1..57: note = derived and/or modified sequence opt5 from anti-HIV_CDR
  source 1..57: mol_type = other RNA
gacaccacaacgttcaccacatttggcgggggacccaacatgggcgggttcgatcct

SEQ ID NO: 44560 - RNA, 57 nt, synthetic construct
  misc_feature 1..57: note = derived and/or modified sequence opt5 from anti-HIV_CDR
  source 1..57: mol_type = other RNA
gccggcctggactacaacttctggaatgggaagggaagaaaaggcgcttttgatgtg

SEQ ID NO: 44561 - RNA, 57 nt, synthetic construct; identical to SEQ ID NO: 29277
  misc_feature 1..57: note = derived and/or modified sequence opt5 from anti-HIV_CDR
  source 1..57: mol_type = other RNA

SEQ ID NO: 44562 - RNA, 57 nt, synthetic construct; identical to SEQ ID NO: 29278
  misc_feature 1..57: note = derived and/or modified sequence opt5 from anti-HIV_CDR
  source 1..57: mol_type = other RNA

SEQ ID NO: 44563 - RNA, 57 nt, synthetic construct; identical to SEQ ID NO: 29279
  misc_feature 1..57: note = derived and/or modified sequence opt5 from anti-HIV_CDR
  source 1..57: mol_type = other RNA

SEQ ID NO: 44564 - RNA, 57 nt, synthetic construct; identical to SEQ ID NO: 29280
  misc_feature 1..57: note = derived and/or modified sequence opt5 from anti-HIV_CDR
  source 1..57: mol_type = other RNA

SEQ ID NO: 44565 - RNA, 57 nt, synthetic construct; identical to SEQ ID NO: 29281
  misc_feature 1..57: note = derived and/or modified sequence opt5 from anti-HIV_CDR
  source 1..57: mol_type = other RNA

SEQ ID NO: 44566 - RNA, 57 nt, synthetic construct; identical to SEQ ID NO: 29282
  misc_feature 1..57: note = derived and/or modified sequence opt5 from anti-HIV_CDR
  source 1..57: mol_type = other RNA

SEQ ID NO: 44567 - RNA, 57 nt, synthetic construct; identical to SEQ ID NO: 29283
  misc_feature 1..57: note = derived and/or modified sequence opt5 from anti-HIV_CDR
  source 1..57: mol_type = other RNA

SEQ ID NO: 44568 - RNA, 57 nt, synthetic construct; identical to SEQ ID NO: 29284
  misc_feature 1..57: note = derived and/or modified sequence opt5 from anti-HIV_CDR
  source 1..57: mol_type = other RNA

SEQ ID NO: 44569 - RNA, 57 nt, synthetic construct; identical to SEQ ID NO: 29285
  misc_feature 1..57: note = derived and/or modified sequence opt5 from anti-HIV_CDR
  source 1..57: mol_type = other RNA

SEQ ID NO: 44570 - RNA, 57 nt, synthetic construct; identical to SEQ ID NO: 29286
  misc_feature 1..57: note = derived and/or modified sequence opt5 from anti-HIV_CDR
  source 1..57: mol_type = other RNA

SEQ ID NO: 44571 - RNA, 57 nt, synthetic construct
  misc_feature 1..57: note = derived and/or modified sequence opt5 from anti-HIV_CDR
  source 1..57: mol_type = other RNA
accaacggcacagagatcttcagacccgggggaggcgacatgcgggataattggcgc

SEQ ID NO: 44572 - RNA, 57 nt, synthetic construct; identical to SEQ ID NO: 29288
  misc_feature 1..57: note = derived and/or modified sequence opt5 from anti-HIV_CDR
  source 1..57: mol_type = other RNA

SEQ ID NO: 44573 - RNA, 57 nt, synthetic construct; identical to SEQ ID NO: 29289
  misc_feature 1..57: note = derived and/or modified sequence opt5 from anti-HIV_CDR
  source 1..57: mol_type = other RNA

SEQ ID NO: 44574 - RNA, 57 nt, synthetic construct
  misc_feature 1..57: note = derived and/or modified sequence opt5 from anti-HIV_CDR
  source 1..57: mol_type = other RNA
ggcgccacctactattacgacagctccgggcaccagtctagacgggctttcgatatc

SEQ ID NO: 44575 - RNA, 57 nt, synthetic construct; identical to SEQ ID NO: 29291
  misc_feature 1..57: note = derived and/or modified sequence opt5 from anti-HIV_CDR
  source 1..57: mol_type = other RNA

SEQ ID NO: 44576 - RNA, 57 nt, synthetic construct
  misc_feature 1..57: note = derived and/or modified sequence opt5 from anti-HIV_CDR
  source 1..57: mol_type = other RNA
cacagagccgactacgatttctggaacggcagcaatctgcgggggtattttgacccc

SEQ ID NO: 44577 - RNA, 57 nt, synthetic construct
  misc_feature 1..57: note = derived and/or modified sequence opt5 from anti-HIV_CDR
  source 1..57: mol_type = other RNA
cacagagccaactacgacttctggggcgggagcaatctgcggggatattttgatccc

SEQ ID NO: 44578 - RNA, 57 nt, synthetic construct
  misc_feature 1..57: note = derived and/or modified sequence opt5 from anti-HIV_CDR
  source 1..57: mol_type = other RNA
ggcttccacttttggagcgggaccggaacaagaccccggaactggtacttcgacctg

SEQ ID NO: 44579 - RNA, 57 nt, synthetic construct; identical to SEQ ID NO: 29295
  misc_feature 1..57: note = derived and/or modified sequence opt5 from anti-HIV_CDR
  source 1..57: mol_type = other RNA

SEQ ID NO: 44580 - RNA, 57 nt, synthetic construct; identical to SEQ ID NO: 29296
  misc_feature 1..57: note = derived and/or modified sequence opt5 from anti-HIV_CDR
  source 1..57: mol_type = other RNA

SEQ ID NO: 44581 - RNA, 57 nt, synthetic construct
  misc_feature 1..57: note = derived and/or modified sequence opt5 from anti-HIV_CDR
  source 1..57: mol_type = other RNA
gacaccacaacgttcggcgcctttgggggaagccccaacatgggcgggctggatcct

SEQ ID NO: 44582 - RNA, 57 nt, synthetic construct
  misc_feature 1..57: note = derived and/or modified sequence opt5 from anti-HIV_CDR
  source 1..57: mol_type = other RNA
cacctggtggtcgccgttgctgccggccccgactacttcagctatgggatggatgtg

SEQ ID NO: 44583 - RNA, 57 nt, synthetic construct
  misc_feature 1..57: note = derived and/or modified sequence opt5 from anti-HIV_CDR
  source 1..57: mol_type = other RNA
gacaccacaacgttcagctcctttggctctccccctaacatgggagggctggatccg

SEQ ID NO: 44584 - RNA, 57 nt, synthetic construct
  misc_feature 1..57: note = derived and/or modified sequence opt5 from anti-HIV_CDR
  source 1..57: mol_type = other RNA
gacaccacaacgttcggcgcctttgggggaggcgctaacatgggagggctggatccc

SEQ ID NO: 44585 - RNA, 57 nt, synthetic construct
  misc_feature 1..57: note = derived and/or modified sequence opt5 from anti-HIV_CDR
  source 1..57: mol_type = other RNA
gacaccacaacgttcaccagctttggctcccctcccagaatgggagggctggatccg

SEQ ID NO: 44586 - RNA, 57 nt, synthetic construct
  misc_feature 1..57: note = derived and/or modified sequence opt5 from anti-HIV_CDR
  source 1..57: mol_type = other RNA
gacaccacaacgttcagctcctttggctctccccctcacatgggagggctggatccg

SEQ ID NO: 44587 - RNA, 57 nt, synthetic construct
  misc_feature 1..57: note = derived and/or modified sequence opt5 from anti-HIV_CDR
  source 1..57: mol_type = other RNA
gacagagtgagcgattacgacttctggtccggcaagcgggggtatggaatggatgtc

SEQ ID NO: 44588 - RNA, 57 nt, synthetic construct; identical to SEQ ID NO: 29304
  misc_feature 1..57: note = derived and/or modified sequence opt5 from anti-HIV_CDR
  source 1..57: mol_type = other RNA

SEQ ID NO: 44589 - RNA, 57 nt, synthetic construct; identical to SEQ ID NO: 29305
  misc_feature 1..57: note = derived and/or modified sequence opt5 from anti-HIV_CDR
  source 1..57: mol_type = other RNA

SEQ ID NO: 44590 - RNA, 57 nt, synthetic construct
  misc_feature 1..57: note = derived and/or modified sequence opt5 from anti-HIV_CDR
  source 1..57: mol_type = other RNA
cacggcgccagcgctaactacgggcccggatcctattctgccgagcatttccagcac

SEQ ID NO: 44591 - RNA, 60 nt, synthetic construct
  misc_feature 1..60: note = derived and/or modified sequence opt5 from anti-HIV_CDR
  source 1..60: mol_type = other RNA
cacgaggcccccagatacagctatgctttccggcgctactatcattacggcctggacgtg

SEQ ID NO: 44592 - RNA, 60 nt, synthetic construct
  misc_feature 1..60: note = derived and/or modified sequence opt5 from anti-HIV_CDR
  source 1..60: mol_type = other RNA
accagcacatacgaccagtggtccggcctgcaccatgatggggtgatggccttctctagc

SEQ ID NO: 44593 - RNA, 60 nt, synthetic construct; identical to SEQ ID NO: 29309
  misc_feature 1..60: note = derived and/or modified sequence opt5 from anti-HIV_CDR
  source 1..60: mol_type = other RNA

SEQ ID NO: 44594 - RNA, 60 nt, synthetic construct; identical to SEQ ID NO: 29310
  misc_feature 1..60: note = derived and/or modified sequence opt5 from anti-HIV_CDR
  source 1..60: mol_type = other RNA

SEQ ID NO: 44595 - RNA, 60 nt, synthetic construct; identical to SEQ ID NO: 29311
  misc_feature 1..60: note = derived and/or modified sequence opt5 from anti-HIV_CDR
  source 1..60: mol_type = other RNA

SEQ ID NO: 44596 - RNA, 60 nt, synthetic construct
  misc_feature 1..60: note = derived and/or modified sequence opt5 from anti-HIV_CDR
  source 1..60: mol_type = other RNA
aacctgatcgaggaaagccagacccaacaggagattaatgaaagagacctcctggccctt

SEQ ID NO: 44597 - RNA, 60 nt, synthetic construct
  misc_feature 1..60: note = derived and/or modified sequence opt5 from anti-HIV_CDR
  source 1..60: mol_type = other RNA
aacctgatcgaggaaagccagattcaacaggagaagaatgaaaaagagctcctggaactt

SEQ ID NO: 44598 - RNA, 60 nt, synthetic construct
  misc_feature 1..60: note = derived and/or modified sequence opt5 from anti-HIV_CDR
  source 1..60: mol_type = other RNA
agcctgatcgagaactcccagattcaacaggaaaagaatgagcaggacctcctgcagctt

SEQ ID NO: 44599 - RNA, 60 nt, synthetic construct
  misc_feature 1..60: note = derived and/or modified sequence opt5 from anti-HIV_CDR
  source 1..60: mol_type = other RNA
agcctgatcgaggaatcccagattcaacaggagaagaacgaaaaagagctcctggaactt

SEQ ID NO: 44600 - RNA, 60 nt, synthetic construct
  misc_feature 1..60: note = derived and/or modified sequence opt5 from anti-HIV_CDR
  source 1..60: mol_type = other RNA
agactgatcgaggaaagccagacccaacaggagaagaacgaacaggagctcctggaactt

SEQ ID NO: 44601 - RNA, 60 nt, synthetic construct
  misc_feature 1..60: note = derived and/or modified sequence opt5 from anti-HIV_CDR
  source 1..60: mol_type = other RNA
agcctgatcgaggaatcccagacccaacaggagaagaacgaaaaagagctcctggaactt

SEQ ID NO: 44602 - RNA, 60 nt, synthetic construct
  misc_feature 1..60: note = derived and/or modified sequence opt5 from anti-HIV_CDR
  source 1..60: mol_type = other RNA
aacctgctcgaggaaagccagaatcaacaggagaagaacgaacaggagctgcttgaactg

SEQ ID NO: 44603 - RNA, 60 nt, synthetic construct
  misc_feature 1..60: note = derived and/or modified sequence opt5 from anti-HIV_CDR
  source 1..60: mol_type = other RNA
accctgatcgaggaaagccagaaccaacaggagaagaatgaactcgagctgcttgaactg

SEQ ID NO: 44604 - RNA, 60 nt, synthetic construct
  misc_feature 1..60: note = derived and/or modified sequence opt5 from anti-HIV_CDR
  source 1..60: mol_type = other RNA
accctgcaggaggaaagccaaaaccagcaggagaagaatgaacaggagctcctggaactt

SEQ ID NO: 44605 - RNA, 60 nt, synthetic construct
  misc_feature 1..60: note = derived and/or modified sequence opt5 from anti-HIV_CDR
  source 1..60: mol_type = other RNA
agcctgctcgaggaatcccagaaccaacaggagaagaatgaacaggagctgcttgaactg

SEQ ID NO: 44606 - RNA, 60 nt, synthetic construct
  misc_feature 1..60: note = derived and/or modified sequence opt5 from anti-HIV_CDR
  source 1..60: mol_type = other RNA
accctgatcgaggaaagccagaaccaacaggagaagaatcagcaggaactcctgcaactt

SEQ ID NO: 44607 - RNA, 60 nt, synthetic construct
  misc_feature 1..60: note = derived and/or modified sequence opt5 from anti-HIV_CDR
  source 1..60: mol_type = other RNA
accctgatcgaggaaagccagaaccaacaggagaagaatgaacaggagctcctgggcctt

SEQ ID NO: 44608 - RNA, 60 nt, synthetic construct
  misc_feature 1..60: note = derived and/or modified sequence opt5 from anti-HIV_CDR
  source 1..60: mol_type = other RNA
accctgatcgaggaaagccagaaccaacaggagaagaatgaacaggagctcctggaactt

SEQ ID NO: 44609 - RNA, 60 nt, synthetic construct
  misc_feature 1..60: note = derived and/or modified sequence opt5 from anti-HIV_CDR
  source 1..60: mol_type = other RNA
agcctgatcgaggactcccagattcaacaggaaaagaacgagaaagaactcctggagctt

SEQ ID NO: 44610 - RNA, 60 nt, synthetic construct
  misc_feature 1..60: note = derived and/or modified sequence opt5 from anti-HIV_CDR
  source 1..60: mol_type = other RNA
agcctgctcgagaagtcccagacccaacaggagaaaaacgaacaggaactgcttgagctg

SEQ ID NO: 44611 - RNA, 60 nt, synthetic construct
  misc_feature 1..60: note = derived and/or modified sequence opt5 from anti-HIV_CDR
  source 1..60: mol_type = other RNA
agcctgatcgaggaatcccagaaccaacaggagaagaatgaacaggagctcctggaactt

SEQ ID NO: 44612 - RNA, 60 nt, synthetic construct; identical to SEQ ID NO: 29328
  misc_feature 1..60: note = derived and/or modified sequence opt5 from anti-HIV_CDR
  source 1..60: mol_type = other RNA

SEQ ID NO: 44613 - RNA, 60 nt, synthetic construct
  misc_feature 1..60: note = derived and/or modified sequence opt5 from anti-HIV_CDR
  source 1..60: mol_type = other RNA
gacaccaacggcacagagatcttcagacccgggggaggcgatatgcgggacaattggcgc

SEQ ID NO: 44614 - RNA, 60 nt, synthetic construct
  misc_feature 1..60: note = derived and/or modified sequence opt5 from anti-HIV_CDR
  source 1..60: mol_type = other RNA
gacgtggtcgagagacccggcttcggggattttcggtacgactattacggaatggatgtt

SEQ ID NO: 44615 - RNA, 60 nt, synthetic construct
  misc_feature 1..60: note = derived and/or modified sequence opt5 from anti-HIV_CDR
  source 1..60: mol_type = other RNA
gaccagagagattgcagcaccaaccggtgtttcggcgtgtttgggtactatatggacgtc

SEQ ID NO: 44616 - RNA, 60 nt, synthetic construct
  misc_feature 1..60: note = derived and/or modified sequence opt5 from anti-HIV_CDR
  source 1..60: mol_type = other RNA
gacagatgggtgcggccccagttccctagcatggattttcaatacaacggcctggacgtc

SEQ ID NO: 44617 - RNA, 60 nt, synthetic construct; identical to SEQ ID NO: 29333
  misc_feature 1..60: note = derived and/or modified sequence opt5 from anti-HIV_CDR
  source 1..60: mol_type = other RNA

SEQ ID NO: 44618 - RNA, 60 nt, synthetic construct; identical to SEQ ID NO: 29334
  misc_feature 1..60: note = derived and/or modified sequence opt5 from anti-HIV_CDR
  source 1..60: mol_type = other RNA

SEQ ID NO: 44619 - RNA, 60 nt, synthetic construct; identical to SEQ ID NO: 29335
  misc_feature 1..60: note = derived and/or modified sequence opt5 from anti-HIV_CDR
  source 1..60: mol_type = other RNA

SEQ ID NO: 44620 - RNA, 60 nt, synthetic construct; identical to SEQ ID NO: 29336
  misc_feature 1..60: note = derived and/or modified sequence opt5 from anti-HIV_CDR
  source 1..60: mol_type = other RNA

SEQ ID NO: 44621 - RNA, 60 nt, synthetic construct
  misc_feature 1..60: note = derived and/or modified sequence opt5 from anti-HIV_CDR
  source 1..60: mol_type = other RNA
gagagaagcaccaagtactccttctggtctgccgtgatgcggcccgacgcttttgatctg

SEQ ID NO: 44622 - RNA, 60 nt, synthetic construct
  misc_feature 1..60: note = derived and/or modified sequence opt5 from anti-HIV_CDR
  source 1..60: mol_type = other RNA
cacgaggcccccagatacagctatgctttccggaactactatcattacggcctggacgtg

SEQ ID NO: 44623 - RNA, 60 nt, synthetic construct; identical to SEQ ID NO: 29339
  misc_feature 1..60: note = derived and/or modified sequence opt5 from anti-HIV_CDR
  source 1..60: mol_type = other RNA

SEQ ID NO: 44624 - RNA, 60 nt, synthetic construct; identical to SEQ ID NO: 29340
  misc_feature 1..60: note = derived and/or modified sequence opt5 from anti-HIV_CDR
  source 1..60: mol_type = other RNA

SEQ ID NO: 44625 - RNA, 60 nt, synthetic construct; identical to SEQ ID NO: 29341
  misc_feature 1..60: note = derived and/or modified sequence opt5 from anti-HIV_CDR
  source 1..60: mol_type = other RNA

SEQ ID NO: 44626 - RNA, 63 nt, synthetic construct
  misc_feature 1..63: note = derived and/or modified sequence opt5 from anti-HIV_CDR
  source 1..63: mol_type = other RNA
gacagaagctccgccatcggctactgctctagcatttcctgttataaggggtctttcgatatc

SEQ ID NO: 44627 - RNA, 63 nt, synthetic construct
  misc_feature 1..63: note = derived and/or modified sequence opt5 from anti-HIV_CDR
  source 1..63: mol_type = other RNA
gtggtcaagatcgagcccctgggcgttgcccctaccaaagctaagagagtggcccgggaaaaa

SEQ ID NO: 44628 - RNA, 63 nt, synthetic construct
  misc_feature 1..63: note = derived and/or modified sequence opt5 from anti-HIV_CDR
  source 1..63: mol_type = other RNA
gtggtcagaatcgagcccctgggcgttgcccctaccaaggctaaacgggtggaacgcgagaag

SEQ ID NO: 44629 - RNA, 63 nt, synthetic construct
  misc_feature 1..63: note = derived and/or modified sequence opt5 from anti-HIV_CDR
  source 1..63: mol_type = other RNA
gtggtcagaatcgagcccctgggcattgcccctacccgggctaagcgcgttgaaagagagaaa

SEQ ID NO: 44630 - RNA, 63 nt, synthetic construct
  misc_feature 1..63: note = derived and/or modified sequence opt5 from anti-HIV_CDR
  source 1..63: mol_type = other RNA
gtggtcaagatcgagcccattggcgttgcccctaccaaagctagacgggtggaacgcgagaag

SEQ ID NO: 44631 - RNA, 63 nt, synthetic construct
  misc_feature 1..63: note = derived and/or modified sequence opt5 from anti-HIV_CDR
  source 1..63: mol_type = other RNA
gtggtcaagatcgagcccctgggcgttgcccctaccagagctaaacgggtggaacgcgagaag

SEQ ID NO: 44632 - RNA, 63 nt, synthetic construct
  misc_feature 1..63: note = derived and/or modified sequence opt5 from anti-HIV_CDR
  source 1..63: mol_type = other RNA
gtggtccagatcgagcccctgggcgttgcccctaccagagctaagcgggtggaacgcgagaaa

SEQ ID NO: 44633 - RNA, 63 nt, synthetic construct
  misc_feature 1..63: note = derived and/or modified sequence opt5 from anti-HIV_CDR
  source 1..63: mol_type = other RNA
gtggtcagaatcgagcccctgggcgttgcccctaccaaggctaaacgggtgcagcgcgaaaag

SEQ ID NO: 44634 - RNA, 63 nt, synthetic construct
  misc_feature 1..63: note = derived and/or modified sequence opt5 from anti-HIV_CDR
  source 1..63: mol_type = other RNA
gtggtcaagatcgagcccctgggcgttgcccctaccaaagctaagagagtgcagcggaaaaag

SEQ ID NO: 44635 - RNA, 63 nt, synthetic construct
  misc_feature 1..63: note = derived and/or modified sequence opt5 from anti-HIV_CDR
  source 1..63: mol_type = other RNA
gtgatcaagattgagcccctgatcgtcgcccctaccaaagctaagagagttcagcgggaaaaa

SEQ ID NO: 44636 - RNA, 63 nt, synthetic construct
  misc_feature 1..63: note = derived and/or modified sequence opt5 from anti-HIV_CDR
  source 1..63: mol_type = other RNA
gtggtcaagatcgagcccctgggcgttgcccctaccaaagctagacgggtgcagcgcgaaaag

SEQ ID NO: 44637 - RNA, 63 nt, synthetic construct
  misc_feature 1..63: note = derived and/or modified sequence opt5 from anti-HIV_CDR
  source 1..63: mol_type = other RNA
gtggtcaagatcgagctgctcggcgttgcccccaccaaagctaagagagtgcagcgggaaaaa

SEQ ID NO: 44638 - RNA, 63 nt, synthetic construct
  misc_feature 1..63: note = derived and/or modified sequence opt5 from anti-HIV_CDR
  source 1..63: mol_type = other RNA
gtggtcaccatcgagcccctgggcgttgcccctacaaaggctaaaagagtgcagcgggaaaag

SEQ ID NO: 44639 - RNA, 63 nt, synthetic construct
  misc_feature 1..63: note = derived and/or modified sequence opt5 from anti-HIV_CDR
  source 1..63: mol_type = other RNA
gtggtcaagatcgagcccctgggcgttgcccctaccaaagctaagagagtgcagcgggaaaaa

SEQ ID NO: 44640 - RNA, 63 nt, synthetic construct
  misc_feature 1..63: note = derived and/or modified sequence opt5 from anti-HIV_CDR
  source 1..63: mol_type = other RNA
gacctggtgagcgtctcccctccctacggcaactatgggccggataataactggttcgacttt

SEQ ID NO: 44641 - RNA, 63 nt, synthetic construct
  misc_feature 1..63: note = derived and/or modified sequence opt5 from anti-HIV_CDR
  source 1..63: mol_type = other RNA
atgaatcccccttggttcagaggcgggagcaacaacccgtactcctattactatatggacgtg

SEQ ID NO: 44642 - RNA, 63 nt, synthetic construct; identical to SEQ ID NO: 29358
  misc_feature 1..63: note = derived and/or modified sequence opt5 from anti-HIV_CDR
  source 1..63: mol_type = other RNA

SEQ ID NO: 44643 - RNA, 63 nt, synthetic construct; identical to SEQ ID NO: 29359
  misc_feature 1..63: note = derived and/or modified sequence opt5 from anti-HIV_CDR
  source 1..63: mol_type = other RNA

SEQ ID NO: 44644 - RNA, 63 nt, synthetic construct
  misc_feature 1..63: note = derived and/or modified sequence opt5 from anti-HIV_CDR
  source 1..63: mol_type = other RNA
gacttcgtgagcatctacggcgtcgcctattttaccgggggaggcccctcctctcctgatatt

SEQ ID NO: 44645 - RNA, 66 nt, synthetic construct; identical to SEQ ID NO: 29361
  misc_feature 1..66: note = derived and/or modified sequence opt5 from anti-HIV_CDR
  source 1..66: mol_type = other RNA

SEQ ID NO: 44646 - RNA, 66 nt, synthetic construct; identical to SEQ ID NO: 29362
  misc_feature 1..66: note = derived and/or modified sequence opt5 from anti-HIV_CDR
  source 1..66: mol_type = other RNA

SEQ ID NO: 44647 - RNA, 66 nt, synthetic construct; identical to SEQ ID NO: 29363
  misc_feature 1..66: note = derived and/or modified sequence opt5 from anti-HIV_CDR
  source 1..66: mol_type = other RNA

SEQ ID NO: 44648 - RNA, 66 nt, synthetic construct
  misc_feature 1..66: note = derived and/or modified sequence opt5 from anti-HIV_CDR
  source 1..66: mol_type = other RNA
gacgaggccagctgggtggaagctgccgatgagtgggacgaacacctgttcagagagatggcggtc

SEQ ID NO: 44649 - RNA, 66 nt, synthetic construct
  misc_feature 1..66: note = derived and/or modified sequence opt5 from anti-HIV_CDR
  source 1..66: mol_type = other RNA
gacgaggtgagctgggtcgaagccgctgatgagtgggacgaacacctgttcagagagatggccgtt

SEQ ID NO: 44650 - RNA, 66 nt, synthetic construct
  misc_feature 1..66: note = derived and/or modified sequence opt5 from anti-HIV_CDR
  source 1..66: mol_type = other RNA
gacgagggcagctgggtggaagccgctgatgagtgggacgaacacctgttcagagagatggccgtc

SEQ ID NO: 44651 - RNA, 66 nt, synthetic construct
  misc_feature 1..66: note = derived and/or modified sequence opt5 from anti-HIV_CDR
  source 1..66: mol_type = other RNA
gaccagagaggccggtacagcttcgggtttgtgaccggacaaacaaaggtctccgccatctctgat

SEQ ID NO: 44652 - RNA, 66 nt, synthetic construct; identical to SEQ ID NO: 29368
  misc_feature 1..66: note = derived and/or modified sequence opt5 from anti-HIV_CDR
  source 1..66: mol_type = other RNA

SEQ ID NO: 44653 - RNA, 66 nt, synthetic construct
  misc_feature 1..66: note = derived and/or modified sequence opt5 from anti-HIV_CDR
  source 1..66: mol_type = other RNA
gaccaggtgggcagatacagcttcgggtttgccaccggacaacagcgggtctccgctatctctgat

SEQ ID NO: 44654 - RNA, 69 nt, synthetic construct
  misc_feature 1..69: note = derived and/or modified sequence opt5 from anti-HIV_CDR
  source 1..69: mol_type = other RNA
gtggtcaagatcgagcccctgggcgttgcccctaccaaagctaagagacgggtggtgcagcgcgaaaaa

SEQ ID NO: 44655 - RNA, 69 nt, synthetic construct
  misc_feature 1..69: note = derived and/or modified sequence opt5 from anti-HIV_CDR
  source 1..69: mol_type = other RNA
agaatcagctcctctagctggtacatggtggacaactcccacaccctgcatttctattacatggatgtc

SEQ ID NO: 44656 - RNA, 69 nt, synthetic construct
  misc_feature 1..69: note = derived and/or modified sequence opt5 from anti-HIV_CDR
  source 1..69: mol_type = other RNA
gacaagcccgcctacgatgagtatgctgaagagaccatcgcccctcacaactaccatgcgatggacctg

SEQ ID NO: 44657 - RNA, 69 nt, synthetic construct
  misc_feature 1..69: note = derived and/or modified sequence opt5 from anti-HIV_CDR
  source 1..69: mol_type = other RNA
cagaacatcgccgctagagccgcggagaagctgtacgaaaatgactattacttctatggcatggatgtg

SEQ ID NO: 44658 - RNA, 69 nt, synthetic construct
  misc_feature 1..69: note = derived and/or modified sequence opt5 from anti-HIV_CDR
  source 1..69: mol_type = other RNA
cagaacatcgccgctagaaccgccgagcggctgtacgaaaatgactattacttctatggcatggatgtg

SEQ ID NO: 44659 - RNA, 72 nt, synthetic construct; identical to SEQ ID NO: 29375
  misc_feature 1..72: note = derived and/or modified sequence opt5 from anti-HIV_CDR
  source 1..72: mol_type = other RNA

SEQ ID NO: 44660 - RNA, 72 nt, synthetic construct; identical to SEQ ID NO: 29376
  misc_feature 1..72: note = derived and/or modified sequence opt5 from anti-HIV_CDR
  source 1..72: mol_type = other RNA

SEQ ID NO: 44661 - RNA, 72 nt, synthetic construct
  misc_feature 1..72: note = derived and/or modified sequence opt5 from anti-HIV_CDR
  source 1..72: mol_type = other RNA
gccagacggggccagcgcatctacggggtggtcagcttcggagagtttttctattactattccatggacgtt

SEQ ID NO: 44662 - RNA, 72 nt, synthetic construct
  misc_feature 1..72: note = derived and/or modified sequence opt5 from anti-HIV_CDR
  source 1..72: mol_type = other RNA
accctgcacggcagacggatctacgggattgtggccttcaacgagtggtttacatatttctacatggacgtc

SEQ ID NO: 44663 - RNA, 72 nt, synthetic construct
  misc_feature 1..72: note = derived and/or modified sequence opt5 from anti-HIV_CDR
  source 1..72: mol_type = other RNA
accaagcacggcagacggatctacgggattgtggccttcaacgagtggtttacatatttctacatggacgtc

SEQ ID NO: 44664 - RNA, 72 nt, synthetic construct
  misc_feature 1..72: note = derived and/or modified sequence opt5 from anti-HIV_CDR
  source 1..72: mol_type = other RNA
gccagacacggccagcggatctacggggtggtcagcttcggagagtttttcacctattactccatggacgtt

SEQ ID NO: 44665 - RNA, 72 nt, synthetic construct; identical to SEQ ID NO: 29381
  misc_feature 1..72: note = derived and/or modified sequence opt5 from anti-HIV_CDR
  source 1..72: mol_type = other RNA

SEQ ID NO: 44666 - RNA, 72 nt, synthetic construct
  misc_feature 1..72: note = derived and/or modified sequence opt5 from anti-HIV_CDR
  source 1..72: mol_type = other RNA
accaagcacggcagacggatctacggggtggtcgccttcggagagtggtttacatatttctacatggacgtt

SEQ ID NO: 44667 - RNA, 72 nt, synthetic construct; identical to SEQ ID NO: 29383
  misc_feature 1..72: note = derived and/or modified sequence opt5 from anti-HIV_CDR
  source 1..72: mol_type = other RNA

SEQ ID NO: 44668 - RNA, 72 nt, synthetic construct
  misc_feature 1..72: note = derived and/or modified sequence opt5 from anti-HIV_CDR
  source 1..72: mol_type = other RNA
gacagaggcgatacccggctgctcgactacggggattatgaggacgaacgctactattacggaatggatgtg

SEQ ID NO: 44669 - RNA, 72 nt, synthetic construct
  misc_feature 1..72: note = derived and/or modified sequence opt5 from anti-HIV_CDR
  source 1..72: mol_type = other RNA
ggcaccagatacgacttctggagcgggttttccaaccgggatggacgcgccctggctggctatttcgactac

SEQ ID NO: 44670 - RNA, 72 nt, synthetic construct
  misc_feature 1..72: note = derived and/or modified sequence opt5 from anti-HIV_CDR
  source 1..72: mol_type = other RNA
gacggcaaggggaaagcctactatgatttctggagcggatacagaaaccagaagtattacggcctggacgtg

SEQ ID NO: 44671 - RNA, 72 nt, synthetic construct; identical to SEQ ID NO: 29387
  misc_feature 1..72: note = derived and/or modified sequence opt5 from anti-HIV_CDR
  source 1..72: mol_type = other RNA

SEQ ID NO: 44672 - RNA, 72 nt, synthetic construct; identical to SEQ ID NO: 29388
  misc_feature 1..72: note = derived and/or modified sequence opt5 from anti-HIV_CDR
  source 1..72: mol_type = other RNA

SEQ ID NO: 44673 - RNA, 81 nt, synthetic construct
  misc_feature 1..81: note = derived and/or modified sequence opt5 from anti-HIV_CDR
  source 1..81: mol_type = other RNA
gacttccccagatttcaccggctggtgggcaactacgatttctggcgcgggaccctcgacagatttagctatatggatctg

SEQ ID NO: 44674 - RNA, 105 nt, synthetic construct
  misc_feature 1..105: note = derived and/or modified sequence opt5 from anti-HIV_CDR
  source 1..105: mol_type = other RNA
agaatcctggccgtggagcggtacctcaaggaccagcaactgcttggcatttgggggtgcagcggaaaaatcatttgtcccaccatggtcccttggaactcctct

SEQ ID NO: 44675 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctccaggaccaacgcctgcttggcatgtgggggtgcagcggaaagcacatctgtaccacattcgttccctggaactcctct

SEQ ID NO: 44676 - RNA, 105 nt, synthetic construct
  misc_feature 1..105: note = derived and/or modified sequence opt5 from anti-HIV_CDR
  source 1..105: mol_type = other RNA
agagtgctggccgtcgagagctacctcaaggaccagcaactgcttggcatctgggggtgctccggaaaacacatttgtaccacaacggttccctggaactctagc

SEQ ID NO: 44677 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctccgcgaccagcaactgcttggcatctgggggtgcagcggaagacacatttgtaccacaaatgttccctggaactcctct

SEQ ID NO: 44678 - RNA, 105 nt, synthetic construct
  misc_feature 1..105: note = derived and/or modified sequence opt5 from anti-HIV_CDR
  source 1..105: mol_type = other RNA
agaatcctggccgtggagcggtacctcaaggaccagcaactgcttggcatttgggggtgcagcggaaaactgatctgtaccacaacggtcccctggaactcctct

SEQ ID NO: 44679 - RNA, 105 nt, synthetic construct
  misc_feature 1..105: note = derived and/or modified sequence opt5 from anti-HIV_CDR
  source 1..105: mol_type = other RNA
agaatcctggccgtggagcggtacctcaaggaccagcaactgcttggcatttgggggtgcagcggaaaacacatctgtaccacaaatgtcccctggaactcctct

SEQ ID NO: 44680 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctccgcgaccagcaactgcttggcatctgggggtgcagcggaaagctgatttgtaccacaacggttccctggaacgcttcc

SEQ ID NO: 44681 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctccgcgaccagcaactgcttggcatctgggggtgcagcggaaagctgatttgtaccacagctgttccctggaacgcctcc

SEQ ID NO: 44682 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctcaaggaccagcaactgcttggcatctgggggtgcagcggaaaactgatttgtaccacaacggttccctggaacgcttcc

SEQ ID NO: 44683 - RNA, 105 nt, synthetic construct
  misc_feature 1..105: note = derived and/or modified sequence opt5 from anti-HIV_CDR
  source 1..105: mol_type = other RNA
agaatcctggccgtggagcggtacctcaaggaccagcaactgcttggcttctgggggtgcagcggaaaactgatttgtaccacagctgtcccctggaacgcctcc

SEQ ID NO: 44684 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctccgcgaccagcaactgcttggcatctgggggtgcagcggaaagctgatttgtaccacaacggttccctggaacacctcc

SEQ ID NO: 44685 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctcaaggaccagcaactgcttggcatctgggggtgcagcggaaaactgatttgtaccacagctgttccctggaacgcctcc

SEQ ID NO: 44686 - RNA, 105 nt, synthetic construct
  misc_feature 1..105: note = derived and/or modified sequence opt5 from anti-HIV_CDR
  source 1..105: mol_type = other RNA
agagtgctggccgtcgagcggtacctcaaggaccagcaactgcttggcttctgggggtgcagcggaaaactgatctgtaccacaacggttccctggaacgcttcc

SEQ ID NO: 44687 - RNA, 105 nt, synthetic construct
  misc_feature 1..105: note = derived and/or modified sequence opt5 from anti-HIV_CDR
  source 1..105: mol_type = other RNA
agaatcctggccgtggagcggtacctcaaggaccagcaactgcttggcatttgggggtgcagcggaaaactgatctgtaccacagctgtcccctggaacgcctcc

SEQ ID NO: 44688-44713 - skipped (26 entries)

SEQ ID NO: 44714 - RNA, 12 nt, synthetic construct
  misc_feature 1..12: note = derived and/or modified sequence opt5 from anti-influenza_CDR
  source 1..12: mol_type = other RNA
gacgtgcccgat

SEQ ID NO: 44715 - RNA, 12 nt, synthetic construct
  misc_feature 1..12: note = derived and/or modified sequence opt5 from anti-influenza_CDR
  source 1..12: mol_type = other RNA
agactgagcggc

SEQ ID NO: 44716 - RNA, 12 nt, synthetic construct
  misc_feature 1..12: note = derived and/or modified sequence opt5 from anti-influenza_CDR
  source 1..12: mol_type = other RNA
ttctgggacctg

SEQ ID NO: 44717 - RNA, 15 nt, synthetic construct
  misc_feature 1..15: note = derived and/or modified sequence opt5 from anti-influenza_CDR
  source 1..15: mol_type = other RNA
accggcctgagaaac

SEQ ID NO: 44718 - RNA, 15 nt, synthetic construct
  misc_feature 1..15: note = derived and/or modified sequence opt5 from anti-influenza_CDR
  source 1..15: mol_type = other RNA
cagcaaagcagaacc

SEQ ID NO: 44719 - RNA, 15 nt, synthetic construct
  misc_feature 1..15: note = derived and/or modified sequence opt5 from anti-influenza_CDR
  source 1..15: mol_type = other RNA
cagctgagcagaacc

SEQ ID NO: 44720 - RNA, 15 nt, synthetic construct
  misc_feature 1..15: note = derived and/or modified sequence opt5 from anti-influenza_CDR
  source 1..15: mol_type = other RNA
agcaactacatcacc

SEQ ID NO: 44721 - RNA, 15 nt, synthetic construct
  misc_feature 1..15: note = derived and/or modified sequence opt5 from anti-influenza_CDR
  source 1..15: mol_type = other RNA
gactacagctggaac

SEQ ID NO: 44722 - RNA, 15 nt, synthetic construct
  misc_feature 1..15: note = derived and/or modified sequence opt5 from anti-influenza_CDR
  source 1..15: mol_type = other RNA
aactacgccttcagc

SEQ ID NO: 44723 - RNA, 15 nt, synthetic construct
  misc_feature 1..15: note = derived and/or modified sequence opt5 from anti-influenza_CDR
  source 1..15: mol_type = other RNA
aagaacgccatcagc

SEQ ID NO: 44724 - RNA, 15 nt, synthetic construct
  misc_feature 1..15: note = derived and/or modified sequence opt5 from anti-influenza_CDR
  source 1..15: mol_type = other RNA
agccactggatgacc

SEQ ID NO: 44725 - RNA, 15 nt, synthetic construct
  misc_feature 1..15: note = derived and/or modified sequence opt5 from anti-influenza_CDR
  source 1..15: mol_type = other RNA
aactacgacatcaat

SEQ ID NO: 44726 - RNA, 15 nt, synthetic construct
  misc_feature 1..15: note = derived and/or modified sequence opt5 from anti-influenza_CDR
  source 1..15: mol_type = other RNA
gactacggcgtgacc

SEQ ID NO: 44727 - RNA, 15 nt, synthetic construct
  misc_feature 1..15: note = derived and/or modified sequence opt5 from anti-influenza_CDR
  source 1..15: mol_type = other RNA
aactacggcatcaat

SEQ ID NO: 44728 - RNA, 15 nt, synthetic construct
  misc_feature 1..15: note = derived and/or modified sequence opt5 from anti-influenza_CDR
  source 1..15: mol_type = other RNA
ggctacaccatcaca

SEQ ID NO: 44729 - RNA, 15 nt, synthetic construct
  misc_feature 1..15: note = derived and/or modified sequence opt5 from anti-influenza_CDR
  source 1..15: mol_type = other RNA
aactacggcatcagc

SEQ ID NO: 44730 - RNA, 15 nt, synthetic construct
  misc_feature 1..15: note = derived and/or modified sequence opt5 from anti-influenza_CDR
  source 1..15: mol_type = other RNA
gacgattactggacc

SEQ ID NO: 44731 - RNA, 15 nt, synthetic construct
  misc_feature 1..15: note = derived and/or modified sequence opt5 from anti-influenza_CDR
  source 1..15: mol_type = other RNA
acctacgccatgcac

SEQ ID NO: 44732 - RNA, 15 nt, synthetic construct
  misc_feature 1..15: note = derived and/or modified sequence opt5 from anti-influenza_CDR
  source 1..15: mol_type = other RNA
agctacgccatgcac

SEQ ID NO: 44733 - RNA, 15 nt, synthetic construct
  misc_feature 1..15: note = derived and/or modified sequence opt5 from anti-influenza_CDR
  source 1..15: mol_type = other RNA
agctactattggaac

SEQ ID NO: 44734 - RNA, 15 nt, synthetic construct
  misc_feature 1..15: note = derived and/or modified sequence opt5 from anti-influenza_CDR
  source 1..15: mol_type = other RNA
acctaccccgtggcc

SEQ ID NO: 44735 - RNA, 15 nt, synthetic construct
  misc_feature 1..15: note = derived and/or modified sequence opt5 from anti-influenza_CDR
  source 1..15: mol_type = other RNA
cactacttctggagc

SEQ ID NO: 44736 - RNA, 15 nt, synthetic construct
  misc_feature 1..15: note = derived and/or modified sequence opt5 from anti-influenza_CDR
  source 1..15: mol_type = other RNA
gactactattggacc

SEQ ID NO: 44737 - RNA, 15 nt, synthetic construct
  misc_feature 1..15: note = derived and/or modified sequence opt5 from anti-influenza_CDR
  source 1..15: mol_type = other RNA
gactactattggagc

SEQ ID NO: 44738 - RNA, 15 nt, synthetic construct
  misc_feature 1..15: note = derived and/or modified sequence opt5 from anti-influenza_CDR
  source 1..15: mol_type = other RNA
ggctactatatgcac

SEQ ID NO: 44739 - RNA, 15 nt, synthetic construct
  misc_feature 1..15: note = derived and/or modified sequence opt5 from anti-influenza_CDR
  source 1..15: mol_type = other RNA
agccactactggtcc

SEQ ID NO: 44740 - RNA, 15 nt, synthetic construct
  misc_feature 1..15: note = derived and/or modified sequence opt5 from anti-influenza_CDR
  source 1..15: mol_type = other RNA
aactactggatcggc

SEQ ID NO: 44741 - RNA, 15 nt, synthetic construct
  misc_feature 1..15: note = derived and/or modified sequence opt5 from anti-influenza_CDR
  source 1..15: mol_type = other RNA
aactacgccatcatt

SEQ ID NO: 44742 - RNA, 15 nt, synthetic construct
  misc_feature 1..15: note = derived and/or modified sequence opt5 from anti-influenza_CDR
  source 1..15: mol_type = other RNA
gactactatatccac

SEQ ID NO: 44743 - RNA, 15 nt, synthetic construct
  misc_feature 1..15: note = derived and/or modified sequence opt5 from anti-influenza_CDR
  source 1..15: mol_type = other RNA
ggctacgacatgcac

SEQ ID NO: 44744 - RNA, 15 nt, synthetic construct
  misc_feature 1..15: note = derived and/or modified sequence opt5 from anti-influenza_CDR
  source 1..15: mol_type = other RNA
ggctactatatccac

SEQ ID NO: 44745 - RNA, 15 nt, synthetic construct
  misc_feature 1..15: note = derived and/or modified sequence opt5 from anti-influenza_CDR
  source 1..15: mol_type = other RNA
ggctactatgtgcac

SEQ ID NO: 44746 - RNA, 15 nt, synthetic construct
  misc_feature 1..15: note = derived and/or modified sequence opt5 from anti-influenza_CDR
  source 1..15: mol_type = other RNA
aactactggatgagc

SEQ ID NO: 44747 - RNA, 15 nt, synthetic construct
  misc_feature 1..15: note = derived and/or modified sequence opt5 from anti-influenza_CDR
  source 1..15: mol_type = other RNA
ggcgagagcaccctg

SEQ ID NO: 44748 - RNA, 15 nt, synthetic construct
  misc_feature 1..15: note = derived and/or modified sequence opt5 from anti-influenza_CDR
  source 1..15: mol_type = other RNA
aactactattggagc

SEQ ID NO: 44749 - RNA, 15 nt, synthetic construct
  misc_feature 1..15: note = derived and/or modified sequence opt5 from anti-influenza_CDR
  source 1..15: mol_type = other RNA
agcaactacatgtcc

SEQ ID NO: 44750 - RNA, 15 nt, synthetic construct
  misc_feature 1..15: note = derived and/or modified sequence opt5 from anti-influenza_CDR
  source 1..15: mol_type = other RNA
agcgactactggtcc

SEQ ID NO: 44751 - RNA, 15 nt, synthetic construct
  misc_feature 1..15: note = derived and/or modified sequence opt5 from anti-influenza_CDR
  source 1..15: mol_type = other RNA
agctacaactggatc

SEQ ID NO: 44752 - RNA, 15 nt, synthetic construct
  misc_feature 1..15: note = derived and/or modified sequence opt5 from anti-influenza_CDR
  source 1..15: mol_type = other RNA
agcacctacatgaac

SEQ ID NO: 44753 - RNA, 15 nt, synthetic construct
  misc_feature 1..15: note = derived and/or modified sequence opt5 from anti-influenza_CDR
  source 1..15: mol_type = other RNA
aactacgccatgagc

SEQ ID NO: 44754 - RNA, 15 nt, synthetic construct
  misc_feature 1..15: note = derived and/or modified sequence opt5 from anti-influenza_CDR
  source 1..15: mol_type = other RNA
agcgacttctggtcc

SEQ ID NO: 44755 - RNA, 15 nt, synthetic construct
  misc_feature 1..15: note = derived and/or modified sequence opt5 from anti-influenza_CDR
  source 1..15: mol_type = other RNA
tactatgccatgagc

SEQ ID NO: 44756 - RNA, 15 nt, synthetic construct
  misc_feature 1..15: note = derived and/or modified sequence opt5 from anti-influenza_CDR
  source 1..15: mol_type = other RNA
ggctactatgtgtac

SEQ ID NO: 44757 - RNA, 15 nt, synthetic construct
  misc_feature 1..15: note = derived and/or modified sequence opt5 from anti-influenza_CDR
  source 1..15: mol_type = other RNA
agctacgccatctcc

SEQ ID NO: 44758 - RNA, 15 nt, synthetic construct
  misc_feature 1..15: note = derived and/or modified sequence opt5 from anti-influenza_CDR
  source 1..15: mol_type = other RNA
agctactcctggtct

SEQ ID NO: 44759 - RNA, 15 nt, synthetic construct
  misc_feature 1..15: note = derived and/or modified sequence opt5 from anti-influenza_CDR
  source 1..15: mol_type = other RNA
aacagcttctggggc

SEQ ID NO: 44760 - RNA, 15 nt, synthetic construct
  misc_feature 1..15: note = derived and/or modified sequence opt5 from anti-influenza_CDR
  source 1..15: mol_type = other RNA
gcctaccactggagc

SEQ ID NO: 44761 - RNA, 15 nt, synthetic construct
  misc_feature 1..15: note = derived and/or modified sequence opt5 from anti-influenza_CDR
  source 1..15: mol_type = other RNA
gacaactacatcaat

SEQ ID NO: 44762 - RNA, 15 nt, synthetic construct
  misc_feature 1..15: note = derived and/or modified sequence opt5 from anti-influenza_CDR
  source 1..15: mol_type = other RNA
agcggcttctccgtg

SEQ ID NO: 44763 - RNA, 15 nt, synthetic construct
  misc_feature 1..15: note = derived and/or modified sequence opt5 from anti-influenza_CDR
  source 1..15: mol_type = other RNA
gcctacgctttcacc

SEQ ID NO: 44764 - RNA, 15 nt, synthetic construct
  misc_feature 1..15: note = derived and/or modified sequence opt5 from anti-influenza_CDR
  source 1..15: mol_type = other RNA
ggcagcgccatctcc

SEQ ID NO: 44765 - RNA, 15 nt, synthetic construct
  misc_feature 1..15: note = derived and/or modified sequence opt5 from anti-influenza_CDR
  source 1..15: mol_type = other RNA
agctacgccatcacc

SEQ ID NO: 44766 - RNA, 15 nt, synthetic construct
  misc_feature 1..15: note = derived and/or modified sequence opt5 from anti-influenza_CDR
  source 1..15: mol_type = other RNA
agctactatatgcac

SEQ ID NO: 44767 - RNA, 15 nt, synthetic construct
  misc_feature 1..15: note = derived and/or modified sequence opt5 from anti-influenza_CDR
  source 1..15: mol_type = other RNA
atctacgccatgagc

SEQ ID NO: 44768 - RNA, 15 nt, synthetic construct
  misc_feature 1..15: note = derived and/or modified sequence opt5 from anti-influenza_CDR
  source 1..15: mol_type = other RNA
agctactccatgaac

SEQ ID NO: 44769 - RNA, 15 nt, synthetic construct
  misc_feature 1..15: note = derived and/or modified sequence opt5 from anti-influenza_CDR
  source 1..15: mol_type = other RNA
agctacggcatctcc

SEQ ID NO: 44770 - RNA, 15 nt, synthetic construct
  misc_feature 1..15: note = derived and/or modified sequence opt5 from anti-influenza_CDR
  source 1..15: mol_type = other RNA
ttctacagcatgtcc

SEQ ID NO: 44771 - RNA, 15 nt, synthetic construct
  misc_feature 1..15: note = derived and/or modified sequence opt5 from anti-influenza_CDR
  source 1..15: mol_type = other RNA
acccacgccatcagc

SEQ ID NO: 44772 - RNA, 15 nt, synthetic construct
  misc_feature 1..15: note = derived and/or modified sequence opt5 from anti-influenza_CDR
  source 1..15: mol_type = other RNA
ggctacgccatcagc

SEQ ID NO: 44773 - RNA, 15 nt, synthetic construct
  misc_feature 1..15: note = derived and/or modified sequence opt5 from anti-influenza_CDR
  source 1..15: mol_type = other RNA
agcaactccatctct

SEQ ID NO: 44774 - RNA, 15 nt, synthetic construct
  misc_feature 1..15: note = derived and/or modified sequence opt5 from anti-influenza_CDR
  source 1..15: mol_type = other RNA
aacttcgccatcaat

SEQ ID NO: 44775 - RNA, 15 nt, synthetic construct
  misc_feature 1..15: note = derived and/or modified sequence opt5 from anti-influenza_CDR
  source 1..15: mol_type = other RNA
agcaacgccgtgtcc

SEQ ID NO: 44776 - RNA, 15 nt, synthetic construct
  misc_feature 1..15: note = derived and/or modified sequence opt5 from anti-influenza_CDR
  source 1..15: mol_type = other RNA
gacaacgccatcagc

SEQ ID NO: 44777 - RNA, 15 nt, synthetic construct
  misc_feature 1..15: note = derived and/or modified sequence opt5 from anti-influenza_CDR
  source 1..15: mol_type = other RNA
ttcagcgaggtggaa

SEQ ID NO: 44778 - RNA, 15 nt, synthetic construct
  misc_feature 1..15: note = derived and/or modified sequence opt5 from anti-influenza_CDR
  source 1..15: mol_type = other RNA
gcccaccatatgcac

SEQ ID NO: 44779 - RNA, 15 nt, synthetic construct
  misc_feature 1..15: note = derived and/or modified sequence opt5 from anti-influenza_CDR
  source 1..15: mol_type = other RNA
agccagtggatcggc

SEQ ID NO: 44780 - RNA, 15 nt, synthetic construct
  misc_feature 1..15: note = derived and/or modified sequence opt5 from anti-influenza_CDR
  source 1..15: mol_type = other RNA
gactacgccatgaac

SEQ ID NO: 44781 - RNA, 15 nt, synthetic construct
  misc_feature 1..15: note = derived and/or modified sequence opt5 from anti-influenza_CDR
  source 1..15: mol_type = other RNA
aacgcctggatgagc

SEQ ID NO: 44782 - RNA, 15 nt, synthetic construct
  misc_feature 1..15: note = derived and/or modified sequence opt5 from anti-influenza_CDR
  source 1..15: mol_type = other RNA
gactacgccatcaac

SEQ ID NO: 44783 - RNA, 15 nt, synthetic construct
  misc_feature 1..15: note = derived and/or modified sequence opt5 from anti-influenza_CDR
  source 1..15: mol_type = other RNA
agacacggcatcagc

SEQ ID NO: 44784 - RNA, 15 nt, synthetic construct
  misc_feature 1..15: note = derived and/or modified sequence opt5 from anti-influenza_CDR
  source 1..15: mol_type = other RNA
gagctgagcatccac

SEQ ID NO: 44785 - RNA, 15 nt, synthetic construct
  misc_feature 1..15: note = derived and/or modified sequence opt5 from anti-influenza_CDR
  source 1..15: mol_type = other RNA
agctccaactactat

SEQ ID NO: 44786 - RNA, 15 nt, synthetic construct
  misc_feature 1..15: note = derived and/or modified sequence opt5 from anti-influenza_CDR
  source 1..15: mol_type = other RNA
acctacgccatgagc

SEQ ID NO: 44787 - RNA, 15 nt, synthetic construct
  misc_feature 1..15: note = derived and/or modified sequence opt5 from anti-influenza_CDR
  source 1..15: mol_type = other RNA
aactacgccatcagc

SEQ ID NO: 44788 - RNA, 18 nt, synthetic construct
  misc_feature 1..18: note = derived and/or modified sequence opt5 from anti-influenza_CDR
  source 1..18: mol_type = other RNA
ttcggcgccatcgctggg

SEQ ID NO: 44789 - RNA, 18 nt, synthetic construct
  misc_feature 1..18: note = derived and/or modified sequence opt5 from anti-influenza_CDR
  source 1..18: mol_type = other RNA
caggacatcagcagatac

SEQ ID NO: 44790 - RNA, 18 nt, synthetic construct
  misc_feature 1..18: note = derived and/or modified sequence opt5 from anti-influenza_CDR
  source 1..18: mol_type = other RNA
cagaacatcggcccctgg

SEQ ID NO: 44791 - RNA, 18 nt, synthetic construct
  misc_feature 1..18: note = derived and/or modified sequence opt5 from anti-influenza_CDR
  source 1..18: mol_type = other RNA
cagagcgtgaacagacgg

SEQ ID NO: 44792 - RNA, 18 nt, synthetic construct
  misc_feature 1..18: note = derived and/or modified sequence opt5 from anti-influenza_CDR
  source 1..18: mol_type = other RNA
cagagcatctccacctac

SEQ ID NO: 44793 - RNA, 18 nt, synthetic construct
  misc_feature 1..18: note = derived and/or modified sequence opt5 from anti-influenza_CDR
  source 1..18: mol_type = other RNA
cagggcatcattacctac

SEQ ID NO: 44794 - RNA, 18 nt, synthetic construct
  misc_feature 1..18: note = derived and/or modified sequence opt5 from anti-influenza_CDR
  source 1..18: mol_type = other RNA
cagggcatcagctcctac

SEQ ID NO: 44795 - RNA, 18 nt, synthetic construct
  misc_feature 1..18: note = derived and/or modified sequence opt5 from anti-influenza_CDR
  source 1..18: mol_type = other RNA
caggacgtgagcacctgg

SEQ ID NO: 44796 - RNA, 18 nt, synthetic construct
  misc_feature 1..18: note = derived and/or modified sequence opt5 from anti-influenza_CDR
  source 1..18: mol_type = other RNA
caggacatctacatttat

SEQ ID NO: 44797 - RNA, 18 nt, synthetic construct
  misc_feature 1..18: note = derived and/or modified sequence opt5 from anti-influenza_CDR
  source 1..18: mol_type = other RNA
gagaacatctggaataac

SEQ ID NO: 44798 - RNA, 18 nt, synthetic construct
  misc_feature 1..18: note = derived and/or modified sequence opt5 from anti-influenza_CDR
  source 1..18: mol_type = other RNA
ggcttcaccgtgacaagc

SEQ ID NO: 44799 - RNA, 18 nt, synthetic construct
  misc_feature 1..18: note = derived and/or modified sequence opt5 from anti-influenza_CDR
  source 1..18: mol_type = other RNA
caggacatcagcggccac

SEQ ID NO: 44800 - RNA, 18 nt, synthetic construct
  misc_feature 1..18: note = derived and/or modified sequence opt5 from anti-influenza_CDR
  source 1..18: mol_type = other RNA
agcctgctcaccgaggtg

SEQ ID NO: 44801 - RNA, 18 nt, synthetic construct
  misc_feature 1..18: note = derived and/or modified sequence opt5 from anti-influenza_CDR
  source 1..18: mol_type = other RNA
ggcagctccatctctaac

SEQ ID NO: 44802 - RNA, 18 nt, synthetic construct
  misc_feature 1..18: note = derived and/or modified sequence opt5 from anti-influenza_CDR
  source 1..18: mol_type = other RNA
ggcgggagcatcacctcc

SEQ ID NO: 44803 - RNA, 18 nt, synthetic construct
  misc_feature 1..18: note = derived and/or modified sequence opt5 from anti-influenza_CDR
  source 1..18: mol_type = other RNA
ggcgggagcatctcctct

SEQ ID NO: 44804 - RNA, 18 nt, synthetic construct
  misc_feature 1..18: note = derived and/or modified sequence opt5 from anti-influenza_CDR
  source 1..18: mol_type = other RNA
ggcctgagcgtgtcctct

SEQ ID NO: 44805 - RNA, 18 nt, synthetic construct
  misc_feature 1..18: note = derived and/or modified sequence opt5 from anti-influenza_CDR
  source 1..18: mol_type = other RNA
ggcgccagcatctcctct

SEQ ID NO: 44806 - RNA, 18 nt, synthetic construct
  misc_feature 1..18: note = derived and/or modified sequence opt5 from anti-influenza_CDR
  source 1..18: mol_type = other RNA
ggcgacagcatctcctct

SEQ ID NO: 44807 - RNA, 18 nt, synthetic construct
  misc_feature 1..18: note = derived and/or modified sequence opt5 from anti-influenza_CDR
  source 1..18: mol_type = other RNA
ggcgggagcatctccaac

SEQ ID NO: 44808 - RNA, 18 nt, synthetic construct
  misc_feature 1..18: note = derived and/or modified sequence opt5 from anti-influenza_CDR
  source 1..18: mol_type = other RNA
ggcgggagcatctccgcc

SEQ ID NO: 44809 - RNA, 18 nt, synthetic construct
  misc_feature 1..18: note = derived and/or modified sequence opt5 from anti-influenza_CDR
  source 1..18: mol_type = other RNA
ggcttcagcgtgtccgac

SEQ ID NO: 44810 - RNA, 18 nt, synthetic construct
  misc_feature 1..18: note = derived and/or modified sequence opt5 from anti-influenza_CDR
  source 1..18: mol_type = other RNA
agcagatccctggacgtg

SEQ ID NO: 44811 - RNA, 18 nt, synthetic construct
  misc_feature 1..18: note = derived and/or modified sequence opt5 from anti-influenza_CDR
  source 1..18: mol_type = other RNA
agaagccagcaaaccgtg

SEQ ID NO: 44812 - RNA, 18 nt, synthetic construct
  misc_feature 1..18: note = derived and/or modified sequence opt5 from anti-influenza_CDR
  source 1..18: mol_type = other RNA
cagaccatcaacaattac

SEQ ID NO: 44813 - RNA, 18 nt, synthetic construct
  misc_feature 1..18: note = derived and/or modified sequence opt5 from anti-influenza_CDR
  source 1..18: mol_type = other RNA
aacatgggccccaccagc

SEQ ID NO: 44814 - RNA, 18 nt, synthetic construct
  misc_feature 1..18: note = derived and/or modified sequence opt5 from anti-influenza_CDR
  source 1..18: mol_type = other RNA
caggtggtcggcaccaac

SEQ ID NO: 44815 - RNA, 18 nt, synthetic construct
  misc_feature 1..18: note = derived and/or modified sequence opt5 from anti-influenza_CDR
  source 1..18: mol_type = other RNA
cagggcatcaacacccac

SEQ ID NO: 44816 - RNA, 18 nt, synthetic construct
  misc_feature 1..18: note = derived and/or modified sequence opt5 from anti-influenza_CDR
  source 1..18: mol_type = other RNA
caggacatcagaaaccgg

SEQ ID NO: 44817 - RNA, 18 nt, synthetic construct
  misc_feature 1..18: note = derived and/or modified sequence opt5 from anti-influenza_CDR
  source 1..18: mol_type = other RNA
cagggcatcgggagcaac

SEQ ID NO: 44818 - RNA, 18 nt, synthetic construct
  misc_feature 1..18: note = derived and/or modified sequence opt5 from anti-influenza_CDR
  source 1..18: mol_type = other RNA
cagaccatctacagatgg

SEQ ID NO: 44819 - RNA, 18 nt, synthetic construct
  misc_feature 1..18: note = derived and/or modified sequence opt5 from anti-influenza_CDR
  source 1..18: mol_type = other RNA
cagaccatcacaagattc

SEQ ID NO: 44820 - RNA, 18 nt, synthetic construct
  misc_feature 1..18: note = derived and/or modified sequence opt5 from anti-influenza_CDR
  source 1..18: mol_type = other RNA
agactgggcgagaagttc

SEQ ID NO: 44821 - RNA, 18 nt, synthetic construct
  misc_feature 1..18: note = derived and/or modified sequence opt5 from anti-influenza_CDR
  source 1..18: mol_type = other RNA
aagctgggcgacaaattc

SEQ ID NO: 44822 - RNA, 18 nt, synthetic construct
  misc_feature 1..18: note = derived and/or modified sequence opt5 from anti-influenza_CDR
  source 1..18: mol_type = other RNA
cagggcctggggagcaac

SEQ ID NO: 44823 - RNA, 18 nt, synthetic construct
  misc_feature 1..18: note = derived and/or modified sequence opt5 from anti-influenza_CDR
  source 1..18: mol_type = other RNA
tacatcggcagcaagtcc

SEQ ID NO: 44824 - RNA, 18 nt, synthetic construct
  misc_feature 1..18: note = derived and/or modified sequence opt5 from anti-influenza_CDR
  source 1..18: mol_type = other RNA
cagctgatcagctcctac

SEQ ID NO: 44825 - RNA, 18 nt, synthetic construct
  misc_feature 1..18: note = derived and/or modified sequence opt5 from anti-influenza_CDR
  source 1..18: mol_type = other RNA
cagagcgtgtcctctaac

SEQ ID NO: 44826 - RNA, 18 nt, synthetic construct
  misc_feature 1..18: note = derived and/or modified sequence opt5 from anti-influenza_CDR
  source 1..18: mol_type = other RNA
caggtgatcagctcctac

SEQ ID NO: 44827 - RNA, 18 nt, synthetic construct
  misc_feature 1..18: note = derived and/or modified sequence opt5 from anti-influenza_CDR
  source 1..18: mol_type = other RNA
cagagcgtgaacagaaat

SEQ ID NO: 44828 - RNA, 18 nt, synthetic construct
  misc_feature 1..18: note = derived and/or modified sequence opt5 from anti-influenza_CDR
  source 1..18: mol_type = other RNA
gacatcggcagcaagtcc

SEQ ID NO: 44829 - RNA, 18 nt, synthetic construct
  misc_feature 1..18: note = derived and/or modified sequence opt5 from anti-influenza_CDR
  source 1..18: mol_type = other RNA
cagagcgtgtccaccaac

SEQ ID NO: 44830 - RNA, 18 nt, synthetic construct
  misc_feature 1..18: note = derived and/or modified sequence opt5 from anti-influenza_CDR
  source 1..18: mol_type = other RNA
atgatcgccggctggcac

SEQ ID NO: 44831 - RNA, 18 nt, synthetic construct
  misc_feature 1..18: note = derived and/or modified sequence opt5 from anti-influenza_CDR
  source 1..18: mol_type = other RNA
caggacatcagcacctgg

SEQ ID NO: 44832 - RNA, 18 nt, synthetic construct
  misc_feature 1..18: note = derived and/or modified sequence opt5 from anti-influenza_CDR
  source 1..18: mol_type = other RNA
gagaagatctacagcaac

SEQ ID NO: 44833 - RNA, 21 nt, synthetic construct
  misc_feature 1..21: note = derived and/or modified sequence opt5 from anti-influenza_CDR
  source 1..21: mol_type = other RNA
atctactataactacaatatt

SEQ ID NO: 44834 - RNA, 21 nt, synthetic construct
  misc_feature 1..21: note = derived and/or modified sequence opt5 from anti-influenza_CDR
  source 1..21: mol_type = other RNA
cagagcatctcctctggctac

SEQ ID NO: 44835 - RNA, 21 nt, synthetic construct
  misc_feature 1..21: note = derived and/or modified sequence opt5 from anti-influenza_CDR
  source 1..21: mol_type = other RNA
cagagcgtgtcctctagctac

SEQ ID NO: 44836 - RNA, 21 nt, synthetic construct
  misc_feature 1..21: note = derived and/or modified sequence opt5 from anti-influenza_CDR
  source 1..21: mol_type = other RNA
cagaccgtgagctcctcttac

SEQ ID NO: 44837 - RNA, 21 nt, synthetic construct
  misc_feature 1..21: note = derived and/or modified sequence opt5 from anti-influenza_CDR
  source 1..21: mol_type = other RNA
agcaacaatgccgtgtggaac

SEQ ID NO: 44838 - RNA, 21 nt, synthetic construct
  misc_feature 1..21: note = derived and/or modified sequence opt5 from anti-influenza_CDR
  source 1..21: mol_type = other RNA
agcaactccgccgtgtggaat

SEQ ID NO: 44839 - RNA, 21 nt, synthetic construct
  misc_feature 1..21: note = derived and/or modified sequence opt5 from anti-influenza_CDR
  source 1..21: mol_type = other RNA
gccgctaccacactgcagagc

SEQ ID NO: 44840 - RNA, 21 nt, synthetic construct
  misc_feature 1..21: note = derived and/or modified sequence opt5 from anti-influenza_CDR
  source 1..21: mol_type = other RNA
agcaacagagccacctggaat

SEQ ID NO: 44841 - RNA, 21 nt, synthetic construct
  misc_feature 1..21: note = derived and/or modified sequence opt5 from anti-influenza_CDR
  source 1..21: mol_type = other RNA
gccaccagcacactgcagtcc

SEQ ID NO: 44842 - RNA, 21 nt, synthetic construct
  misc_feature 1..21: note = derived and/or modified sequence opt5 from anti-influenza_CDR
  source 1..21: mol_type = other RNA
agcaactccgccacctggaat

SEQ ID NO: 44843 - RNA, 21 nt, synthetic construct
  misc_feature 1..21: note = derived and/or modified sequence opt5 from anti-influenza_CDR
  source 1..21: mol_type = other RNA
gccagctccaccctgcagtct

SEQ ID NO: 44844 - RNA, 21 nt, synthetic construct
  misc_feature 1..21: note = derived and/or modified sequence opt5 from anti-influenza_CDR
  source 1..21: mol_type = other RNA
agctacaacgccgtgtggaat

SEQ ID NO: 44845 - RNA, 21 nt, synthetic construct
  misc_feature 1..21: note = derived and/or modified sequence opt5 from anti-influenza_CDR
  source 1..21: mol_type = other RNA
gccgctagctccagactgtct

SEQ ID NO: 44846 - RNA, 21 nt, synthetic construct
  misc_feature 1..21: note = derived and/or modified sequence opt5 from anti-influenza_CDR
  source 1..21: mol_type = other RNA
gccgctagctccagaggctct

SEQ ID NO: 44847 - RNA, 21 nt, synthetic construct
  misc_feature 1..21: note = derived and/or modified sequence opt5 from anti-influenza_CDR
  source 1..21: mol_type = other RNA
atctaccacagcggctccgcc

SEQ ID NO: 44848 - RNA, 21 nt, synthetic construct
  misc_feature 1..21: note = derived and/or modified sequence opt5 from anti-influenza_CDR
  source 1..21: mol_type = other RNA
atctactatagcggcgtgacc

SEQ ID NO: 44849 - RNA, 21 nt, synthetic construct
  misc_feature 1..21: note = derived and/or modified sequence opt5 from anti-influenza_CDR
  source 1..21: mol_type = other RNA
agctcctacctggcctggtat

SEQ ID NO: 44850 - RNA, 21 nt, synthetic construct
  misc_feature 1..21: note = derived and/or modified sequence opt5 from anti-influenza_CDR
  source 1..21: mol_type = other RNA
cagagcctgtcctctagctcc

SEQ ID NO: 44851 - RNA, 21 nt, synthetic construct
  misc_feature 1..21: note = derived and/or modified sequence opt5 from anti-influenza_CDR
  source 1..21: mol_type = other RNA
cagagcgtgtccatctcttac

SEQ ID NO: 44852 - RNA, 21 nt, synthetic construct
  misc_feature 1..21: note = derived and/or modified sequence opt5 from anti-influenza_CDR
  source 1..21: mol_type = other RNA
gacgtgaccgagagacccagc

SEQ ID NO: 44853 - RNA, 21 nt, synthetic construct
  misc_feature 1..21: note = derived and/or modified sequence opt5 from anti-influenza_CDR
  source 1..21: mol_type = other RNA
gccgctagcaccctgctcgac

SEQ ID NO: 44854 - RNA, 21 nt, synthetic construct
  misc_feature 1..21: note = derived and/or modified sequence opt5 from anti-influenza_CDR
  source 1..21: mol_type = other RNA
gccgctagcaccctgcactcc

SEQ ID NO: 44855 - RNA, 21 nt, synthetic construct
  misc_feature 1..21: note = derived and/or modified sequence opt5 from anti-influenza_CDR
  source 1..21: mol_type = other RNA
ggcgccagctccctgcagggg

SEQ ID NO: 44856 - RNA, 21 nt, synthetic construct
  misc_feature 1..21: note = derived and/or modified sequence opt5 from anti-influenza_CDR
  source 1..21: mol_type = other RNA
accaacggcgtgaatgtcggg

SEQ ID NO: 44857 - RNA, 21 nt, synthetic construct
  misc_feature 1..21: note = derived and/or modified sequence opt5 from anti-influenza_CDR
  source 1..21: mol_type = other RNA
gacgccagcaccagagctaca

SEQ ID NO: 44858 - RNA, 21 nt, synthetic construct
  misc_feature 1..21: note = derived and/or modified sequence opt5 from anti-influenza_CDR
  source 1..21: mol_type = other RNA
agcgagacctactattggtcc

SEQ ID NO: 44859 - RNA, 21 nt, synthetic construct
  misc_feature 1..21: note = derived and/or modified sequence opt5 from anti-influenza_CDR
  source 1..21: mol_type = other RNA
gaggccgtgaacctggaaagc

SEQ ID NO: 44860 - RNA, 21 nt, synthetic construct
  misc_feature 1..21: note = derived and/or modified sequence opt5 from anti-influenza_CDR
  source 1..21: mol_type = other RNA
ggcgccagcaccagagctaca

SEQ ID NO: 44861 - RNA, 21 nt, synthetic construct
  misc_feature 1..21: note = derived and/or modified sequence opt5 from anti-influenza_CDR
  source 1..21: mol_type = other RNA
gtgagcggctactattggtcc

SEQ ID NO: 44862 - RNA, 21 nt, synthetic construct
  misc_feature 1..21: note = derived and/or modified sequence opt5 from anti-influenza_CDR
  source 1..21: mol_type = other RNA
atcaccggcgtgagagtcggg

SEQ ID NO: 44863 - RNA, 21 nt, synthetic construct
  misc_feature 1..21: note = derived and/or modified sequence opt5 from anti-influenza_CDR
  source 1..21: mol_type = other RNA
gacgccagcaacagagctacc

SEQ ID NO: 44864 - RNA, 21 nt, synthetic construct
  misc_feature 1..21: note = derived and/or modified sequence opt5 from anti-influenza_CDR
  source 1..21: mol_type = other RNA
gaggtgaccaactggcccagc

SEQ ID NO: 44865 - RNA, 21 nt, synthetic construct
  misc_feature 1..21: note = derived and/or modified sequence opt5 from anti-influenza_CDR
  source 1..21: mol_type = other RNA
aaggacagcgagagaccctcc

SEQ ID NO: 44866 - RNA, 21 nt, synthetic construct
  misc_feature 1..21: note = derived and/or modified sequence opt5 from anti-influenza_CDR
  source 1..21: mol_type = other RNA
agcggcaactactattggaat

SEQ ID NO: 44867 - RNA, 21 nt, synthetic construct
  misc_feature 1..21: note = derived and/or modified sequence opt5 from anti-influenza_CDR
  source 1..21: mol_type = other RNA
agcaccacaatcagacactcc

SEQ ID NO: 44868 - RNA, 21 nt, synthetic construct
  misc_feature 1..21: note = derived and/or modified sequence opt5 from anti-influenza_CDR
  source 1..21: mol_type = other RNA
gacgatagcggcagaccctcc

SEQ ID NO: 44869 - RNA, 21 nt, synthetic construct
  misc_feature 1..21: note = derived and/or modified sequence opt5 from anti-influenza_CDR
  source 1..21: mol_type = other RNA
agaaacgacctgcggcccagc

SEQ ID NO: 44870 - RNA, 21 nt, synthetic construct
  misc_feature 1..21: note = derived and/or modified sequence opt5 from anti-influenza_CDR
  source 1..21: mol_type = other RNA
agcgtggaccactactggtcc

SEQ ID NO: 44871 - RNA, 21 nt, synthetic construct
  misc_feature 1..21: note = derived and/or modified sequence opt5 from anti-influenza_CDR
  source 1..21: mol_type = other RNA
gccgtgagcatcctgcagtcc

SEQ ID NO: 44872 - RNA, 21 nt, synthetic construct
  misc_feature 1..21: note = derived and/or modified sequence opt5 from anti-influenza_CDR
  source 1..21: mol_type = other RNA
gacgataccgacagacccagc

SEQ ID NO: 44873 - RNA, 21 nt, synthetic construct
  misc_feature 1..21: note = derived and/or modified sequence opt5 from anti-influenza_CDR
  source 1..21: mol_type = other RNA
gagaacaataagagacccagc

SEQ ID NO: 44874 - RNA, 21 nt, synthetic construct
  misc_feature 1..21: note = derived and/or modified sequence opt5 from anti-influenza_CDR
  source 1..21: mol_type = other RNA
gacagctccaacagagccccc

SEQ ID NO: 44875 - RNA, 21 nt, synthetic construct
  misc_feature 1..21: note = derived and/or modified sequence opt5 from anti-influenza_CDR
  source 1..21: mol_type = other RNA
gaggtgaccaagagacccagc

SEQ ID NO: 44876 - RNA, 21 nt, synthetic construct
  misc_feature 1..21: note = derived and/or modified sequence opt5 from anti-influenza_CDR
  source 1..21: mol_type = other RNA
gccaccagcaacacacactcc

SEQ ID NO: 44877 - RNA, 21 nt, synthetic construct
  misc_feature 1..21: note = derived and/or modified sequence opt5 from anti-influenza_CDR
  source 1..21: mol_type = other RNA
gccgctagcaacctggagaat

SEQ ID NO: 44878 - RNA, 21 nt, synthetic construct
  misc_feature 1..21: note = derived and/or modified sequence opt5 from anti-influenza_CDR
  source 1..21: mol_type = other RNA
gccgctagcggcctgcagtcc

SEQ ID NO: 44879 - RNA, 21 nt, synthetic construct
  misc_feature 1..21: note = derived and/or modified sequence opt5 from anti-influenza_CDR
  source 1..21: mol_type = other RNA
ggcttcaccgtgagctccaac

SEQ ID NO: 44880 - RNA, 21 nt, synthetic construct
  misc_feature 1..21: note = derived and/or modified sequence opt5 from anti-influenza_CDR
  source 1..21: mol_type = other RNA
ggcgggggatacagctggaac

SEQ ID NO: 44881 - RNA, 21 nt, synthetic construct
  misc_feature 1..21: note = derived and/or modified sequence opt5 from anti-influenza_CDR
  source 1..21: mol_type = other RNA
ggcgccagcaacctgcagtcc

SEQ ID NO: 44882 - RNA, 21 nt, synthetic construct
  misc_feature 1..21: note = derived and/or modified sequence opt5 from anti-influenza_CDR
  source 1..21: mol_type = other RNA
ggcgccaccaacctgcagagc

SEQ ID NO: 44883 - RNA, 21 nt, synthetic construct
  misc_feature 1..21: note = derived and/or modified sequence opt5 from anti-influenza_CDR
  source 1..21: mol_type = other RNA
ggcgccagcaacctgcactcc

SEQ ID NO: 44884 - RNA, 21 nt, synthetic construct
  misc_feature 1..21: note = derived and/or modified sequence opt5 from anti-influenza_CDR
  source 1..21: mol_type = other RNA
ggcgccagcaccctgcagtcc

SEQ ID NO: 44885 - RNA, 21 nt, synthetic construct
  misc_feature 1..21: note = derived and/or modified sequence opt5 from anti-influenza_CDR
  source 1..21: mol_type = other RNA
gacaacagcgatagaccctcc

SEQ ID NO: 44886 - RNA, 21 nt, synthetic construct
  misc_feature 1..21: note = derived and/or modified sequence opt5 from anti-influenza_CDR
  source 1..21: mol_type = other RNA
ggcgccagctccctgcagtct

SEQ ID NO: 44887 - RNA, 21 nt, synthetic construct
  misc_feature 1..21: note = derived and/or modified sequence opt5 from anti-influenza_CDR
  source 1..21: mol_type = other RNA
ggcaacagcaatagaccctcc

SEQ ID NO: 44888 - RNA, 21 nt, synthetic construct
  misc_feature 1..21: note = derived and/or modified sequence opt5 from anti-influenza_CDR
  source 1..21: mol_type = other RNA
gccgctagctccctgcagtct

SEQ ID NO: 44889 - RNA, 21 nt, synthetic construct
  misc_feature 1..21: note = derived and/or modified sequence opt5 from anti-influenza_CDR
  source 1..21: mol_type = other RNA
gccgctagctccctgcactct

SEQ ID NO: 44890 - RNA, 21 nt, synthetic construct
  misc_feature 1..21: note = derived and/or modified sequence opt5 from anti-influenza_CDR
  source 1..21: mol_type = other RNA
ggcgccagcaccctgcagaac

SEQ ID NO: 44891 - RNA, 21 nt, synthetic construct
  misc_feature 1..21: note = derived and/or modified sequence opt5 from anti-influenza_CDR
  source 1..21: mol_type = other RNA
ggcgccaccgacctgcagagc

SEQ ID NO: 44892 - RNA, 21 nt, synthetic construct
  misc_feature 1..21: note = derived and/or modified sequence opt5 from anti-influenza_CDR
  source 1..21: mol_type = other RNA
agcggcgcctactattggacc

SEQ ID NO: 44893 - RNA, 21 nt, synthetic construct
  misc_feature 1..21: note = derived and/or modified sequence opt5 from anti-influenza_CDR
  source 1..21: mol_type = other RNA
gtgagcgacaactacatcaat

SEQ ID NO: 44894 - RNA, 21 nt, synthetic construct
  misc_feature 1..21: note = derived and/or modified sequence opt5 from anti-influenza_CDR
  source 1..21: mol_type = other RNA
tgggccagcaccagagagtcc

SEQ ID NO: 44895 - RNA, 21 nt, synthetic construct
  misc_feature 1..21: note = derived and/or modified sequence opt5 from anti-influenza_CDR
  source 1..21: mol_type = other RNA
agcaacaatcagagaccctcc

SEQ ID NO: 44896 - RNA, 21 nt, synthetic construct
  misc_feature 1..21: note = derived and/or modified sequence opt5 from anti-influenza_CDR
  source 1..21: mol_type = other RNA
gaggtgagcaacagaccctcc

SEQ ID NO: 44897 - RNA, 21 nt, synthetic construct
  misc_feature 1..21: note = derived and/or modified sequence opt5 from anti-influenza_CDR
  source 1..21: mol_type = other RNA
aagaacacccagagacccagc

SEQ ID NO: 44898 - RNA, 21 nt, synthetic construct
  misc_feature 1..21: note = derived and/or modified sequence opt5 from anti-influenza_CDR
  source 1..21: mol_type = other RNA
gacaacaataagagacccagc

SEQ ID NO: 44899 - RNA, 21 nt, synthetic construct
  misc_feature 1..21: note = derived and/or modified sequence opt5 from anti-influenza_CDR
  source 1..21: mol_type = other RNA
gacgccagcaccctgagatcc

SEQ ID NO: 44900 - RNA, 21 nt, synthetic construct
  misc_feature 1..21: note = derived and/or modified sequence opt5 from anti-influenza_CDR
  source 1..21: mol_type = other RNA
caggacaacagacggcccagc

SEQ ID NO: 44901 - RNA, 21 nt, synthetic construct
  misc_feature 1..21: note = derived and/or modified sequence opt5 from anti-influenza_CDR
  source 1..21: mol_type = other RNA
gacgtgagcaagagaccctcc

SEQ ID NO: 44902 - RNA, 21 nt, synthetic construct
  misc_feature 1..21: note = derived and/or modified sequence opt5 from anti-influenza_CDR
  source 1..21: mol_type = other RNA
gacgccagctccagagctacc

SEQ ID NO: 44903 - RNA, 21 nt, synthetic construct
  misc_feature 1..21: note = derived and/or modified sequence opt5 from anti-influenza_CDR
  source 1..21: mol_type = other RNA
ctgggcagcaacagagcctcc

SEQ ID NO: 44904 - RNA, 21 nt, synthetic construct
  misc_feature 1..21: note = derived and/or modified sequence opt5 from anti-influenza_CDR
  source 1..21: mol_type = other RNA
ggcgccagcaccagagctgcc

SEQ ID NO: 44905 - RNA, 21 nt, synthetic construct
  misc_feature 1..21: note = derived and/or modified sequence opt5 from anti-influenza_CDR
  source 1..21: mol_type = other RNA
gacgatagcgacagaccctcc

SEQ ID NO: 44906 - RNA, 21 nt, synthetic construct
  misc_feature 1..21: note = derived and/or modified sequence opt5 from anti-influenza_CDR
  source 1..21: mol_type = other RNA
agagacggccagcggcccagc

SEQ ID NO: 44907 - RNA, 21 nt, synthetic construct
  misc_feature 1..21: note = derived and/or modified sequence opt5 from anti-influenza_CDR
  source 1..21: mol_type = other RNA
ggcgccagctccagagctacc

SEQ ID NO: 44908 - RNA, 21 nt, synthetic construct
  misc_feature 1..21: note = derived and/or modified sequence opt5 from anti-influenza_CDR
  source 1..21: mol_type = other RNA
ggcgccagctccagagcttct

SEQ ID NO: 44909 - RNA, 21 nt, synthetic construct
  misc_feature 1..21: note = derived and/or modified sequence opt5 from anti-influenza_CDR
  source 1..21: mol_type = other RNA
gccgctagcaccctgcagtcc

SEQ ID NO: 44910 - RNA, 21 nt, synthetic construct
  misc_feature 1..21: note = derived and/or modified sequence opt5 from anti-influenza_CDR
  source 1..21: mol_type = other RNA
ctggtgagcaagagagcctcc

SEQ ID NO: 44911 - RNA, 21 nt, synthetic construct
  misc_feature 1..21: note = derived and/or modified sequence opt5 from anti-influenza_CDR
  source 1..21: mol_type = other RNA
gacgtgacctacagacccagc

SEQ ID NO: 44912 - RNA, 21 nt, synthetic construct
  misc_feature 1..21: note = derived and/or modified sequence opt5 from anti-influenza_CDR
  source 1..21: mol_type = other RNA
atgcaggccctggagaccccc

SEQ ID NO: 44913 - RNA, 21 nt, synthetic construct
  misc_feature 1..21: note = derived and/or modified sequence opt5 from anti-influenza_CDR
  source 1..21: mol_type = other RNA
cagaactacggcagccccttc

SEQ ID NO: 44914 - RNA, 21 nt, synthetic construct
  misc_feature 1..21: note = derived and/or modified sequence opt5 from anti-influenza_CDR
  source 1..21: mol_type = other RNA
cagcaatacggcagcctgccc

SEQ ID NO: 44915 - RNA, 21 nt, synthetic construct
  misc_feature 1..21: note = derived and/or modified sequence opt5 from anti-influenza_CDR
  source 1..21: mol_type = other RNA
tggggcagctacctggagtcc

SEQ ID NO: 44916 - RNA, 21 nt, synthetic construct
  misc_feature 1..21: note = derived and/or modified sequence opt5 from anti-influenza_CDR
  source 1..21: mol_type = other RNA
agcgcctccaccagagctaca

SEQ ID NO: 44917 - RNA, 21 nt, synthetic construct
  misc_feature 1..21: note = derived and/or modified sequence opt5 from anti-influenza_CDR
  source 1..21: mol_type = other RNA
ggcgccagcaccagagcttcc

SEQ ID NO: 44918 - RNA, 21 nt, synthetic construct
  misc_feature 1..21: note = derived and/or modified sequence opt5 from anti-influenza_CDR
  source 1..21: mol_type = other RNA
ggcgccagcaccagagacaca

SEQ ID NO: 44919 - RNA, 21 nt, synthetic construct
  misc_feature 1..21: note = derived and/or modified sequence opt5 from anti-influenza_CDR
  source 1..21: mol_type = other RNA
aaggtgagcaccctggagtcc

SEQ ID NO: 44920 - RNA, 21 nt, synthetic construct
  misc_feature 1..21: note = derived and/or modified sequence opt5 from anti-influenza_CDR
  source 1..21: mol_type = other RNA
agcaacaccgagagaccctcc

SEQ ID NO: 44921 - RNA, 21 nt, synthetic construct
  misc_feature 1..21: note = derived and/or modified sequence opt5 from anti-influenza_CDR
  source 1..21: mol_type = other RNA
aagatcagcaacagagactcc

SEQ ID NO: 44922 - RNA, 21 nt, synthetic construct
  misc_feature 1..21: note = derived and/or modified sequence opt5 from anti-influenza_CDR
  source 1..21: mol_type = other RNA
agcgcctcccacagatactct

SEQ ID NO: 44923 - RNA, 21 nt, synthetic construct
  misc_feature 1..21: note = derived and/or modified sequence opt5 from anti-influenza_CDR
  source 1..21: mol_type = other RNA
cagagcgtgagatccaacaat

SEQ ID NO: 44924 - RNA, 21 nt, synthetic construct
  misc_feature 1..21: note = derived and/or modified sequence opt5 from anti-influenza_CDR
  source 1..21: mol_type = other RNA
cagagcgtgagatccggctac

SEQ ID NO: 44925 - RNA, 21 nt, synthetic construct
  misc_feature 1..21: note = derived and/or modified sequence opt5 from anti-influenza_CDR
  source 1..21: mol_type = other RNA
atctactatagaggcagcacc

SEQ ID NO: 44926 - RNA, 21 nt, synthetic construct
  misc_feature 1..21: note = derived and/or modified sequence opt5 from anti-influenza_CDR
  source 1..21: mol_type = other RNA
gtgtactatagcggcatcacc

SEQ ID NO: 44927 - RNA, 21 nt, synthetic construct
  misc_feature 1..21: note = derived and/or modified sequence opt5 from anti-influenza_CDR
  source 1..21: mol_type = other RNA
agccacttcgccaacctgaag

SEQ ID NO: 44928 - RNA, 21 nt, synthetic construct
  misc_feature 1..21: note = derived and/or modified sequence opt5 from anti-influenza_CDR
  source 1..21: mol_type = other RNA
ctgaacaagagcaaaccctac

SEQ ID NO: 44929 - RNA, 21 nt, synthetic construct
  misc_feature 1..21: note = derived and/or modified sequence opt5 from anti-influenza_CDR
  source 1..21: mol_type = other RNA
aagctggccaacaccggcaca

SEQ ID NO: 44930 - RNA, 21 nt, synthetic construct
  misc_feature 1..21: note = derived and/or modified sequence opt5 from anti-influenza_CDR
  source 1..21: mol_type = other RNA
gccgctagcaccctgacatcc

SEQ ID NO: 44931 - RNA, 21 nt, synthetic construct
  misc_feature 1..21: note = derived and/or modified sequence opt5 from anti-influenza_CDR
  source 1..21: mol_type = other RNA
gacgccagcaagctggcttcc

SEQ ID NO: 44932 - RNA, 21 nt, synthetic construct
  misc_feature 1..21: note = derived and/or modified sequence opt5 from anti-influenza_CDR
  source 1..21: mol_type = other RNA
ttcgccagcagactggcttcc

SEQ ID NO: 44933 - RNA, 21 nt, synthetic construct
  misc_feature 1..21: note = derived and/or modified sequence opt5 from anti-influenza_CDR
  source 1..21: mol_type = other RNA
agcgcctccaccctggcttct

SEQ ID NO: 44934 - RNA, 21 nt, synthetic construct
  misc_feature 1..21: note = derived and/or modified sequence opt5 from anti-influenza_CDR
  source 1..21: mol_type = other RNA
gaggtgagccagagaccctcc

SEQ ID NO: 44935 - RNA, 21 nt, synthetic construct
  misc_feature 1..21: note = derived and/or modified sequence opt5 from anti-influenza_CDR
  source 1..21: mol_type = other RNA
ggcgggaccctgaacaattac

SEQ ID NO: 44936 - RNA, 21 nt, synthetic construct
  misc_feature 1..21: note = derived and/or modified sequence opt5 from anti-influenza_CDR
  source 1..21: mol_type = other RNA
gacatcgtgatgacccagagc

SEQ ID NO: 44937 - RNA, 24 nt, synthetic construct
  misc_feature 1..24: note = derived and/or modified sequence opt5 from anti-influenza_CDR
  source 1..24: mol_type = other RNA
ggcttcacctttagcaactacgcc

SEQ ID NO: 44938 - RNA, 24 nt, synthetic construct
  misc_feature 1..24: note = derived and/or modified sequence opt5 from anti-influenza_CDR
  source 1..24: mol_type = other RNA
ggcttcacctttagcaactacggg

SEQ ID NO: 44939 - RNA, 24 nt, synthetic construct
  misc_feature 1..24: note = derived and/or modified sequence opt5 from anti-influenza_CDR
  source 1..24: mol_type = other RNA
ggcttcacctttagctcctacgcc

SEQ ID NO: 44940 - RNA, 24 nt, synthetic construct
  misc_feature 1..24: note = derived and/or modified sequence opt5 from anti-influenza_CDR
  source 1..24: mol_type = other RNA
ggcttcacctttagcacatacgcc

SEQ ID NO: 44941 - RNA, 24 nt, synthetic construct
  misc_feature 1..24: note = derived and/or modified sequence opt5 from anti-influenza_CDR
  source 1..24: mol_type = other RNA
ggcgggatcttcattagccaggcc

SEQ ID NO: 44942 - RNA, 24 nt, synthetic construct
  misc_feature 1..24: note = derived and/or modified sequence opt5 from anti-influenza_CDR
  source 1..24: mol_type = other RNA
ggcgggatcttcagcccctacgcc

SEQ ID NO: 44943 - RNA, 24 nt, synthetic construct
  misc_feature 1..24: note = derived and/or modified sequence opt5 from anti-influenza_CDR
  source 1..24: mol_type = other RNA
ggcgggcccttcagcggatttgcc

SEQ ID NO: 44944 - RNA, 24 nt, synthetic construct
  misc_feature 1..24: note = derived and/or modified sequence opt5 from anti-influenza_CDR
  source 1..24: mol_type = other RNA
ggcgggaccttcaacagccacgcc

SEQ ID NO: 44945 - RNA, 24 nt, synthetic construct
  misc_feature 1..24: note = derived and/or modified sequence opt5 from anti-influenza_CDR
  source 1..24: mol_type = other RNA
ggcagcaacatcgggtccaatacc

SEQ ID NO: 44946 - RNA, 24 nt, synthetic construct
  misc_feature 1..24: note = derived and/or modified sequence opt5 from anti-influenza_CDR
  source 1..24: mol_type = other RNA
ggcgtgaccttcagcatgtacgcc

SEQ ID NO: 44947 - RNA, 24 nt, synthetic construct
  misc_feature 1..24: note = derived and/or modified sequence opt5 from anti-influenza_CDR
  source 1..24: mol_type = other RNA
ggcgtgaccttcagcatgtacaca

SEQ ID NO: 44948 - RNA, 24 nt, synthetic construct
  misc_feature 1..24: note = derived and/or modified sequence opt5 from anti-influenza_CDR
  source 1..24: mol_type = other RNA
ggcgtgaccagctccaactacccc

SEQ ID NO: 44949 - RNA, 24 nt, synthetic construct
  misc_feature 1..24: note = derived and/or modified sequence opt5 from anti-influenza_CDR
  source 1..24: mol_type = other RNA
atcattgccatcttcggcaccaca

SEQ ID NO: 44950 - RNA, 24 nt, synthetic construct
  misc_feature 1..24: note = derived and/or modified sequence opt5 from anti-influenza_CDR
  source 1..24: mol_type = other RNA
atcattcccctgttcggcaccgcc

SEQ ID NO: 44951 - RNA, 24 nt, synthetic construct
  misc_feature 1..24: note = derived and/or modified sequence opt5 from anti-influenza_CDR
  source 1..24: mol_type = other RNA
atcattcccctgttcggcaccaca

SEQ ID NO: 44952 - RNA, 24 nt, synthetic construct
  misc_feature 1..24: note = derived and/or modified sequence opt5 from anti-influenza_CDR
  source 1..24: mol_type = other RNA
atcattcccatgttcggcgccacc

SEQ ID NO: 44953 - RNA, 24 nt, synthetic construct
  misc_feature 1..24: note = derived and/or modified sequence opt5 from anti-influenza_CDR
  source 1..24: mol_type = other RNA
atcattcccatgttcggcaccaca

SEQ ID NO: 44954 - RNA, 24 nt, synthetic construct
  misc_feature 1..24: note = derived and/or modified sequence opt5 from anti-influenza_CDR
  source 1..24: mol_type = other RNA
atcaacagcggcgggggagccacc

SEQ ID NO: 44955 - RNA, 24 nt, synthetic construct
  misc_feature 1..24: note = derived and/or modified sequence opt5 from anti-influenza_CDR
  source 1..24: mol_type = other RNA
atcagcgccgtgttcggcaccgct

SEQ ID NO: 44956 - RNA, 24 nt, synthetic construct
  misc_feature 1..24: note = derived and/or modified sequence opt5 from anti-influenza_CDR
  source 1..24: mol_type = other RNA
atcagctacgacgccaactataag

SEQ ID NO: 44957 - RNA, 24 nt, synthetic construct
  misc_feature 1..24: note = derived and/or modified sequence opt5 from anti-influenza_CDR
  source 1..24: mol_type = other RNA
atcagctacgacggcaactataag

SEQ ID NO: 44958 - RNA, 24 nt, synthetic construct
  misc_feature 1..24: note = derived and/or modified sequence opt5 from anti-influenza_CDR
  source 1..24: mol_type = other RNA
atcagctacgacggctccaacaag

SEQ ID NO: 44959 - RNA, 24 nt, synthetic construct
  misc_feature 1..24: note = derived and/or modified sequence opt5 from anti-influenza_CDR
  source 1..24: mol_type = other RNA
atcagctacgacggctccaaccag

SEQ ID NO: 44960 - RNA, 24 nt, synthetic construct
  misc_feature 1..24: note = derived and/or modified sequence opt5 from anti-influenza_CDR
  source 1..24: mol_type = other RNA
cagcaatactatagaagcccctcc

SEQ ID NO: 44961 - RNA, 24 nt, synthetic construct
  misc_feature 1..24: note = derived and/or modified sequence opt5 from anti-influenza_CDR
  source 1..24: mol_type = other RNA
gtgctgcccctcttcggcgtcacc

SEQ ID NO: 44962 - RNA, 24 nt, synthetic construct
  misc_feature 1..24: note = derived and/or modified sequence opt5 from anti-influenza_CDR
  source 1..24: mol_type = other RNA
ggcgggaccttcagctccgacgcc

SEQ ID NO: 44963 - RNA, 24 nt, synthetic construct
  misc_feature 1..24: note = derived and/or modified sequence opt5 from anti-influenza_CDR
  source 1..24: mol_type = other RNA
atcattcccgtgttccagaccgcc

SEQ ID NO: 44964 - RNA, 24 nt, synthetic construct
  misc_feature 1..24: note = derived and/or modified sequence opt5 from anti-influenza_CDR
  source 1..24: mol_type = other RNA
accagcaacatcggctccaatgcc

SEQ ID NO: 44965 - RNA, 24 nt, synthetic construct
  misc_feature 1..24: note = derived and/or modified sequence opt5 from anti-influenza_CDR
  source 1..24: mol_type = other RNA
ggctacagcttcacctccagatgg

SEQ ID NO: 44966 - RNA, 24 nt, synthetic construct
  misc_feature 1..24: note = derived and/or modified sequence opt5 from anti-influenza_CDR
  source 1..24: mol_type = other RNA
atctaccccagcgactccgatgtg

SEQ ID NO: 44967 - RNA, 24 nt, synthetic construct
  misc_feature 1..24: note = derived and/or modified sequence opt5 from anti-influenza_CDR
  source 1..24: mol_type = other RNA
cagcaatacgacaactggctgagc

SEQ ID NO: 44968 - RNA, 24 nt, synthetic construct
  misc_feature 1..24: note = derived and/or modified sequence opt5 from anti-influenza_CDR
  source 1..24: mol_type = other RNA
ggcgggaccttcagcaactacgga

SEQ ID NO: 44969 - RNA, 24 nt, synthetic construct
  misc_feature 1..24: note = derived and/or modified sequence opt5 from anti-influenza_CDR
  source 1..24: mol_type = other RNA
ggcgccagcatctcctctagctac

SEQ ID NO: 44970 - RNA, 24 nt, synthetic construct
  misc_feature 1..24: note = derived and/or modified sequence opt5 from anti-influenza_CDR
  source 1..24: mol_type = other RNA
ggcgggaccttcagctcctacgac

SEQ ID NO: 44971 - RNA, 24 nt, synthetic construct
  misc_feature 1..24: note = derived and/or modified sequence opt5 from anti-influenza_CDR
  source 1..24: mol_type = other RNA
atcattcccatctacggcaccgcc

SEQ ID NO: 44972 - RNA, 24 nt, synthetic construct
  misc_feature 1..24: note = derived and/or modified sequence opt5 from anti-influenza_CDR
  source 1..24: mol_type = other RNA
ggctacaccagcacaacgtatggg

SEQ ID NO: 44973 - RNA, 24 nt, synthetic construct
  misc_feature 1..24: note = derived and/or modified sequence opt5 from anti-influenza_CDR
  source 1..24: mol_type = other RNA
atcaacccctacaatggcaaccct

SEQ ID NO: 44974 - RNA, 24 nt, synthetic construct
  misc_feature 1..24: note = derived and/or modified sequence opt5 from anti-influenza_CDR
  source 1..24: mol_type = other RNA
atctggtacgacggcgataacaag

SEQ ID NO: 44975 - RNA, 24 nt, synthetic construct
  misc_feature 1..24: note = derived and/or modified sequence opt5 from anti-influenza_CDR
  source 1..24: mol_type = other RNA
ggcttcacctttagcgacttctgg

SEQ ID NO: 44976 - RNA, 24 nt, synthetic construct
  misc_feature 1..24: note = derived and/or modified sequence opt5 from anti-influenza_CDR
  source 1..24: mol_type = other RNA
atcgaccaggatggcaacgagaga

SEQ ID NO: 44977 - RNA, 24 nt, synthetic construct
  misc_feature 1..24: note = derived and/or modified sequence opt5 from anti-influenza_CDR
  source 1..24: mol_type = other RNA
agctccaacatcggcaagaattac

SEQ ID NO: 44978 - RNA, 24 nt, synthetic construct
  misc_feature 1..24: note = derived and/or modified sequence opt5 from anti-influenza_CDR
  source 1..24: mol_type = other RNA
ggctacaccttcacaaactattgg

SEQ ID NO: 44979 - RNA, 24 nt, synthetic construct
  misc_feature 1..24: note = derived and/or modified sequence opt5 from anti-influenza_CDR
  source 1..24: mol_type = other RNA
atcttccctcccgacagccagacc

SEQ ID NO: 44980 - RNA, 24 nt, synthetic construct
  misc_feature 1..24: note = derived and/or modified sequence opt5 from anti-influenza_CDR
  source 1..24: mol_type = other RNA
ggctacagcttctccgactattgg

SEQ ID NO: 44981 - RNA, 24 nt, synthetic construct
  misc_feature 1..24: note = derived and/or modified sequence opt5 from anti-influenza_CDR
  source 1..24: mol_type = other RNA
atctaccccgccagctccgagatt

SEQ ID NO: 44982 - RNA, 24 nt, synthetic construct
  misc_feature 1..24: note = derived and/or modified sequence opt5 from anti-influenza_CDR
  source 1..24: mol_type = other RNA
agcggcgactccgggacctggaac

SEQ ID NO: 44983 - RNA, 24 nt, synthetic construct
  misc_feature 1..24: note = derived and/or modified sequence opt5 from anti-influenza_CDR
  source 1..24: mol_type = other RNA
ggcgggaccctgaacaattacgcc

SEQ ID NO: 44984 - RNA, 24 nt, synthetic construct
  misc_feature 1..24: note = derived and/or modified sequence opt5 from anti-influenza_CDR
  source 1..24: mol_type = other RNA
atcagccccattttcggcaccctg

SEQ ID NO: 44985 - RNA, 24 nt, synthetic construct
  misc_feature 1..24: note = derived and/or modified sequence opt5 from anti-influenza_CDR
  source 1..24: mol_type = other RNA
ggcgtgttctttagctcccacgcc

SEQ ID NO: 44986 - RNA, 24 nt, synthetic construct
  misc_feature 1..24: note = derived and/or modified sequence opt5 from anti-influenza_CDR
  source 1..24: mol_type = other RNA
atcagccccatgttcggcaccaca

SEQ ID NO: 44987 - RNA, 24 nt, synthetic construct
  misc_feature 1..24: note = derived and/or modified sequence opt5 from anti-influenza_CDR
  source 1..24: mol_type = other RNA
ggcttcacctttagcagattcggg

SEQ ID NO: 44988 - RNA, 24 nt, synthetic construct
  misc_feature 1..24: note = derived and/or modified sequence opt5 from anti-influenza_CDR
  source 1..24: mol_type = other RNA
atctggtacgacggcagcaacaag

SEQ ID NO: 44989 - RNA, 24 nt, synthetic construct
  misc_feature 1..24: note = derived and/or modified sequence opt5 from anti-influenza_CDR
  source 1..24: mol_type = other RNA
cagacctacggcggggtgagcaca

SEQ ID NO: 44990 - RNA, 24 nt, synthetic construct
  misc_feature 1..24: note = derived and/or modified sequence opt5 from anti-influenza_CDR
  source 1..24: mol_type = other RNA
gacagcgccggcaacagacactcc

SEQ ID NO: 44991 - RNA, 24 nt, synthetic construct
  misc_feature 1..24: note = derived and/or modified sequence opt5 from anti-influenza_CDR
  source 1..24: mol_type = other RNA
ttcagaggcgggaacagcctgtcc

SEQ ID NO: 44992 - RNA, 24 nt, synthetic construct
  misc_feature 1..24: note = derived and/or modified sequence opt5 from anti-influenza_CDR
  source 1..24: mol_type = other RNA
ggctacaccttcacaacgtattgg

SEQ ID NO: 44993 - RNA, 24 nt, synthetic construct
  misc_feature 1..24: note = derived and/or modified sequence opt5 from anti-influenza_CDR
  source 1..24: mol_type = other RNA
atcgacccctacgatagcgagacc

SEQ ID NO: 44994 - RNA, 24 nt, synthetic construct
  misc_feature 1..24: note = derived and/or modified sequence opt5 from anti-influenza_CDR
  source 1..24: mol_type = other RNA
atcagaaagttcctgaactggtac

SEQ ID NO: 44995 - RNA, 24 nt, synthetic construct
  misc_feature 1..24: note = derived and/or modified sequence opt5 from anti-influenza_CDR
  source 1..24: mol_type = other RNA
cagcaatacgacggcctgcccttc

SEQ ID NO: 44996 - RNA, 24 nt, synthetic construct
  misc_feature 1..24: note = derived and/or modified sequence opt5 from anti-influenza_CDR
  source 1..24: mol_type = other RNA
atcagaaacagcctgaattggtac

SEQ ID NO: 44997 - RNA, 24 nt, synthetic construct
  misc_feature 1..24: note = derived and/or modified sequence opt5 from anti-influenza_CDR
  source 1..24: mol_type = other RNA
cagcaagccaacagcttccccctg

SEQ ID NO: 44998 - RNA, 24 nt, synthetic construct
  misc_feature 1..24: note = derived and/or modified sequence opt5 from anti-influenza_CDR
  source 1..24: mol_type = other RNA
agcctgctcaccgaggtggaaaca

SEQ ID NO: 44999 - RNA, 24 nt, synthetic construct
  misc_feature 1..24: note = derived and/or modified sequence opt5 from anti-influenza_CDR
  source 1..24: mol_type = other RNA
cagcaaagctactccatgcccgcc

SEQ ID NO: 45000 - RNA, 24 nt, synthetic construct
  misc_feature 1..24: note = derived and/or modified sequence opt5 from anti-influenza_CDR
  source 1..24: mol_type = other RNA
ggcgggcccgtgagcggaggcggg

SEQ ID NO: 45001 - RNA, 24 nt, synthetic construct
  misc_feature 1..24: note = derived and/or modified sequence opt5 from anti-influenza_CDR
  source 1..24: mol_type = other RNA
caacagagcttctccgtgcccgcc

SEQ ID NO: 45002 - RNA, 24 nt, synthetic construct
  misc_feature 1..24: note = derived and/or modified sequence opt5 from anti-influenza_CDR
  source 1..24: mol_type = other RNA
cagcaaacctacagcatccccctg

SEQ ID NO: 45003 - RNA, 24 nt, synthetic construct
  misc_feature 1..24: note = derived and/or modified sequence opt5 from anti-influenza_CDR
  source 1..24: mol_type = other RNA
cagcaaagctactccgtgcccgcc

SEQ ID NO: 45004 - RNA, 24 nt, synthetic construct
  misc_feature 1..24: note = derived and/or modified sequence opt5 from anti-influenza_CDR
  source 1..24: mol_type = other RNA
cagcaaaccttcagcatccccctg

SEQ ID NO: 45005 - RNA, 24 nt, synthetic construct
  misc_feature 1..24: note = derived and/or modified sequence opt5 from anti-influenza_CDR
  source 1..24: mol_type = other RNA
ggcgacagcatcacctccggggcc

SEQ ID NO: 45006 - RNA, 24 nt, synthetic construct
  misc_feature 1..24: note = derived and/or modified sequence opt5 from anti-influenza_CDR
  source 1..24: mol_type = other RNA
caggcctgggacagctccaccgct

SEQ ID NO: 45007 - RNA, 24 nt, synthetic construct
  misc_feature 1..24: note = derived and/or modified sequence opt5 from anti-influenza_CDR
  source 1..24: mol_type = other RNA
cagcaatacggcagctccctgtgg

SEQ ID NO: 45008 - RNA, 24 nt, synthetic construct
  misc_feature 1..24: note = derived and/or modified sequence opt5 from anti-influenza_CDR
  source 1..24: mol_type = other RNA
gcctacggctataccttcgacccc

SEQ ID NO: 45009 - RNA, 24 nt, synthetic construct
  misc_feature 1..24: note = derived and/or modified sequence opt5 from anti-influenza_CDR
  source 1..24: mol_type = other RNA
atgcaggccctgcaaacccccctc

SEQ ID NO: 45010 - RNA, 24 nt, synthetic construct
  misc_feature 1..24: note = derived and/or modified sequence opt5 from anti-influenza_CDR
  source 1..24: mol_type = other RNA
cagcaatacggcagctccctgacc

SEQ ID NO: 45011 - RNA, 24 nt, synthetic construct
  misc_feature 1..24: note = derived and/or modified sequence opt5 from anti-influenza_CDR
  source 1..24: mol_type = other RNA
cagaagtacaacagcgccccctcc

SEQ ID NO: 45012 - RNA, 24 nt, synthetic construct
  misc_feature 1..24: note = derived and/or modified sequence opt5 from anti-influenza_CDR
  source 1..24: mol_type = other RNA
cagcaaagaagcaactggctgaag

SEQ ID NO: 45013 - RNA, 24 nt, synthetic construct
  misc_feature 1..24: note = derived and/or modified sequence opt5 from anti-influenza_CDR
  source 1..24: mol_type = other RNA
agctcccagtctagaagctccacc

SEQ ID NO: 45014 - RNA, 24 nt, synthetic construct
  misc_feature 1..24: note = derived and/or modified sequence opt5 from anti-influenza_CDR
  source 1..24: mol_type = other RNA
ccctacgacgtgcctgattatgag

SEQ ID NO: 45015 - RNA, 24 nt, synthetic construct
  misc_feature 1..24: note = derived and/or modified sequence opt5 from anti-influenza_CDR
  source 1..24: mol_type = other RNA
ccctacgacgtgcctgattatgcc

SEQ ID NO: 45016 - RNA, 24 nt, synthetic construct
  misc_feature 1..24: note = derived and/or modified sequence opt5 from anti-influenza_CDR
  source 1..24: mol_type = other RNA
cccggcgacttcaacgattacgag

SEQ ID NO: 45017 - RNA, 24 nt, synthetic construct
  misc_feature 1..24: note = derived and/or modified sequence opt5 from anti-influenza_CDR
  source 1..24: mol_type = other RNA
cccaaggtgagagaccaggagagc

SEQ ID NO: 45018 - RNA, 24 nt, synthetic construct
  misc_feature 1..24: note = derived and/or modified sequence opt5 from anti-influenza_CDR
  source 1..24: mol_type = other RNA
accagctacacatcctctaacacg

SEQ ID NO: 45019 - RNA, 24 nt, synthetic construct
  misc_feature 1..24: note = derived and/or modified sequence opt5 from anti-influenza_CDR
  source 1..24: mol_type = other RNA
ggcgggaacttcaataactacgcc

SEQ ID NO: 45020 - RNA, 24 nt, synthetic construct
  misc_feature 1..24: note = derived and/or modified sequence opt5 from anti-influenza_CDR
  source 1..24: mol_type = other RNA
atcagccccattttcggctccacc

SEQ ID NO: 45021 - RNA, 24 nt, synthetic construct
  misc_feature 1..24: note = derived and/or modified sequence opt5 from anti-influenza_CDR
  source 1..24: mol_type = other RNA
agctcctacacctctagcaacaca

SEQ ID NO: 45022 - RNA, 24 nt, synthetic construct
  misc_feature 1..24: note = derived and/or modified sequence opt5 from anti-influenza_CDR
  source 1..24: mol_type = other RNA
ggcgggaccttcaacaattacgcc

SEQ ID NO: 45023 - RNA, 24 nt, synthetic construct
  misc_feature 1..24: note = derived and/or modified sequence opt5 from anti-influenza_CDR
  source 1..24: mol_type = other RNA
atcagccccattttcggctccgtg

SEQ ID NO: 45024 - RNA, 24 nt, synthetic construct
  misc_feature 1..24: note = derived and/or modified sequence opt5 from anti-influenza_CDR
  source 1..24: mol_type = other RNA
agctccaacatcggccacaatttc

SEQ ID NO: 45025 - RNA, 24 nt, synthetic construct
  misc_feature 1..24: note = derived and/or modified sequence opt5 from anti-influenza_CDR
  source 1..24: mol_type = other RNA
ggcacctgggacagctccctgtct

SEQ ID NO: 45026 - RNA, 24 nt, synthetic construct
  misc_feature 1..24: note = derived and/or modified sequence opt5 from anti-influenza_CDR
  source 1..24: mol_type = other RNA
ggcgggatcattagaaagtacgcc

SEQ ID NO: 45027 - RNA, 24 nt, synthetic construct
  misc_feature 1..24: note = derived and/or modified sequence opt5 from anti-influenza_CDR
  source 1..24: mol_type = other RNA
atcattgccatcttcaacaccgct

SEQ ID NO: 45028 - RNA, 24 nt, synthetic construct
  misc_feature 1..24: note = derived and/or modified sequence opt5 from anti-influenza_CDR
  source 1..24: mol_type = other RNA
ggctacaccttcacagcctatacg

SEQ ID NO: 45029 - RNA, 24 nt, synthetic construct
  misc_feature 1..24: note = derived and/or modified sequence opt5 from anti-influenza_CDR
  source 1..24: mol_type = other RNA
atcaacgccggcaatgggcacacc

SEQ ID NO: 45030 - RNA, 24 nt, synthetic construct
  misc_feature 1..24: note = derived and/or modified sequence opt5 from anti-influenza_CDR
  source 1..24: mol_type = other RNA
ggcgggaccttcatcaactacgcc

SEQ ID NO: 45031 - RNA, 24 nt, synthetic construct
  misc_feature 1..24: note = derived and/or modified sequence opt5 from anti-influenza_CDR
  source 1..24: mol_type = other RNA
atcattcccgtgtacggcaccagc

SEQ ID NO: 45032 - RNA, 24 nt, synthetic construct
  misc_feature 1..24: note = derived and/or modified sequence opt5 from anti-influenza_CDR
  source 1..24: mol_type = other RNA
ggcttcacctttagaagccacgcc

SEQ ID NO: 45033 - RNA, 24 nt, synthetic construct
  misc_feature 1..24: note = derived and/or modified sequence opt5 from anti-influenza_CDR
  source 1..24: mol_type = other RNA
atcagctacgacgaggtgaacaag

SEQ ID NO: 45034 - RNA, 24 nt, synthetic construct
  misc_feature 1..24: note = derived and/or modified sequence opt5 from anti-influenza_CDR
  source 1..24: mol_type = other RNA
ggctacaacttcgccgcttattac

SEQ ID NO: 45035 - RNA, 24 nt, synthetic construct
  misc_feature 1..24: note = derived and/or modified sequence opt5 from anti-influenza_CDR
  source 1..24: mol_type = other RNA
agcaaccccaataccggcggggcc

SEQ ID NO: 45036 - RNA, 24 nt, synthetic construct
  misc_feature 1..24: note = derived and/or modified sequence opt5 from anti-influenza_CDR
  source 1..24: mol_type = other RNA
ggctacaccctgatcgactattac

SEQ ID NO: 45037 - RNA, 24 nt, synthetic construct
  misc_feature 1..24: note = derived and/or modified sequence opt5 from anti-influenza_CDR
  source 1..24: mol_type = other RNA
atcaaccccattaatggcgggacc

SEQ ID NO: 45038 - RNA, 24 nt, synthetic construct
  misc_feature 1..24: note = derived and/or modified sequence opt5 from anti-influenza_CDR
  source 1..24: mol_type = other RNA
ggcttcacctttagcgcctacgct

SEQ ID NO: 45039 - RNA, 24 nt, synthetic construct
  misc_feature 1..24: note = derived and/or modified sequence opt5 from anti-influenza_CDR
  source 1..24: mol_type = other RNA
accagctacgacggcagagattcc

SEQ ID NO: 45040 - RNA, 24 nt, synthetic construct
  misc_feature 1..24: note = derived and/or modified sequence opt5 from anti-influenza_CDR
  source 1..24: mol_type = other RNA
ggcttcacctttacaaactacgcc

SEQ ID NO: 45041 - RNA, 24 nt, synthetic construct
  misc_feature 1..24: note = derived and/or modified sequence opt5 from anti-influenza_CDR
  source 1..24: mol_type = other RNA
atcagcttcgacgaggataacaag

SEQ ID NO: 45042 - RNA, 24 nt, synthetic construct
  misc_feature 1..24: note = derived and/or modified sequence opt5 from anti-influenza_CDR
  source 1..24: mol_type = other RNA
ggcttcaactttagctcctacggg

SEQ ID NO: 45043 - RNA, 24 nt, synthetic construct
  misc_feature 1..24: note = derived and/or modified sequence opt5 from anti-influenza_CDR
  source 1..24: mol_type = other RNA
atctggagcggcgggtccaacaag

SEQ ID NO: 45044 - RNA, 24 nt, synthetic construct
  misc_feature 1..24: note = derived and/or modified sequence opt5 from anti-influenza_CDR
  source 1..24: mol_type = other RNA
ggcttcatctttggggacttcgcc

SEQ ID NO: 45045 - RNA, 24 nt, synthetic construct
  misc_feature 1..24: note = derived and/or modified sequence opt5 from anti-influenza_CDR
  source 1..24: mol_type = other RNA
ggcttcaactttgacgagtacgtg

SEQ ID NO: 45046 - RNA, 24 nt, synthetic construct
  misc_feature 1..24: note = derived and/or modified sequence opt5 from anti-influenza_CDR
  source 1..24: mol_type = other RNA
atcggcgccgacgggagaggaacc

SEQ ID NO: 45047 - RNA, 24 nt, synthetic construct
  misc_feature 1..24: note = derived and/or modified sequence opt5 from anti-influenza_CDR
  source 1..24: mol_type = other RNA
ggcgggagcgtgtccaactactat

SEQ ID NO: 45048 - RNA, 24 nt, synthetic construct
  misc_feature 1..24: note = derived and/or modified sequence opt5 from anti-influenza_CDR
  source 1..24: mol_type = other RNA
ggcgggaccttcagctactatgcc

SEQ ID NO: 45049 - RNA, 24 nt, synthetic construct
  misc_feature 1..24: note = derived and/or modified sequence opt5 from anti-influenza_CDR
  source 1..24: mol_type = other RNA
atcattcccatcgtgggcaccgcc

SEQ ID NO: 45050 - RNA, 24 nt, synthetic construct
  misc_feature 1..24: note = derived and/or modified sequence opt5 from anti-influenza_CDR
  source 1..24: mol_type = other RNA
accagcaacatcggctccaataca

SEQ ID NO: 45051 - RNA, 24 nt, synthetic construct
  misc_feature 1..24: note = derived and/or modified sequence opt5 from anti-influenza_CDR
  source 1..24: mol_type = other RNA
ggctacaacttccccaagtattgg

SEQ ID NO: 45052 - RNA, 24 nt, synthetic construct
  misc_feature 1..24: note = derived and/or modified sequence opt5 from anti-influenza_CDR
  source 1..24: mol_type = other RNA
atctaccccggcgacagcgatgtg

SEQ ID NO: 45053 - RNA, 24 nt, synthetic construct
  misc_feature 1..24: note = derived and/or modified sequence opt5 from anti-influenza_CDR
  source 1..24: mol_type = other RNA
ggccacaccttcatcagctacgcc

SEQ ID NO: 45054 - RNA, 24 nt, synthetic construct
  misc_feature 1..24: note = derived and/or modified sequence opt5 from anti-influenza_CDR
  source 1..24: mol_type = other RNA
atcgtgcccattttcggcaccgtc

SEQ ID NO: 45055 - RNA, 24 nt, synthetic construct
  misc_feature 1..24: note = derived and/or modified sequence opt5 from anti-influenza_CDR
  source 1..24: mol_type = other RNA
ggcttcacctttagaacatacggg

SEQ ID NO: 45056 - RNA, 24 nt, synthetic construct
  misc_feature 1..24: note = derived and/or modified sequence opt5 from anti-influenza_CDR
  source 1..24: mol_type = other RNA
atcagctacgacggcaccaacaag

SEQ ID NO: 45057 - RNA, 24 nt, synthetic construct
  misc_feature 1..24: note = derived and/or modified sequence opt5 from anti-influenza_CDR
  source 1..24: mol_type = other RNA
ggcttcacctttagctcctacggg

SEQ ID NO: 45058 - RNA, 24 nt, synthetic construct
  misc_feature 1..24: note = derived and/or modified sequence opt5 from anti-influenza_CDR
  source 1..24: mol_type = other RNA
atcagctacgacgagattaacaag

SEQ ID NO: 45059 - RNA, 24 nt, synthetic construct
  misc_feature 1..24: note = derived and/or modified sequence opt5 from anti-influenza_CDR
  source 1..24: mol_type = other RNA
ggcttcagcctgtggacctccggg

SEQ ID NO: 45060 - RNA, 24 nt, synthetic construct
  misc_feature 1..24: note = derived and/or modified sequence opt5 from anti-influenza_CDR
  source 1..24: mol_type = other RNA
atgagctacgacgagaccaagaaa

SEQ ID NO: 45061 - RNA, 24 nt, synthetic construct
  misc_feature 1..24: note = derived and/or modified sequence opt5 from anti-influenza_CDR
  source 1..24: mol_type = other RNA
ggcttcacctttagcagatactcc

SEQ ID NO: 45062 - RNA, 24 nt, synthetic construct
  misc_feature 1..24: note = derived and/or modified sequence opt5 from anti-influenza_CDR
  source 1..24: mol_type = other RNA
atcagcgacacctccagaacaatt

SEQ ID NO: 45063 - RNA, 24 nt, synthetic construct
  misc_feature 1..24: note = derived and/or modified sequence opt5 from anti-influenza_CDR
  source 1..24: mol_type = other RNA
ggcttcacctttaacagctacgcc

SEQ ID NO: 45064 - RNA, 24 nt, synthetic construct
  misc_feature 1..24: note = derived and/or modified sequence opt5 from anti-influenza_CDR
  source 1..24: mol_type = other RNA
atcagaggcagcggggagaacacc

SEQ ID NO: 45065 - RNA, 24 nt, synthetic construct
  misc_feature 1..24: note = derived and/or modified sequence opt5 from anti-influenza_CDR
  source 1..24: mol_type = other RNA
ggcttcacctttagcagattctcc

SEQ ID NO: 45066 - RNA, 24 nt, synthetic construct
  misc_feature 1..24: note = derived and/or modified sequence opt5 from anti-influenza_CDR
  source 1..24: mol_type = other RNA
atcagcgacaccggcagaacaatt

SEQ ID NO: 45067 - RNA, 24 nt, synthetic construct
  misc_feature 1..24: note = derived and/or modified sequence opt5 from anti-influenza_CDR
  source 1..24: mol_type = other RNA
ggcgacagcttcacctcctactgg

SEQ ID NO: 45068 - RNA, 24 nt, synthetic construct
  misc_feature 1..24: note = derived and/or modified sequence opt5 from anti-influenza_CDR
  source 1..24: mol_type = other RNA
atctaccccagagacagcgagacc

SEQ ID NO: 45069 - RNA, 24 nt, synthetic construct
  misc_feature 1..24: note = derived and/or modified sequence opt5 from anti-influenza_CDR
  source 1..24: mol_type = other RNA
ggctacaccttcacagcctatcac

SEQ ID NO: 45070 - RNA, 24 nt, synthetic construct
  misc_feature 1..24: note = derived and/or modified sequence opt5 from anti-influenza_CDR
  source 1..24: mol_type = other RNA
atcaaccccaatagcggcgccacc

SEQ ID NO: 45071 - RNA, 24 nt, synthetic construct
  misc_feature 1..24: note = derived and/or modified sequence opt5 from anti-influenza_CDR
  source 1..24: mol_type = other RNA
ggcttcacctttagcgactactgg

SEQ ID NO: 45072 - RNA, 24 nt, synthetic construct
  misc_feature 1..24: note = derived and/or modified sequence opt5 from anti-influenza_CDR
  source 1..24: mol_type = other RNA
atcagctccgacggctctaccaca

SEQ ID NO: 45073 - RNA, 24 nt, synthetic construct
  misc_feature 1..24: note = derived and/or modified sequence opt5 from anti-influenza_CDR
  source 1..24: mol_type = other RNA
ggcttcagcttttccaacgcctgg

SEQ ID NO: 45074 - RNA, 24 nt, synthetic construct
  misc_feature 1..24: note = derived and/or modified sequence opt5 from anti-influenza_CDR
  source 1..24: mol_type = other RNA
ggcctgaccttcagcaacgcctgg

SEQ ID NO: 45075 - RNA, 24 nt, synthetic construct
  misc_feature 1..24: note = derived and/or modified sequence opt5 from anti-influenza_CDR
  source 1..24: mol_type = other RNA
ggcttcacctttagcaacgcctgg

SEQ ID NO: 45076 - RNA, 24 nt, synthetic construct
  misc_feature 1..24: note = derived and/or modified sequence opt5 from anti-influenza_CDR
  source 1..24: mol_type = other RNA
ggcctgagcttcctcaacgcctgg

SEQ ID NO: 45077 - RNA, 24 nt, synthetic construct
  misc_feature 1..24: note = derived and/or modified sequence opt5 from anti-influenza_CDR
  source 1..24: mol_type = other RNA
ggcttcagctttctgaacgcctgg

SEQ ID NO: 45078 - RNA, 24 nt, synthetic construct
  misc_feature 1..24: note = derived and/or modified sequence opt5 from anti-influenza_CDR
  source 1..24: mol_type = other RNA
ggcctgaccttcctcaacgcctgg

SEQ ID NO: 45079 - RNA, 24 nt, synthetic construct
  misc_feature 1..24: note = derived and/or modified sequence opt5 from anti-influenza_CDR
  source 1..24: mol_type = other RNA
ggcttcacctttctgaacgcctgg

SEQ ID NO: 45080 - RNA, 24 nt, synthetic construct
  misc_feature 1..24: note = derived and/or modified sequence opt5 from anti-influenza_CDR
  source 1..24: mol_type = other RNA
ggctacaccttcacagactattac

SEQ ID NO: 45081 - RNA, 24 nt, synthetic construct
  misc_feature 1..24: note = derived and/or modified sequence opt5 from anti-influenza_CDR
  source 1..24: mol_type = other RNA
gtgaacccctacagcggcgggacc

SEQ ID NO: 45082 - RNA, 24 nt, synthetic construct
  misc_feature 1..24: note = derived and/or modified sequence opt5 from anti-influenza_CDR
  source 1..24: mol_type = other RNA
ggctacaccttcacagactataac

SEQ ID NO: 45083 - RNA, 24 nt, synthetic construct
  misc_feature 1..24: note = derived and/or modified sequence opt5 from anti-influenza_CDR
  source 1..24: mol_type = other RNA
atctaccccaacaatggcgggacc

SEQ ID NO: 45084 - RNA, 24 nt, synthetic construct
  misc_feature 1..24: note = derived and/or modified sequence opt5 from anti-influenza_CDR
  source 1..24: mol_type = other RNA
ggctacaccttcacagggtataac

SEQ ID NO: 45085 - RNA, 24 nt, synthetic construct
  misc_feature 1..24: note = derived and/or modified sequence opt5 from anti-influenza_CDR
  source 1..24: mol_type = other RNA
atctaccccaacaatggcgtgacc

SEQ ID NO: 45086 - RNA, 24 nt, synthetic construct
  misc_feature 1..24: note = derived and/or modified sequence opt5 from anti-influenza_CDR
  source 1..24: mol_type = other RNA
atggagaccgacacactgctcctg

SEQ ID NO: 45087 - RNA, 27 nt, synthetic construct
  misc_feature 1..27: note = derived and/or modified sequence opt5 from anti-influenza_CDR
  source 1..27: mol_type = other RNA
gacggcgtgaccaacaaggtcaatagc

SEQ ID NO: 45088 - RNA, 27 nt, synthetic construct
  misc_feature 1..27: note = derived and/or modified sequence opt5 from anti-influenza_CDR
  source 1..27: mol_type = other RNA
ggcagcgacgtggggtcctctaacctg

SEQ ID NO: 45089 - RNA, 27 nt, synthetic construct
  misc_feature 1..27: note = derived and/or modified sequence opt5 from anti-influenza_CDR
  source 1..27: mol_type = other RNA
atgcagaacatcctgctccccctgacc

SEQ ID NO: 45090 - RNA, 27 nt, synthetic construct
  misc_feature 1..27: note = derived and/or modified sequence opt5 from anti-influenza_CDR
  source 1..27: mol_type = other RNA
atgcagagcctgcaactccccctgacc

SEQ ID NO: 45091 - RNA, 27 nt, synthetic construct
  misc_feature 1..27: note = derived and/or modified sequence opt5 from anti-influenza_CDR
  source 1..27: mol_type = other RNA
cagcaacactacagaacaccccctacc

SEQ ID NO: 45092 - RNA, 27 nt, synthetic construct
  misc_feature 1..27: note = derived and/or modified sequence opt5 from anti-influenza_CDR
  source 1..27: mol_type = other RNA
cagcaatacggcaacagcccctatacc

SEQ ID NO: 45093 - RNA, 27 nt, synthetic construct
  misc_feature 1..27: note = derived and/or modified sequence opt5 from anti-influenza_CDR
  source 1..27: mol_type = other RNA
cagcaatacggcagctccccctatacc

SEQ ID NO: 45094 - RNA, 27 nt, synthetic construct
  misc_feature 1..27: note = derived and/or modified sequence opt5 from anti-influenza_CDR
  source 1..27: mol_type = other RNA
cagcaatacggcaccagcccccagaca

SEQ ID NO: 45095 - RNA, 27 nt, synthetic construct
  misc_feature 1..27: note = derived and/or modified sequence opt5 from anti-influenza_CDR
  source 1..27: mol_type = other RNA
cagcaatacggctatctgcccctcacc

SEQ ID NO: 45096 - RNA, 27 nt, synthetic construct
  misc_feature 1..27: note = derived and/or modified sequence opt5 from anti-influenza_CDR
  source 1..27: mol_type = other RNA
caggcctgggacagctccaccgctgtg

SEQ ID NO: 45097 - RNA, 27 nt, synthetic construct
  misc_feature 1..27: note = derived and/or modified sequence opt5 from anti-influenza_CDR
  source 1..27: mol_type = other RNA
cagcactacaacgcctattggggcacc

SEQ ID NO: 45098 - RNA, 27 nt, synthetic construct
  misc_feature 1..27: note = derived and/or modified sequence opt5 from anti-influenza_CDR
  source 1..27: mol_type = other RNA
cagcaaacctacagctcccctcccaca

SEQ ID NO: 45099 - RNA, 27 nt, synthetic construct
  misc_feature 1..27: note = derived and/or modified sequence opt5 from anti-influenza_CDR
  source 1..27: mol_type = other RNA
cagcaatactatagcttcccctacacc

SEQ ID NO: 45100 - RNA, 27 nt, synthetic construct
  misc_feature 1..27: note = derived and/or modified sequence opt5 from anti-influenza_CDR
  source 1..27: mol_type = other RNA
atgcaggccctgcaactccccctggct

SEQ ID NO: 45101 - RNA, 27 nt, synthetic construct
  misc_feature 1..27: note = derived and/or modified sequence opt5 from anti-influenza_CDR
  source 1..27: mol_type = other RNA
cagcaagccaacagcttcccctttacc

SEQ ID NO: 45102 - RNA, 27 nt, synthetic construct
  misc_feature 1..27: note = derived and/or modified sequence opt5 from anti-influenza_CDR
  source 1..27: mol_type = other RNA
cagcaactgaacggctaccccctcacc

SEQ ID NO: 45103 - RNA, 27 nt, synthetic construct
  misc_feature 1..27: note = derived and/or modified sequence opt5 from anti-influenza_CDR
  source 1..27: mol_type = other RNA
atgcaggccctgcaaacacccctcacc

SEQ ID NO: 45104 - RNA, 27 nt, synthetic construct
  misc_feature 1..27: note = derived and/or modified sequence opt5 from anti-influenza_CDR
  source 1..27: mol_type = other RNA
cagcaaaactacaattggcccctgacc

SEQ ID NO: 45105 - RNA, 27 nt, synthetic construct
  misc_feature 1..27: note = derived and/or modified sequence opt5 from anti-influenza_CDR
  source 1..27: mol_type = other RNA
cagcaatacgacaccagctccggcctg

SEQ ID NO: 45106 - RNA, 27 nt, synthetic construct
  misc_feature 1..27: note = derived and/or modified sequence opt5 from anti-influenza_CDR
  source 1..27: mol_type = other RNA
cagcaatacaacagctggcccagaacc

SEQ ID NO: 45107 - RNA, 27 nt, synthetic construct
  misc_feature 1..27: note = derived and/or modified sequence opt5 from anti-influenza_CDR
  source 1..27: mol_type = other RNA
gtgatctacagccacggcagagcctat

SEQ ID NO: 45108 - RNA, 27 nt, synthetic construct
  misc_feature 1..27: note = derived and/or modified sequence opt5 from anti-influenza_CDR
  source 1..27: mol_type = other RNA
cagcaatacggcgacagcagatatacc

SEQ ID NO: 45109 - RNA, 27 nt, synthetic construct
  misc_feature 1..27: note = derived and/or modified sequence opt5 from anti-influenza_CDR
  source 1..27: mol_type = other RNA
ctgcagcacaacagctacccctatacc

SEQ ID NO: 45110 - RNA, 27 nt, synthetic construct
  misc_feature 1..27: note = derived and/or modified sequence opt5 from anti-influenza_CDR
  source 1..27: mol_type = other RNA
agaaagatgaccacagccttcgacagc

SEQ ID NO: 45111 - RNA, 27 nt, synthetic construct
  misc_feature 1..27: note = derived and/or modified sequence opt5 from anti-influenza_CDR
  source 1..27: mol_type = other RNA
cagagaaaccacagcccctcctggacc

SEQ ID NO: 45112 - RNA, 27 nt, synthetic construct
  misc_feature 1..27: note = derived and/or modified sequence opt5 from anti-influenza_CDR
  source 1..27: mol_type = other RNA
cagcaaagctacgacaacccccagacc

SEQ ID NO: 45113 - RNA, 27 nt, synthetic construct
  misc_feature 1..27: note = derived and/or modified sequence opt5 from anti-influenza_CDR
  source 1..27: mol_type = other RNA
cagcaaagcagacggctgccctacacc

SEQ ID NO: 45114 - RNA, 27 nt, synthetic construct
  misc_feature 1..27: note = derived and/or modified sequence opt5 from anti-influenza_CDR
  source 1..27: mol_type = other RNA
agaaagatgaccacagccatcgactac

SEQ ID NO: 45115 - RNA, 27 nt, synthetic construct
  misc_feature 1..27: note = derived and/or modified sequence opt5 from anti-influenza_CDR
  source 1..27: mol_type = other RNA
atcagatacaccggccagcaactgctc

SEQ ID NO: 45116 - RNA, 27 nt, synthetic construct
  misc_feature 1..27: note = derived and/or modified sequence opt5 from anti-influenza_CDR
  source 1..27: mol_type = other RNA
cagcactacggcaccatcagccaaaca

SEQ ID NO: 45117 - RNA, 27 nt, synthetic construct
  misc_feature 1..27: note = derived and/or modified sequence opt5 from anti-influenza_CDR
  source 1..27: mol_type = other RNA
cagcaatacagcacctcccctcccaca

SEQ ID NO: 45118 - RNA, 27 nt, synthetic construct
  misc_feature 1..27: note = derived and/or modified sequence opt5 from anti-influenza_CDR
  source 1..27: mol_type = other RNA
cagcaatacggcaacagccccatcacc

SEQ ID NO: 45119 - RNA, 27 nt, synthetic construct
  misc_feature 1..27: note = derived and/or modified sequence opt5 from anti-influenza_CDR
  source 1..27: mol_type = other RNA
cagcaatactatagcagaccctacacc

SEQ ID NO: 45120 - RNA, 27 nt, synthetic construct
  misc_feature 1..27: note = derived and/or modified sequence opt5 from anti-influenza_CDR
  source 1..27: mol_type = other RNA
caggtgtgggacaacttcggcggggtc

SEQ ID NO: 45121 - RNA, 27 nt, synthetic construct
  misc_feature 1..27: note = derived and/or modified sequence opt5 from anti-influenza_CDR
  source 1..27: mol_type = other RNA
cagcaaagctactcctctcccctgacc

SEQ ID NO: 45122 - RNA, 27 nt, synthetic construct
  misc_feature 1..27: note = derived and/or modified sequence opt5 from anti-influenza_CDR
  source 1..27: mol_type = other RNA
cagcaatacttcgccacccccagaaca

SEQ ID NO: 45123 - RNA, 27 nt, synthetic construct
  misc_feature 1..27: note = derived and/or modified sequence opt5 from anti-influenza_CDR
  source 1..27: mol_type = other RNA
cagcaatactatttcagccccctgacc

SEQ ID NO: 45124 - RNA, 27 nt, synthetic construct
  misc_feature 1..27: note = derived and/or modified sequence opt5 from anti-influenza_CDR
  source 1..27: mol_type = other RNA
cagcacttcggcaccagcgtgtttaca

SEQ ID NO: 45125 - RNA, 27 nt, synthetic construct
  misc_feature 1..27: note = derived and/or modified sequence opt5 from anti-influenza_CDR
  source 1..27: mol_type = other RNA
cagcaatactataacgcccccctgacc

SEQ ID NO: 45126 - RNA, 27 nt, synthetic construct
  misc_feature 1..27: note = derived and/or modified sequence opt5 from anti-influenza_CDR
  source 1..27: mol_type = other RNA
gtgctgttcaccagcccctttgacttc

SEQ ID NO: 45127 - RNA, 27 nt, synthetic construct
  misc_feature 1..27: note = derived and/or modified sequence opt5 from anti-influenza_CDR
  source 1..27: mol_type = other RNA
ctgctcagctactccggcgtgtgggtc

SEQ ID NO: 45128 - RNA, 27 nt, synthetic construct
  misc_feature 1..27: note = derived and/or modified sequence opt5 from anti-influenza_CDR
  source 1..27: mol_type = other RNA
ttcctgagctactccggcgcctgggtg

SEQ ID NO: 45129 - RNA, 27 nt, synthetic construct
  misc_feature 1..27: note = derived and/or modified sequence opt5 from anti-influenza_CDR
  source 1..27: mol_type = other RNA
caacagagcttctccaagtcttggacc

SEQ ID NO: 45130 - RNA, 27 nt, synthetic construct
  misc_feature 1..27: note = derived and/or modified sequence opt5 from anti-influenza_CDR
  source 1..27: mol_type = other RNA
gtgcagtacgtccaattcccctggacc

SEQ ID NO: 45131 - RNA, 27 nt, synthetic construct
  misc_feature 1..27: note = derived and/or modified sequence opt5 from anti-influenza_CDR
  source 1..27: mol_type = other RNA
cagcaaagctactcccctcccctgacc

SEQ ID NO: 45132 - RNA, 27 nt, synthetic construct
  misc_feature 1..27: note = derived and/or modified sequence opt5 from anti-influenza_CDR
  source 1..27: mol_type = other RNA
ttcatctactatggcgggaacaccaag

SEQ ID NO: 45133 - RNA, 27 nt, synthetic construct
  misc_feature 1..27: note = derived and/or modified sequence opt5 from anti-influenza_CDR
  source 1..27: mol_type = other RNA
gtgatctacagcggcgggtccacctat

SEQ ID NO: 45134 - RNA, 27 nt, synthetic construct
  misc_feature 1..27: note = derived and/or modified sequence opt5 from anti-influenza_CDR
  source 1..27: mol_type = other RNA
ttcatgtttcacagcggctcccccaga

SEQ ID NO: 45135 - RNA, 27 nt, synthetic construct
  misc_feature 1..27: note = derived and/or modified sequence opt5 from anti-influenza_CDR
  source 1..27: mol_type = other RNA
cagcaaacctacagcacacccatcacg

SEQ ID NO: 45136 - RNA, 27 nt, synthetic construct
  misc_feature 1..27: note = derived and/or modified sequence opt5 from anti-influenza_CDR
  source 1..27: mol_type = other RNA
ttcttttacaacggcgggagcaccaag

SEQ ID NO: 45137 - RNA, 27 nt, synthetic construct
  misc_feature 1..27: note = derived and/or modified sequence opt5 from anti-influenza_CDR
  source 1..27: mol_type = other RNA
cagcaaagctacaacacccccctgatc

SEQ ID NO: 45138 - RNA, 27 nt, synthetic construct
  misc_feature 1..27: note = derived and/or modified sequence opt5 from anti-influenza_CDR
  source 1..27: mol_type = other RNA
cacatctacgactatggcagaaccttc

SEQ ID NO: 45139 - RNA, 27 nt, synthetic construct
  misc_feature 1..27: note = derived and/or modified sequence opt5 from anti-influenza_CDR
  source 1..27: mol_type = other RNA
gtgttctacagcgagaccagaacatat

SEQ ID NO: 45140 - RNA, 27 nt, synthetic construct
  misc_feature 1..27: note = derived and/or modified sequence opt5 from anti-influenza_CDR
  source 1..27: mol_type = other RNA
caggtgtggggcagctcctctgaccac

SEQ ID NO: 45141 - RNA, 27 nt, synthetic construct
  misc_feature 1..27: note = derived and/or modified sequence opt5 from anti-influenza_CDR
  source 1..27: mol_type = other RNA
tacgtgtataacagaggcagcaccaag

SEQ ID NO: 45142 - RNA, 27 nt, synthetic construct
  misc_feature 1..27: note = derived and/or modified sequence opt5 from anti-influenza_CDR
  source 1..27: mol_type = other RNA
tacatctataacagaggcagcaccaag

SEQ ID NO: 45143 - RNA, 27 nt, synthetic construct
  misc_feature 1..27: note = derived and/or modified sequence opt5 from anti-influenza_CDR
  source 1..27: mol_type = other RNA
cagcaaagctacaacacccccatcaca

SEQ ID NO: 45144 - RNA, 27 nt, synthetic construct
  misc_feature 1..27: note = derived and/or modified sequence opt5 from anti-influenza_CDR
  source 1..27: mol_type = other RNA
cagcaatactatagctcccctcccacc

SEQ ID NO: 45145 - RNA, 27 nt, synthetic construct
  misc_feature 1..27: note = derived and/or modified sequence opt5 from anti-influenza_CDR
  source 1..27: mol_type = other RNA
tacctgtattacagcggctccaccaag

SEQ ID NO: 45146 - RNA, 27 nt, synthetic construct
  misc_feature 1..27: note = derived and/or modified sequence opt5 from anti-influenza_CDR
  source 1..27: mol_type = other RNA
cagcaaagctactcccctcccatcacc

SEQ ID NO: 45147 - RNA, 27 nt, synthetic construct
  misc_feature 1..27: note = derived and/or modified sequence opt5 from anti-influenza_CDR
  source 1..27: mol_type = other RNA
tacgtgtataacagcggcaataccaag

SEQ ID NO: 45148 - RNA, 27 nt, synthetic construct
  misc_feature 1..27: note = derived and/or modified sequence opt5 from anti-influenza_CDR
  source 1..27: mol_type = other RNA
cagcaaagctacaacacacccctgacc

SEQ ID NO: 45149 - RNA, 27 nt, synthetic construct
  misc_feature 1..27: note = derived and/or modified sequence opt5 from anti-influenza_CDR
  source 1..27: mol_type = other RNA
cacatcttcgacagcggctccacctac

SEQ ID NO: 45150 - RNA, 27 nt, synthetic construct
  misc_feature 1..27: note = derived and/or modified sequence opt5 from anti-influenza_CDR
  source 1..27: mol_type = other RNA
gtgttctacagcgccgacagaacctcc

SEQ ID NO: 45151 - RNA, 27 nt, synthetic construct
  misc_feature 1..27: note = derived and/or modified sequence opt5 from anti-influenza_CDR
  source 1..27: mol_type = other RNA
cagcaatactatagcacacccctgacc

SEQ ID NO: 45152 - RNA, 27 nt, synthetic construct
  misc_feature 1..27: note = derived and/or modified sequence opt5 from anti-influenza_CDR
  source 1..27: mol_type = other RNA
tacatctattacagcggcaacacctat

SEQ ID NO: 45153 - RNA, 27 nt, synthetic construct
  misc_feature 1..27: note = derived and/or modified sequence opt5 from anti-influenza_CDR
  source 1..27: mol_type = other RNA
cagcaaagctactccacacccctgacc

SEQ ID NO: 45154 - RNA, 27 nt, synthetic construct
  misc_feature 1..27: note = derived and/or modified sequence opt5 from anti-influenza_CDR
  source 1..27: mol_type = other RNA
cagcaatacggcagctcctctctgacc

SEQ ID NO: 45155 - RNA, 27 nt, synthetic construct
  misc_feature 1..27: note = derived and/or modified sequence opt5 from anti-influenza_CDR
  source 1..27: mol_type = other RNA
agctcctacacctctagctccacatat

SEQ ID NO: 45156 - RNA, 27 nt, synthetic construct
  misc_feature 1..27: note = derived and/or modified sequence opt5 from anti-influenza_CDR
  source 1..27: mol_type = other RNA
cagagatacaacagcgcccctcccatc

SEQ ID NO: 45157 - RNA, 27 nt, synthetic construct
  misc_feature 1..27: note = derived and/or modified sequence opt5 from anti-influenza_CDR
  source 1..27: mol_type = other RNA
cagcaatacggcagaacacccctgacc

SEQ ID NO: 45158 - RNA, 27 nt, synthetic construct
  misc_feature 1..27: note = derived and/or modified sequence opt5 from anti-influenza_CDR
  source 1..27: mol_type = other RNA
cagcaatacggcagctcccccagaacc

SEQ ID NO: 45159 - RNA, 27 nt, synthetic construct
  misc_feature 1..27: note = derived and/or modified sequence opt5 from anti-influenza_CDR
  source 1..27: mol_type = other RNA
cagcaatacggctccagccccctgacc

SEQ ID NO: 45160 - RNA, 27 nt, synthetic construct
  misc_feature 1..27: note = derived and/or modified sequence opt5 from anti-influenza_CDR
  source 1..27: mol_type = other RNA
caggtgtgggacagctcctctgatcac

SEQ ID NO: 45161 - RNA, 27 nt, synthetic construct
  misc_feature 1..27: note = derived and/or modified sequence opt5 from anti-influenza_CDR
  source 1..27: mol_type = other RNA
aaggagttcagcgaagtggagggcaga

SEQ ID NO: 45162 - RNA, 27 nt, synthetic construct
  misc_feature 1..27: note = derived and/or modified sequence opt5 from anti-influenza_CDR
  source 1..27: mol_type = other RNA
aaagagttcaacaatctggaaaagaga

SEQ ID NO: 45163 - RNA, 27 nt, synthetic construct
  misc_feature 1..27: note = derived and/or modified sequence opt5 from anti-influenza_CDR
  source 1..27: mol_type = other RNA
cagcaacactacagaacccctcccagc

SEQ ID NO: 45164 - RNA, 27 nt, synthetic construct
  misc_feature 1..27: note = derived and/or modified sequence opt5 from anti-influenza_CDR
  source 1..27: mol_type = other RNA
atgcaggccacccactggcccctgaca

SEQ ID NO: 45165 - RNA, 27 nt, synthetic construct
  misc_feature 1..27: note = derived and/or modified sequence opt5 from anti-influenza_CDR
  source 1..27: mol_type = other RNA
cagcaatactatagctacccctatacc

SEQ ID NO: 45166 - RNA, 27 nt, synthetic construct
  misc_feature 1..27: note = derived and/or modified sequence opt5 from anti-influenza_CDR
  source 1..27: mol_type = other RNA
agctccgacgtgggcgggtacaactat

SEQ ID NO: 45167 - RNA, 27 nt, synthetic construct
  misc_feature 1..27: note = derived and/or modified sequence opt5 from anti-influenza_CDR
  source 1..27: mol_type = other RNA
agctccgacgtgggcgattacaactat

SEQ ID NO: 45168 - RNA, 27 nt, synthetic construct
  misc_feature 1..27: note = derived and/or modified sequence opt5 from anti-influenza_CDR
  source 1..27: mol_type = other RNA
cagcaatacaacaattggcccctgagc

SEQ ID NO: 45169 - RNA, 27 nt, synthetic construct
  misc_feature 1..27: note = derived and/or modified sequence opt5 from anti-influenza_CDR
  source 1..27: mol_type = other RNA
cagcaaagctacaactatcccagaacc

SEQ ID NO: 45170 - RNA, 27 nt, synthetic construct
  misc_feature 1..27: note = derived and/or modified sequence opt5 from anti-influenza_CDR
  source 1..27: mol_type = other RNA
atgcagggcctgcaaaccccctacaca

SEQ ID NO: 45171 - RNA, 27 nt, synthetic construct
  misc_feature 1..27: note = derived and/or modified sequence opt5 from anti-influenza_CDR
  source 1..27: mol_type = other RNA
cagcaacactacagcatccccctgacc

SEQ ID NO: 45172 - RNA, 27 nt, synthetic construct
  misc_feature 1..27: note = derived and/or modified sequence opt5 from anti-influenza_CDR
  source 1..27: mol_type = other RNA
ctgcagcacaacagctacccctggacc

SEQ ID NO: 45173 - RNA, 27 nt, synthetic construct
  misc_feature 1..27: note = derived and/or modified sequence opt5 from anti-influenza_CDR
  source 1..27: mol_type = other RNA
cagcaatacaacacctggcccctgaca

SEQ ID NO: 45174 - RNA, 27 nt, synthetic construct
  misc_feature 1..27: note = derived and/or modified sequence opt5 from anti-influenza_CDR
  source 1..27: mol_type = other RNA
cagcaatacaacagcttcccctataga

SEQ ID NO: 45175 - RNA, 27 nt, synthetic construct
  misc_feature 1..27: note = derived and/or modified sequence opt5 from anti-influenza_CDR
  source 1..27: mol_type = other RNA
cagcaaagctactccgcccccttcacc

SEQ ID NO: 45176 - RNA, 27 nt, synthetic construct
  misc_feature 1..27: note = derived and/or modified sequence opt5 from anti-influenza_CDR
  source 1..27: mol_type = other RNA
caggcctgggacagctccaccgtggtc

SEQ ID NO: 45177 - RNA, 27 nt, synthetic construct
  misc_feature 1..27: note = derived and/or modified sequence opt5 from anti-influenza_CDR
  source 1..27: mol_type = other RNA
caggcctgggacagcaccacagtggtc

SEQ ID NO: 45178 - RNA, 27 nt, synthetic construct
  misc_feature 1..27: note = derived and/or modified sequence opt5 from anti-influenza_CDR
  source 1..27: mol_type = other RNA
ctgcagtacggcagctcccccagaacc

SEQ ID NO: 45179 - RNA, 27 nt, synthetic construct
  misc_feature 1..27: note = derived and/or modified sequence opt5 from anti-influenza_CDR
  source 1..27: mol_type = other RNA
agctccgacgtgggcgggtacgattat

SEQ ID NO: 45180 - RNA, 27 nt, synthetic construct
  misc_feature 1..27: note = derived and/or modified sequence opt5 from anti-influenza_CDR
  source 1..27: mol_type = other RNA
cagcaatacacctattggcccctgaca

SEQ ID NO: 45181 - RNA, 27 nt, synthetic construct
  misc_feature 1..27: note = derived and/or modified sequence opt5 from anti-influenza_CDR
  source 1..27: mol_type = other RNA
cagcaatacgacaagtggccccctggc

SEQ ID NO: 45182 - RNA, 27 nt, synthetic construct
  misc_feature 1..27: note = derived and/or modified sequence opt5 from anti-influenza_CDR
  source 1..27: mol_type = other RNA
atgcagagcctgcaaacctccatcaca

SEQ ID NO: 45183 - RNA, 27 nt, synthetic construct
  misc_feature 1..27: note = derived and/or modified sequence opt5 from anti-influenza_CDR
  source 1..27: mol_type = other RNA
agccagatcgagctggccgtgctcctg

SEQ ID NO: 45184 - RNA, 27 nt, synthetic construct
  misc_feature 1..27: note = derived and/or modified sequence opt5 from anti-influenza_CDR
  source 1..27: mol_type = other RNA
atgcaggccctgcaaaccccctacaca

SEQ ID NO: 45185 - RNA, 27 nt, synthetic construct
  misc_feature 1..27: note = derived and/or modified sequence opt5 from anti-influenza_CDR
  source 1..27: mol_type = other RNA
cagcaaagaagccactggccccctatc

SEQ ID NO: 45186 - RNA, 27 nt, synthetic construct
  misc_feature 1..27: note = derived and/or modified sequence opt5 from anti-influenza_CDR
  source 1..27: mol_type = other RNA
cagcacttctggggcacacccctgacc

SEQ ID NO: 45187 - RNA, 27 nt, synthetic construct
  misc_feature 1..27: note = derived and/or modified sequence opt5 from anti-influenza_CDR
  source 1..27: mol_type = other RNA
cagcaaaactacgaggacccctggacc

SEQ ID NO: 45188 - RNA, 27 nt, synthetic construct
  misc_feature 1..27: note = derived and/or modified sequence opt5 from anti-influenza_CDR
  source 1..27: mol_type = other RNA
cagcaagccaacagcttccctcccacc

SEQ ID NO: 45189 - RNA, 27 nt, synthetic construct
  misc_feature 1..27: note = derived and/or modified sequence opt5 from anti-influenza_CDR
  source 1..27: mol_type = other RNA
cagcaaagagaccactggccccctatc

SEQ ID NO: 45190 - RNA, 27 nt, synthetic construct
  misc_feature 1..27: note = derived and/or modified sequence opt5 from anti-influenza_CDR
  source 1..27: mol_type = other RNA
atggacagcagactgaacctcgtgttc

SEQ ID NO: 45191 - RNA, 27 nt, synthetic construct
  misc_feature 1..27: note = derived and/or modified sequence opt5 from anti-influenza_CDR
  source 1..27: mol_type = other RNA
atgaagctgcccgtgagactcctggtc

SEQ ID NO: 45192 - RNA, 30 nt, synthetic construct; identical to SEQ ID NO: 29908
  misc_feature 1..30: note = derived and/or modified sequence opt5 from anti-influenza_CDR
  source 1..30: mol_type = other RNA

SEQ ID NO: 45193 - RNA, 30 nt, synthetic construct; identical to SEQ ID NO: 29909
  misc_feature 1..30: note = derived and/or modified sequence opt5 from anti-influenza_CDR
  source 1..30: mol_type = other RNA

SEQ ID NO: 45194 - RNA, 30 nt, synthetic construct; identical to SEQ ID NO: 29910
  misc_feature 1..30: note = derived and/or modified sequence opt5 from anti-influenza_CDR
  source 1..30: mol_type = other RNA

SEQ ID NO: 45195 - RNA, 30 nt, synthetic construct; identical to SEQ ID NO: 29911
  misc_feature 1..30: note = derived and/or modified sequence opt5 from anti-influenza_CDR
  source 1..30: mol_type = other RNA

SEQ ID NO: 45196 - RNA, 30 nt, synthetic construct
  misc_feature 1..30: note = derived and/or modified sequence opt5 from anti-influenza_CDR
  source 1..30: mol_type = other RNA
agctcctacacctctagctccacatatgtg

SEQ ID NO: 45197 - RNA, 30 nt, synthetic construct; identical to SEQ ID NO: 29913
  misc_feature 1..30: note = derived and/or modified sequence opt5 from anti-influenza_CDR
  source 1..30: mol_type = other RNA

SEQ ID NO: 45198 - RNA, 30 nt, synthetic construct; identical to SEQ ID NO: 29914
  misc_feature 1..30: note = derived and/or modified sequence opt5 from anti-influenza_CDR
  source 1..30: mol_type = other RNA

SEQ ID NO: 45199 - RNA, 30 nt, synthetic construct; identical to SEQ ID NO: 29915
  misc_feature 1..30: note = derived and/or modified sequence opt5 from anti-influenza_CDR
  source 1..30: mol_type = other RNA

SEQ ID NO: 45200 - RNA, 30 nt, synthetic construct; identical to SEQ ID NO: 29916
  misc_feature 1..30: note = derived and/or modified sequence opt5 from anti-influenza_CDR
  source 1..30: mol_type = other RNA

SEQ ID NO: 45201 - RNA, 30 nt, synthetic construct; identical to SEQ ID NO: 29917
  misc_feature 1..30: note = derived and/or modified sequence opt5 from anti-influenza_CDR
  source 1..30: mol_type = other RNA

SEQ ID NO: 45202 - RNA, 30 nt, synthetic construct; identical to SEQ ID NO: 29918
  misc_feature 1..30: note = derived and/or modified sequence opt5 from anti-influenza_CDR
  source 1..30: mol_type = other RNA

SEQ ID NO: 45203 - RNA, 30 nt, synthetic construct; identical to SEQ ID NO: 29919
  misc_feature 1..30: note = derived and/or modified sequence opt5 from anti-influenza_CDR
  source 1..30: mol_type = other RNA

SEQ ID NO: 45204 - RNA, 30 nt, synthetic construct; identical to SEQ ID NO: 29920
  misc_feature 1..30: note = derived and/or modified sequence opt5 from anti-influenza_CDR
  source 1..30: mol_type = other RNA

SEQ ID NO: 45205 - RNA, 30 nt, synthetic construct
  misc_feature 1..30: note = derived and/or modified sequence opt5 from anti-influenza_CDR
  source 1..30: mol_type = other RNA
agctcctacgccggctctagcacctgggtg

SEQ ID NO: 45206 - RNA, 30 nt, synthetic construct; identical to SEQ ID NO: 14638
  misc_feature 1..30: note = derived and/or modified sequence opt5 from anti-influenza_CDR
  source 1..30: mol_type = other RNA

SEQ ID NO: 45207 - RNA, 30 nt, synthetic construct; identical to SEQ ID NO: 29923
  misc_feature 1..30: note = derived and/or modified sequence opt5 from anti-influenza_CDR
  source 1..30: mol_type = other RNA

SEQ ID NO: 45208 - RNA, 30 nt, synthetic construct; identical to SEQ ID NO: 29924
  misc_feature 1..30: note = derived and/or modified sequence opt5 from anti-influenza_CDR
  source 1..30: mol_type = other RNA

SEQ ID NO: 45209 - RNA, 30 nt, synthetic construct; identical to SEQ ID NO: 29925
  misc_feature 1..30: note = derived and/or modified sequence opt5 from anti-influenza_CDR
  source 1..30: mol_type = other RNA

SEQ ID NO: 45210 - RNA, 30 nt, synthetic construct; identical to SEQ ID NO: 29926
  misc_feature 1..30: note = derived and/or modified sequence opt5 from anti-influenza_CDR
  source 1..30: mol_type = other RNA

SEQ ID NO: 45211 - RNA, 30 nt, synthetic construct; identical to SEQ ID NO: 29927
  misc_feature 1..30: note = derived and/or modified sequence opt5 from anti-influenza_CDR
  source 1..30: mol_type = other RNA

SEQ ID NO: 45212 - RNA, 30 nt, synthetic construct; identical to SEQ ID NO: 29928
  misc_feature 1..30: note = derived and/or modified sequence opt5 from anti-influenza_CDR
  source 1..30: mol_type = other RNA

SEQ ID NO: 45213 - RNA, 30 nt, synthetic construct
  misc_feature 1..30: note = derived and/or modified sequence opt5 from anti-influenza_CDR
  source 1..30: mol_type = other RNA
cagagctacgacaactccctgtctggcagc

SEQ ID NO: 45214 - RNA, 30 nt, synthetic construct; identical to SEQ ID NO: 14646
  misc_feature 1..30: note = derived and/or modified sequence opt5 from anti-influenza_CDR
  source 1..30: mol_type = other RNA

SEQ ID NO: 45215 - RNA, 30 nt, synthetic construct; identical to SEQ ID NO: 14647
  misc_feature 1..30: note = derived and/or modified sequence opt5 from anti-influenza_CDR
  source 1..30: mol_type = other RNA

SEQ ID NO: 45216 - RNA, 30 nt, synthetic construct; identical to SEQ ID NO: 29932
  misc_feature 1..30: note = derived and/or modified sequence opt5 from anti-influenza_CDR
  source 1..30: mol_type = other RNA

SEQ ID NO: 45217 - RNA, 30 nt, synthetic construct; identical to SEQ ID NO: 29933
  misc_feature 1..30: note = derived and/or modified sequence opt5 from anti-influenza_CDR
  source 1..30: mol_type = other RNA

SEQ ID NO: 45218 - RNA, 30 nt, synthetic construct
  misc_feature 1..30: note = derived and/or modified sequence opt5 from anti-influenza_CDR
  source 1..30: mol_type = other RNA
agctcctacacctctagctccacacacgtg

SEQ ID NO: 45219 - RNA, 30 nt, synthetic construct
  misc_feature 1..30: note = derived and/or modified sequence opt5 from anti-influenza_CDR
  source 1..30: mol_type = other RNA
agctcctacacctctagctccacactggtg

SEQ ID NO: 45220 - RNA, 30 nt, synthetic construct; identical to SEQ ID NO: 29936
  misc_feature 1..30: note = derived and/or modified sequence opt5 from anti-influenza_CDR
  source 1..30: mol_type = other RNA

SEQ ID NO: 45221 - RNA, 30 nt, synthetic construct; identical to SEQ ID NO: 29937
  misc_feature 1..30: note = derived and/or modified sequence opt5 from anti-influenza_CDR
  source 1..30: mol_type = other RNA

SEQ ID NO: 45222 - RNA, 30 nt, synthetic construct
  misc_feature 1..30: note = derived and/or modified sequence opt5 from anti-influenza_CDR
  source 1..30: mol_type = other RNA
agctccaactacaatagacggttcaccccc

SEQ ID NO: 45223 - RNA, 30 nt, synthetic construct
  misc_feature 1..30: note = derived and/or modified sequence opt5 from anti-influenza_CDR
  source 1..30: mol_type = other RNA
agacccaaggtgcgggaccaggagagccgc

SEQ ID NO: 45224 - RNA, 30 nt, synthetic construct
  misc_feature 1..30: note = derived and/or modified sequence opt5 from anti-influenza_CDR
  source 1..30: mol_type = other RNA
agaccctgggtgcggggcgtcagctcccgc

SEQ ID NO: 45225 - RNA, 30 nt, synthetic construct
  misc_feature 1..30: note = derived and/or modified sequence opt5 from anti-influenza_CDR
  source 1..30: mol_type = other RNA
agaccctgggtgcggggcctgagctcccgc

SEQ ID NO: 45226 - RNA, 30 nt, synthetic construct
  misc_feature 1..30: note = derived and/or modified sequence opt5 from anti-influenza_CDR
  source 1..30: mol_type = other RNA
agacccaaggtgcggggccaggccgggcgc

SEQ ID NO: 45227 - RNA, 30 nt, synthetic construct
  misc_feature 1..30: note = derived and/or modified sequence opt5 from anti-influenza_CDR
  source 1..30: mol_type = other RNA
gcccccgctgtggccgcgcaggctagcgcc

SEQ ID NO: 45228 - RNA, 30 nt, synthetic construct; identical to SEQ ID NO: 29944
  misc_feature 1..30: note = derived and/or modified sequence opt5 from anti-influenza_CDR
  source 1..30: mol_type = other RNA

SEQ ID NO: 45229 - RNA, 30 nt, synthetic construct; identical to SEQ ID NO: 29945
  misc_feature 1..30: note = derived and/or modified sequence opt5 from anti-influenza_CDR
  source 1..30: mol_type = other RNA

SEQ ID NO: 45230 - RNA, 30 nt, synthetic construct; identical to SEQ ID NO: 29946
  misc_feature 1..30: note = derived and/or modified sequence opt5 from anti-influenza_CDR
  source 1..30: mol_type = other RNA

SEQ ID NO: 45231 - RNA, 30 nt, synthetic construct; identical to SEQ ID NO: 14663
  misc_feature 1..30: note = derived and/or modified sequence opt5 from anti-influenza_CDR
  source 1..30: mol_type = other RNA

SEQ ID NO: 45232 - RNA, 30 nt, synthetic construct; identical to SEQ ID NO: 14664
  misc_feature 1..30: note = derived and/or modified sequence opt5 from anti-influenza_CDR
  source 1..30: mol_type = other RNA

SEQ ID NO: 45233 - RNA, 30 nt, synthetic construct; identical to SEQ ID NO: 29949
  misc_feature 1..30: note = derived and/or modified sequence opt5 from anti-influenza_CDR
  source 1..30: mol_type = other RNA

SEQ ID NO: 45234 - RNA, 30 nt, synthetic construct; identical to SEQ ID NO: 29950
  misc_feature 1..30: note = derived and/or modified sequence opt5 from anti-influenza_CDR
  source 1..30: mol_type = other RNA

SEQ ID NO: 45235 - RNA, 30 nt, synthetic construct; identical to SEQ ID NO: 29951
  misc_feature 1..30: note = derived and/or modified sequence opt5 from anti-influenza_CDR
  source 1..30: mol_type = other RNA

SEQ ID NO: 45236 - RNA, 30 nt, synthetic construct; identical to SEQ ID NO: 29952
  misc_feature 1..30: note = derived and/or modified sequence opt5 from anti-influenza_CDR
  source 1..30: mol_type = other RNA

SEQ ID NO: 45237 - RNA, 30 nt, synthetic construct; identical to SEQ ID NO: 29953
  misc_feature 1..30: note = derived and/or modified sequence opt5 from anti-influenza_CDR
  source 1..30: mol_type = other RNA

SEQ ID NO: 45238 - RNA, 30 nt, synthetic construct; identical to SEQ ID NO: 29954
  misc_feature 1..30: note = derived and/or modified sequence opt5 from anti-influenza_CDR
  source 1..30: mol_type = other RNA

SEQ ID NO: 45239 - RNA, 30 nt, synthetic construct; identical to SEQ ID NO: 29955
  misc_feature 1..30: note = derived and/or modified sequence opt5 from anti-influenza_CDR
  source 1..30: mol_type = other RNA

SEQ ID NO: 45240 - RNA, 30 nt, synthetic construct
  misc_feature 1..30: note = derived and/or modified sequence opt5 from anti-influenza_CDR
  source 1..30: mol_type = other RNA
atcagaagcggcctgaaccggttcgagacc

SEQ ID NO: 45241 - RNA, 30 nt, synthetic construct; identical to SEQ ID NO: 29957
  misc_feature 1..30: note = derived and/or modified sequence opt5 from anti-influenza_CDR
  source 1..30: mol_type = other RNA

SEQ ID NO: 45242 - RNA, 30 nt, synthetic construct; identical to SEQ ID NO: 29958
  misc_feature 1..30: note = derived and/or modified sequence opt5 from anti-influenza_CDR
  source 1..30: mol_type = other RNA

SEQ ID NO: 45243 - RNA, 30 nt, synthetic construct; identical to SEQ ID NO: 29959
  misc_feature 1..30: note = derived and/or modified sequence opt5 from anti-influenza_CDR
  source 1..30: mol_type = other RNA

SEQ ID NO: 45244 - RNA, 30 nt, synthetic construct; identical to SEQ ID NO: 29960
  misc_feature 1..30: note = derived and/or modified sequence opt5 from anti-influenza_CDR
  source 1..30: mol_type = other RNA

SEQ ID NO: 45245 - RNA, 30 nt, synthetic construct; identical to SEQ ID NO: 29961
  misc_feature 1..30: note = derived and/or modified sequence opt5 from anti-influenza_CDR
  source 1..30: mol_type = other RNA

SEQ ID NO: 45246 - RNA, 30 nt, synthetic construct; identical to SEQ ID NO: 29962
  misc_feature 1..30: note = derived and/or modified sequence opt5 from anti-influenza_CDR
  source 1..30: mol_type = other RNA

SEQ ID NO: 45247 - RNA, 30 nt, synthetic construct
  misc_feature 1..30: note = derived and/or modified sequence opt5 from anti-influenza_CDR
  source 1..30: mol_type = other RNA
cagcaactgaccacataccctcccatcacg

SEQ ID NO: 45248 - RNA, 30 nt, synthetic construct
  misc_feature 1..30: note = derived and/or modified sequence opt5 from anti-influenza_CDR
  source 1..30: mol_type = other RNA
ggcgggagcatctccaacggaggctaccac

SEQ ID NO: 45249 - RNA, 30 nt, synthetic construct; identical to SEQ ID NO: 29965
  misc_feature 1..30: note = derived and/or modified sequence opt5 from anti-influenza_CDR
  source 1..30: mol_type = other RNA

SEQ ID NO: 45250 - RNA, 30 nt, synthetic construct; identical to SEQ ID NO: 29966
  misc_feature 1..30: note = derived and/or modified sequence opt5 from anti-influenza_CDR
  source 1..30: mol_type = other RNA

SEQ ID NO: 45251 - RNA, 30 nt, synthetic construct; identical to SEQ ID NO: 29967
  misc_feature 1..30: note = derived and/or modified sequence opt5 from anti-influenza_CDR
  source 1..30: mol_type = other RNA

SEQ ID NO: 45252 - RNA, 30 nt, synthetic construct; identical to SEQ ID NO: 29968
  misc_feature 1..30: note = derived and/or modified sequence opt5 from anti-influenza_CDR
  source 1..30: mol_type = other RNA

SEQ ID NO: 45253 - RNA, 30 nt, synthetic construct
  misc_feature 1..30: note = derived and/or modified sequence opt5 from anti-influenza_CDR
  source 1..30: mol_type = other RNA
gccggcgactacagcggggctaactatgcc

SEQ ID NO: 45254 - RNA, 30 nt, synthetic construct; identical to SEQ ID NO: 29970
  misc_feature 1..30: note = derived and/or modified sequence opt5 from anti-influenza_CDR
  source 1..30: mol_type = other RNA

SEQ ID NO: 45255 - RNA, 30 nt, synthetic construct; identical to SEQ ID NO: 29971
  misc_feature 1..30: note = derived and/or modified sequence opt5 from anti-influenza_CDR
  source 1..30: mol_type = other RNA

SEQ ID NO: 45256 - RNA, 30 nt, synthetic construct; identical to SEQ ID NO: 29972
  misc_feature 1..30: note = derived and/or modified sequence opt5 from anti-influenza_CDR
  source 1..30: mol_type = other RNA

SEQ ID NO: 45257 - RNA, 30 nt, synthetic construct
  misc_feature 1..30: note = derived and/or modified sequence opt5 from anti-influenza_CDR
  source 1..30: mol_type = other RNA
atcaagagcaacaccgacggcgggacaacg

SEQ ID NO: 45258 - RNA, 30 nt, synthetic construct; identical to SEQ ID NO: 14690
  misc_feature 1..30: note = derived and/or modified sequence opt5 from anti-influenza_CDR
  source 1..30: mol_type = other RNA

SEQ ID NO: 45259 - RNA, 30 nt, synthetic construct; identical to SEQ ID NO: 29975
  misc_feature 1..30: note = derived and/or modified sequence opt5 from anti-influenza_CDR
  source 1..30: mol_type = other RNA

SEQ ID NO: 45260 - RNA, 30 nt, synthetic construct; identical to SEQ ID NO: 29976
  misc_feature 1..30: note = derived and/or modified sequence opt5 from anti-influenza_CDR
  source 1..30: mol_type = other RNA

SEQ ID NO: 45261 - RNA, 33 nt, synthetic construct; identical to SEQ ID NO: 29977
  misc_feature 1..33: note = derived and/or modified sequence opt5 from anti-influenza_CDR
  source 1..33: mol_type = other RNA

SEQ ID NO: 45262 - RNA, 33 nt, synthetic construct
  misc_feature 1..33: note = derived and/or modified sequence opt5 from anti-influenza_CDR
  source 1..33: mol_type = other RNA
tgcagctacgccggctcctctagctccagagtg

SEQ ID NO: 45263 - RNA, 33 nt, synthetic construct
  misc_feature 1..33: note = derived and/or modified sequence opt5 from anti-influenza_CDR
  source 1..33: mol_type = other RNA
ctggtgctcgccaccggcctgagaaacagcccc

SEQ ID NO: 45264 - RNA, 33 nt, synthetic construct; identical to SEQ ID NO: 14696
  misc_feature 1..33: note = derived and/or modified sequence opt5 from anti-influenza_CDR
  source 1..33: mol_type = other RNA

SEQ ID NO: 45265 - RNA, 33 nt, synthetic construct
  misc_feature 1..33: note = derived and/or modified sequence opt5 from anti-influenza_CDR
  source 1..33: mol_type = other RNA
agaaccagccagtccctgtctagctacctccac

SEQ ID NO: 45266 - RNA, 33 nt, synthetic construct
  misc_feature 1..33: note = derived and/or modified sequence opt5 from anti-influenza_CDR
  source 1..33: mol_type = other RNA
agagccagccagcggctgaactcctacctccac

SEQ ID NO: 45267 - RNA, 33 nt, synthetic construct
  misc_feature 1..33: note = derived and/or modified sequence opt5 from anti-influenza_CDR
  source 1..33: mol_type = other RNA
agaaccagccagtccctgcggtcttacctccac

SEQ ID NO: 45268 - RNA, 33 nt, synthetic construct
  misc_feature 1..33: note = derived and/or modified sequence opt5 from anti-influenza_CDR
  source 1..33: mol_type = other RNA
agaaccagccagtccctgtctagctacacacac

SEQ ID NO: 45269 - RNA, 33 nt, synthetic construct
  misc_feature 1..33: note = derived and/or modified sequence opt5 from anti-influenza_CDR
  source 1..33: mol_type = other RNA
agaaccagccagtccctgtctagctacgaccac

SEQ ID NO: 45270 - RNA, 33 nt, synthetic construct; identical to SEQ ID NO: 29986
  misc_feature 1..33: note = derived and/or modified sequence opt5 from anti-influenza_CDR
  source 1..33: mol_type = other RNA

SEQ ID NO: 45271 - RNA, 33 nt, synthetic construct; identical to SEQ ID NO: 29987
  misc_feature 1..33: note = derived and/or modified sequence opt5 from anti-influenza_CDR
  source 1..33: mol_type = other RNA

SEQ ID NO: 45272 - RNA, 33 nt, synthetic construct; identical to SEQ ID NO: 29988
  misc_feature 1..33: note = derived and/or modified sequence opt5 from anti-influenza_CDR
  source 1..33: mol_type = other RNA

SEQ ID NO: 45273 - RNA, 33 nt, synthetic construct; identical to SEQ ID NO: 29989
  misc_feature 1..33: note = derived and/or modified sequence opt5 from anti-influenza_CDR
  source 1..33: mol_type = other RNA

SEQ ID NO: 45274 - RNA, 33 nt, synthetic construct
  misc_feature 1..33: note = derived and/or modified sequence opt5 from anti-influenza_CDR
  source 1..33: mol_type = other RNA
agagccagccagggcatccggaacgacctgggg

SEQ ID NO: 45275 - RNA, 33 nt, synthetic construct
  misc_feature 1..33: note = derived and/or modified sequence opt5 from anti-influenza_CDR
  source 1..33: mol_type = other RNA
agagccagccagaacatccggtcctacctgaat

SEQ ID NO: 45276 - RNA, 33 nt, synthetic construct; identical to SEQ ID NO: 29992
  misc_feature 1..33: note = derived and/or modified sequence opt5 from anti-influenza_CDR
  source 1..33: mol_type = other RNA

SEQ ID NO: 45277 - RNA, 33 nt, synthetic construct; identical to SEQ ID NO: 29993
  misc_feature 1..33: note = derived and/or modified sequence opt5 from anti-influenza_CDR
  source 1..33: mol_type = other RNA

SEQ ID NO: 45278 - RNA, 33 nt, synthetic construct; identical to SEQ ID NO: 29994
  misc_feature 1..33: note = derived and/or modified sequence opt5 from anti-influenza_CDR
  source 1..33: mol_type = other RNA

SEQ ID NO: 45279 - RNA, 33 nt, synthetic construct; identical to SEQ ID NO: 29995
  misc_feature 1..33: note = derived and/or modified sequence opt5 from anti-influenza_CDR
  source 1..33: mol_type = other RNA

SEQ ID NO: 45280 - RNA, 33 nt, synthetic construct
  misc_feature 1..33: note = derived and/or modified sequence opt5 from anti-influenza_CDR
  source 1..33: mol_type = other RNA
agagccagccagtccatcgcttcttggctggcc

SEQ ID NO: 45281 - RNA, 33 nt, synthetic construct; identical to SEQ ID NO: 29997
  misc_feature 1..33: note = derived and/or modified sequence opt5 from anti-influenza_CDR
  source 1..33: mol_type = other RNA

SEQ ID NO: 45282 - RNA, 33 nt, synthetic construct
  misc_feature 1..33: note = derived and/or modified sequence opt5 from anti-influenza_CDR
  source 1..33: mol_type = other RNA
agagccagccagtccgtgtctagctacctggct

SEQ ID NO: 45283 - RNA, 33 nt, synthetic construct; identical to SEQ ID NO: 29999
  misc_feature 1..33: note = derived and/or modified sequence opt5 from anti-influenza_CDR
  source 1..33: mol_type = other RNA

SEQ ID NO: 45284 - RNA, 33 nt, synthetic construct
  misc_feature 1..33: note = derived and/or modified sequence opt5 from anti-influenza_CDR
  source 1..33: mol_type = other RNA
cagagcgccgactcctctggcaccagctgggtg

SEQ ID NO: 45285 - RNA, 33 nt, synthetic construct
  misc_feature 1..33: note = derived and/or modified sequence opt5 from anti-influenza_CDR
  source 1..33: mol_type = other RNA
ggcgggagcaacatcggaggcaagtccgtgcac

SEQ ID NO: 45286 - RNA, 33 nt, synthetic construct; identical to SEQ ID NO: 30002
  misc_feature 1..33: note = derived and/or modified sequence opt5 from anti-influenza_CDR
  source 1..33: mol_type = other RNA

SEQ ID NO: 45287 - RNA, 33 nt, synthetic construct
  misc_feature 1..33: note = derived and/or modified sequence opt5 from anti-influenza_CDR
  source 1..33: mol_type = other RNA
agagccagccagtccatctctagctacctgaac

SEQ ID NO: 45288 - RNA, 33 nt, synthetic construct; identical to SEQ ID NO: 30004
  misc_feature 1..33: note = derived and/or modified sequence opt5 from anti-influenza_CDR
  source 1..33: mol_type = other RNA

SEQ ID NO: 45289 - RNA, 33 nt, synthetic construct; identical to SEQ ID NO: 30005
  misc_feature 1..33: note = derived and/or modified sequence opt5 from anti-influenza_CDR
  source 1..33: mol_type = other RNA

SEQ ID NO: 45290 - RNA, 33 nt, synthetic construct; identical to SEQ ID NO: 30006
  misc_feature 1..33: note = derived and/or modified sequence opt5 from anti-influenza_CDR
  source 1..33: mol_type = other RNA

SEQ ID NO: 45291 - RNA, 33 nt, synthetic construct; identical to SEQ ID NO: 30007
  misc_feature 1..33: note = derived and/or modified sequence opt5 from anti-influenza_CDR
  source 1..33: mol_type = other RNA

SEQ ID NO: 45292 - RNA, 33 nt, synthetic construct; identical to SEQ ID NO: 30008
  misc_feature 1..33: note = derived and/or modified sequence opt5 from anti-influenza_CDR
  source 1..33: mol_type = other RNA

SEQ ID NO: 45293 - RNA, 33 nt, synthetic construct; identical to SEQ ID NO: 30009
  misc_feature 1..33: note = derived and/or modified sequence opt5 from anti-influenza_CDR
  source 1..33: mol_type = other RNA

SEQ ID NO: 45294 - RNA, 33 nt, synthetic construct
  misc_feature 1..33: note = derived and/or modified sequence opt5 from anti-influenza_CDR
  source 1..33: mol_type = other RNA
agagccagccagaacatcaagcggtacttcaat

SEQ ID NO: 45295 - RNA, 33 nt, synthetic construct; identical to SEQ ID NO: 30011
  misc_feature 1..33: note = derived and/or modified sequence opt5 from anti-influenza_CDR
  source 1..33: mol_type = other RNA

SEQ ID NO: 45296 - RNA, 33 nt, synthetic construct; identical to SEQ ID NO: 30012
  misc_feature 1..33: note = derived and/or modified sequence opt5 from anti-influenza_CDR
  source 1..33: mol_type = other RNA

SEQ ID NO: 45297 - RNA, 33 nt, synthetic construct; identical to SEQ ID NO: 30013
  misc_feature 1..33: note = derived and/or modified sequence opt5 from anti-influenza_CDR
  source 1..33: mol_type = other RNA

SEQ ID NO: 45298 - RNA, 33 nt, synthetic construct; identical to SEQ ID NO: 30014
  misc_feature 1..33: note = derived and/or modified sequence opt5 from anti-influenza_CDR
  source 1..33: mol_type = other RNA

SEQ ID NO: 45299 - RNA, 33 nt, synthetic construct
  misc_feature 1..33: note = derived and/or modified sequence opt5 from anti-influenza_CDR
  source 1..33: mol_type = other RNA
agaaccagccagtccatctctagctacctgaac

SEQ ID NO: 45300 - RNA, 33 nt, synthetic construct; identical to SEQ ID NO: 30016
  misc_feature 1..33: note = derived and/or modified sequence opt5 from anti-influenza_CDR
  source 1..33: mol_type = other RNA

SEQ ID NO: 45301 - RNA, 33 nt, synthetic construct; identical to SEQ ID NO: 30017
  misc_feature 1..33: note = derived and/or modified sequence opt5 from anti-influenza_CDR
  source 1..33: mol_type = other RNA

SEQ ID NO: 45302 - RNA, 33 nt, synthetic construct; identical to SEQ ID NO: 30018
  misc_feature 1..33: note = derived and/or modified sequence opt5 from anti-influenza_CDR
  source 1..33: mol_type = other RNA

SEQ ID NO: 45303 - RNA, 33 nt, synthetic construct; identical to SEQ ID NO: 30019
  misc_feature 1..33: note = derived and/or modified sequence opt5 from anti-influenza_CDR
  source 1..33: mol_type = other RNA

SEQ ID NO: 45304 - RNA, 33 nt, synthetic construct; identical to SEQ ID NO: 30020
  misc_feature 1..33: note = derived and/or modified sequence opt5 from anti-influenza_CDR
  source 1..33: mol_type = other RNA

SEQ ID NO: 45305 - RNA, 33 nt, synthetic construct; identical to SEQ ID NO: 30021
  misc_feature 1..33: note = derived and/or modified sequence opt5 from anti-influenza_CDR
  source 1..33: mol_type = other RNA

SEQ ID NO: 45306 - RNA, 33 nt, synthetic construct; identical to SEQ ID NO: 30022
  misc_feature 1..33: note = derived and/or modified sequence opt5 from anti-influenza_CDR
  source 1..33: mol_type = other RNA

SEQ ID NO: 45307 - RNA, 33 nt, synthetic construct; identical to SEQ ID NO: 30023
  misc_feature 1..33: note = derived and/or modified sequence opt5 from anti-influenza_CDR
  source 1..33: mol_type = other RNA

SEQ ID NO: 45308 - RNA, 33 nt, synthetic construct; identical to SEQ ID NO: 30024
  misc_feature 1..33: note = derived and/or modified sequence opt5 from anti-influenza_CDR
  source 1..33: mol_type = other RNA

SEQ ID NO: 45309 - RNA, 33 nt, synthetic construct
  misc_feature 1..33: note = derived and/or modified sequence opt5 from anti-influenza_CDR
  source 1..33: mol_type = other RNA
agagccagccagtccatctctcggtacctgaac

SEQ ID NO: 45310 - RNA, 33 nt, synthetic construct; identical to SEQ ID NO: 30026
  misc_feature 1..33: note = derived and/or modified sequence opt5 from anti-influenza_CDR
  source 1..33: mol_type = other RNA

SEQ ID NO: 45311 - RNA, 33 nt, synthetic construct; identical to SEQ ID NO: 30027
  misc_feature 1..33: note = derived and/or modified sequence opt5 from anti-influenza_CDR
  source 1..33: mol_type = other RNA

SEQ ID NO: 45312 - RNA, 33 nt, synthetic construct; identical to SEQ ID NO: 30028
  misc_feature 1..33: note = derived and/or modified sequence opt5 from anti-influenza_CDR
  source 1..33: mol_type = other RNA

SEQ ID NO: 45313 - RNA, 33 nt, synthetic construct; identical to SEQ ID NO: 30029
  misc_feature 1..33: note = derived and/or modified sequence opt5 from anti-influenza_CDR
  source 1..33: mol_type = other RNA

SEQ ID NO: 45314 - RNA, 33 nt, synthetic construct; identical to SEQ ID NO: 30030
  misc_feature 1..33: note = derived and/or modified sequence opt5 from anti-influenza_CDR
  source 1..33: mol_type = other RNA

SEQ ID NO: 45315 - RNA, 33 nt, synthetic construct; identical to SEQ ID NO: 30031
  misc_feature 1..33: note = derived and/or modified sequence opt5 from anti-influenza_CDR
  source 1..33: mol_type = other RNA

SEQ ID NO: 45316 - RNA, 33 nt, synthetic construct; identical to SEQ ID NO: 30032
  misc_feature 1..33: note = derived and/or modified sequence opt5 from anti-influenza_CDR
  source 1..33: mol_type = other RNA

SEQ ID NO: 45317 - RNA, 33 nt, synthetic construct; identical to SEQ ID NO: 30033
  misc_feature 1..33: note = derived and/or modified sequence opt5 from anti-influenza_CDR
  source 1..33: mol_type = other RNA

SEQ ID NO: 45318 - RNA, 33 nt, synthetic construct; identical to SEQ ID NO: 30034
  misc_feature 1..33: note = derived and/or modified sequence opt5 from anti-influenza_CDR
  source 1..33: mol_type = other RNA

SEQ ID NO: 45319 - RNA, 33 nt, synthetic construct
  misc_feature 1..33: note = derived and/or modified sequence opt5 from anti-influenza_CDR
  source 1..33: mol_type = other RNA
agagccagccagcgggtgtcctcttacctggct

SEQ ID NO: 45320 - RNA, 33 nt, synthetic construct; identical to SEQ ID NO: 28929
  misc_feature 1..33: note = derived and/or modified sequence opt5 from anti-influenza_CDR
  source 1..33: mol_type = other RNA

SEQ ID NO: 45321 - RNA, 33 nt, synthetic construct; identical to SEQ ID NO: 30037
  misc_feature 1..33: note = derived and/or modified sequence opt5 from anti-influenza_CDR
  source 1..33: mol_type = other RNA

SEQ ID NO: 45322 - RNA, 33 nt, synthetic construct; identical to SEQ ID NO: 30038
  misc_feature 1..33: note = derived and/or modified sequence opt5 from anti-influenza_CDR
  source 1..33: mol_type = other RNA

SEQ ID NO: 45323 - RNA, 33 nt, synthetic construct; identical to SEQ ID NO: 30039
  misc_feature 1..33: note = derived and/or modified sequence opt5 from anti-influenza_CDR
  source 1..33: mol_type = other RNA

SEQ ID NO: 45324 - RNA, 33 nt, synthetic construct
  misc_feature 1..33: note = derived and/or modified sequence opt5 from anti-influenza_CDR
  source 1..33: mol_type = other RNA
ggcgggaacaatatcggaagcaagggcgtgcac

SEQ ID NO: 45325 - RNA, 33 nt, synthetic construct; identical to SEQ ID NO: 30041
  misc_feature 1..33: note = derived and/or modified sequence opt5 from anti-influenza_CDR
  source 1..33: mol_type = other RNA

SEQ ID NO: 45326 - RNA, 33 nt, synthetic construct; identical to SEQ ID NO: 30042
  misc_feature 1..33: note = derived and/or modified sequence opt5 from anti-influenza_CDR
  source 1..33: mol_type = other RNA

SEQ ID NO: 45327 - RNA, 33 nt, synthetic construct; identical to SEQ ID NO: 30043
  misc_feature 1..33: note = derived and/or modified sequence opt5 from anti-influenza_CDR
  source 1..33: mol_type = other RNA

SEQ ID NO: 45328 - RNA, 33 nt, synthetic construct; identical to SEQ ID NO: 30044
  misc_feature 1..33: note = derived and/or modified sequence opt5 from anti-influenza_CDR
  source 1..33: mol_type = other RNA

SEQ ID NO: 45329 - RNA, 33 nt, synthetic construct; identical to SEQ ID NO: 30045
  misc_feature 1..33: note = derived and/or modified sequence opt5 from anti-influenza_CDR
  source 1..33: mol_type = other RNA

SEQ ID NO: 45330 - RNA, 33 nt, synthetic construct; identical to SEQ ID NO: 30046
  misc_feature 1..33: note = derived and/or modified sequence opt5 from anti-influenza_CDR
  source 1..33: mol_type = other RNA

SEQ ID NO: 45331 - RNA, 33 nt, synthetic construct; identical to SEQ ID NO: 30047
  misc_feature 1..33: note = derived and/or modified sequence opt5 from anti-influenza_CDR
  source 1..33: mol_type = other RNA

SEQ ID NO: 45332 - RNA, 33 nt, synthetic construct; identical to SEQ ID NO: 30048
  misc_feature 1..33: note = derived and/or modified sequence opt5 from anti-influenza_CDR
  source 1..33: mol_type = other RNA

SEQ ID NO: 45333 - RNA, 33 nt, synthetic construct
  misc_feature 1..33: note = derived and/or modified sequence opt5 from anti-influenza_CDR
  source 1..33: mol_type = other RNA
agagccagccagtccgtgtctcggtacctggct

SEQ ID NO: 45334 - RNA, 33 nt, synthetic construct
  misc_feature 1..33: note = derived and/or modified sequence opt5 from anti-influenza_CDR
  source 1..33: mol_type = other RNA
tggggccaggggaccacactgacggtgagctcc

SEQ ID NO: 45335 - RNA, 33 nt, synthetic construct; identical to SEQ ID NO: 30051
  misc_feature 1..33: note = derived and/or modified sequence opt5 from anti-influenza_CDR
  source 1..33: mol_type = other RNA

SEQ ID NO: 45336 - RNA, 33 nt, synthetic construct; identical to SEQ ID NO: 30052
  misc_feature 1..33: note = derived and/or modified sequence opt5 from anti-influenza_CDR
  source 1..33: mol_type = other RNA

SEQ ID NO: 45337 - RNA, 33 nt, synthetic construct
  misc_feature 1..33: note = derived and/or modified sequence opt5 from anti-influenza_CDR
  source 1..33: mol_type = other RNA
agagccagccagtccgtgtctagcaacctggct

SEQ ID NO: 45338 - RNA, 33 nt, synthetic construct; identical to SEQ ID NO: 30054
  misc_feature 1..33: note = derived and/or modified sequence opt5 from anti-influenza_CDR
  source 1..33: mol_type = other RNA

SEQ ID NO: 45339 - RNA, 33 nt, synthetic construct; identical to SEQ ID NO: 30055
  misc_feature 1..33: note = derived and/or modified sequence opt5 from anti-influenza_CDR
  source 1..33: mol_type = other RNA

SEQ ID NO: 45340 - RNA, 33 nt, synthetic construct; identical to SEQ ID NO: 30056
  misc_feature 1..33: note = derived and/or modified sequence opt5 from anti-influenza_CDR
  source 1..33: mol_type = other RNA

SEQ ID NO: 45341 - RNA, 33 nt, synthetic construct; identical to SEQ ID NO: 30057
  misc_feature 1..33: note = derived and/or modified sequence opt5 from anti-influenza_CDR
  source 1..33: mol_type = other RNA

SEQ ID NO: 45342 - RNA, 33 nt, synthetic construct; identical to SEQ ID NO: 30058
  misc_feature 1..33: note = derived and/or modified sequence opt5 from anti-influenza_CDR
  source 1..33: mol_type = other RNA

SEQ ID NO: 45343 - RNA, 33 nt, synthetic construct; identical to SEQ ID NO: 30059
  misc_feature 1..33: note = derived and/or modified sequence opt5 from anti-influenza_CDR
  source 1..33: mol_type = other RNA

SEQ ID NO: 45344 - RNA, 33 nt, synthetic construct; identical to SEQ ID NO: 30060
  misc_feature 1..33: note = derived and/or modified sequence opt5 from anti-influenza_CDR
  source 1..33: mol_type = other RNA

SEQ ID NO: 45345 - RNA, 33 nt, synthetic construct; identical to SEQ ID NO: 30061
  misc_feature 1..33: note = derived and/or modified sequence opt5 from anti-influenza_CDR
  source 1..33: mol_type = other RNA

SEQ ID NO: 45346 - RNA, 33 nt, synthetic construct
  misc_feature 1..33: note = derived and/or modified sequence opt5 from anti-influenza_CDR
  source 1..33: mol_type = other RNA
agagccagccagtccgtggctaacaatctggcc

SEQ ID NO: 45347 - RNA, 33 nt, synthetic construct; identical to SEQ ID NO: 30063
  misc_feature 1..33: note = derived and/or modified sequence opt5 from anti-influenza_CDR
  source 1..33: mol_type = other RNA

SEQ ID NO: 45348 - RNA, 33 nt, synthetic construct; identical to SEQ ID NO: 30064
  misc_feature 1..33: note = derived and/or modified sequence opt5 from anti-influenza_CDR
  source 1..33: mol_type = other RNA

SEQ ID NO: 45349 - RNA, 33 nt, synthetic construct; identical to SEQ ID NO: 30065
  misc_feature 1..33: note = derived and/or modified sequence opt5 from anti-influenza_CDR
  source 1..33: mol_type = other RNA

SEQ ID NO: 45350 - RNA, 33 nt, synthetic construct; identical to SEQ ID NO: 30066
  misc_feature 1..33: note = derived and/or modified sequence opt5 from anti-influenza_CDR
  source 1..33: mol_type = other RNA

SEQ ID NO: 45351 - RNA, 33 nt, synthetic construct; identical to SEQ ID NO: 30067
  misc_feature 1..33: note = derived and/or modified sequence opt5 from anti-influenza_CDR
  source 1..33: mol_type = other RNA

SEQ ID NO: 45352 - RNA, 33 nt, synthetic construct
  misc_feature 1..33: note = derived and/or modified sequence opt5 from anti-influenza_CDR
  source 1..33: mol_type = other RNA
caggtgtgggacatgagctccgatagacgggtc

SEQ ID NO: 45353 - RNA, 33 nt, synthetic construct; identical to SEQ ID NO: 30069
  misc_feature 1..33: note = derived and/or modified sequence opt5 from anti-influenza_CDR
  source 1..33: mol_type = other RNA

SEQ ID NO: 45354 - RNA, 33 nt, synthetic construct; identical to SEQ ID NO: 14786
  misc_feature 1..33: note = derived and/or modified sequence opt5 from anti-influenza_CDR
  source 1..33: mol_type = other RNA

SEQ ID NO: 45355 - RNA, 33 nt, synthetic construct; identical to SEQ ID NO: 28982
  misc_feature 1..33: note = derived and/or modified sequence opt5 from anti-influenza_CDR
  source 1..33: mol_type = other RNA

SEQ ID NO: 45356 - RNA, 33 nt, synthetic construct; identical to SEQ ID NO: 30072
  misc_feature 1..33: note = derived and/or modified sequence opt5 from anti-influenza_CDR
  source 1..33: mol_type = other RNA

SEQ ID NO: 45357 - RNA, 33 nt, synthetic construct; identical to SEQ ID NO: 30073
  misc_feature 1..33: note = derived and/or modified sequence opt5 from anti-influenza_CDR
  source 1..33: mol_type = other RNA

SEQ ID NO: 45358 - RNA, 33 nt, synthetic construct; identical to SEQ ID NO: 30074
  misc_feature 1..33: note = derived and/or modified sequence opt5 from anti-influenza_CDR
  source 1..33: mol_type = other RNA

SEQ ID NO: 45359 - RNA, 33 nt, synthetic construct; identical to SEQ ID NO: 30075
  misc_feature 1..33: note = derived and/or modified sequence opt5 from anti-influenza_CDR
  source 1..33: mol_type = other RNA

SEQ ID NO: 45360 - RNA, 33 nt, synthetic construct; identical to SEQ ID NO: 30076
  misc_feature 1..33: note = derived and/or modified sequence opt5 from anti-influenza_CDR
  source 1..33: mol_type = other RNA

SEQ ID NO: 45361 - RNA, 33 nt, synthetic construct
  misc_feature 1..33: note = derived and/or modified sequence opt5 from anti-influenza_CDR
  source 1..33: mol_type = other RNA
agagccagccggtccatcaccacattcctggct

SEQ ID NO: 45362 - RNA, 33 nt, synthetic construct; identical to SEQ ID NO: 30078
  misc_feature 1..33: note = derived and/or modified sequence opt5 from anti-influenza_CDR
  source 1..33: mol_type = other RNA

SEQ ID NO: 45363 - RNA, 33 nt, synthetic construct
  misc_feature 1..33: note = derived and/or modified sequence opt5 from anti-influenza_CDR
  source 1..33: mol_type = other RNA
agagccagccagtccgtgtctagctcctacctg

SEQ ID NO: 45364 - RNA, 36 nt, synthetic construct; identical to SEQ ID NO: 30080
  misc_feature 1..36: note = derived and/or modified sequence opt5 from anti-influenza_CDR
  source 1..36: mol_type = other RNA

SEQ ID NO: 45365 - RNA, 36 nt, synthetic construct; identical to SEQ ID NO: 30081
  misc_feature 1..36: note = derived and/or modified sequence opt5 from anti-influenza_CDR
  source 1..36: mol_type = other RNA

SEQ ID NO: 45366 - RNA, 36 nt, synthetic construct; identical to SEQ ID NO: 30082
  misc_feature 1..36: note = derived and/or modified sequence opt5 from anti-influenza_CDR
  source 1..36: mol_type = other RNA

SEQ ID NO: 45367 - RNA, 36 nt, synthetic construct; identical to SEQ ID NO: 30083
  misc_feature 1..36: note = derived and/or modified sequence opt5 from anti-influenza_CDR
  source 1..36: mol_type = other RNA

SEQ ID NO: 45368 - RNA, 36 nt, synthetic construct; identical to SEQ ID NO: 30084
  misc_feature 1..36: note = derived and/or modified sequence opt5 from anti-influenza_CDR
  source 1..36: mol_type = other RNA

SEQ ID NO: 45369 - RNA, 36 nt, synthetic construct
  misc_feature 1..36: note = derived and/or modified sequence opt5 from anti-influenza_CDR
  source 1..36: mol_type = other RNA
gtgggcaccgggggaatcgtcggcagcaagggggac

SEQ ID NO: 45370 - RNA, 36 nt, synthetic construct
  misc_feature 1..36: note = derived and/or modified sequence opt5 from anti-influenza_CDR
  source 1..36: mol_type = other RNA
agatacagccggtcctctcccggcaccttcgagagc

SEQ ID NO: 45371 - RNA, 36 nt, synthetic construct
  misc_feature 1..36: note = derived and/or modified sequence opt5 from anti-influenza_CDR
  source 1..36: mol_type = other RNA
cagagctacgactcctctctgagcggcttccacgtg

SEQ ID NO: 45372 - RNA, 36 nt, synthetic construct
  misc_feature 1..36: note = derived and/or modified sequence opt5 from anti-influenza_CDR
  source 1..36: mol_type = other RNA
agagccagccagtccgtgtctagctcccaactggct

SEQ ID NO: 45373 - RNA, 36 nt, synthetic construct
  misc_feature 1..36: note = derived and/or modified sequence opt5 from anti-influenza_CDR
  source 1..36: mol_type = other RNA
agagccagccagttcgtgtccacccggtctctggct

SEQ ID NO: 45374 - RNA, 36 nt, synthetic construct; identical to SEQ ID NO: 30090
  misc_feature 1..36: note = derived and/or modified sequence opt5 from anti-influenza_CDR
  source 1..36: mol_type = other RNA

SEQ ID NO: 45375 - RNA, 36 nt, synthetic construct
  misc_feature 1..36: note = derived and/or modified sequence opt5 from anti-influenza_CDR
  source 1..36: mol_type = other RNA
agagccagccacttcgtgaactaccggtccctggct

SEQ ID NO: 45376 - RNA, 36 nt, synthetic construct
  misc_feature 1..36: note = derived and/or modified sequence opt5 from anti-influenza_CDR
  source 1..36: mol_type = other RNA
agagccagccacttcgtgatcggccgggctgtcgcc

SEQ ID NO: 45377 - RNA, 36 nt, synthetic construct; identical to SEQ ID NO: 30093
  misc_feature 1..36: note = derived and/or modified sequence opt5 from anti-influenza_CDR
  source 1..36: mol_type = other RNA

SEQ ID NO: 45378 - RNA, 36 nt, synthetic construct; identical to SEQ ID NO: 14810
  misc_feature 1..36: note = derived and/or modified sequence opt5 from anti-influenza_CDR
  source 1..36: mol_type = other RNA

SEQ ID NO: 45379 - RNA, 36 nt, synthetic construct
  misc_feature 1..36: note = derived and/or modified sequence opt5 from anti-influenza_CDR
  source 1..36: mol_type = other RNA
gtgggcaacgggggaaatgtcgccagcaagggcgac

SEQ ID NO: 45380 - RNA, 36 nt, synthetic construct; identical to SEQ ID NO: 30096
  misc_feature 1..36: note = derived and/or modified sequence opt5 from anti-influenza_CDR
  source 1..36: mol_type = other RNA

SEQ ID NO: 45381 - RNA, 36 nt, synthetic construct
  misc_feature 1..36: note = derived and/or modified sequence opt5 from anti-influenza_CDR
  source 1..36: mol_type = other RNA
tgcctgagcagaatgcggggctacgggctcgacgtg

SEQ ID NO: 45382 - RNA, 36 nt, synthetic construct; identical to SEQ ID NO: 30098
  misc_feature 1..36: note = derived and/or modified sequence opt5 from anti-influenza_CDR
  source 1..36: mol_type = other RNA

SEQ ID NO: 45383 - RNA, 36 nt, synthetic construct; identical to SEQ ID NO: 30099
  misc_feature 1..36: note = derived and/or modified sequence opt5 from anti-influenza_CDR
  source 1..36: mol_type = other RNA

SEQ ID NO: 45384 - RNA, 36 nt, synthetic construct; identical to SEQ ID NO: 30100
  misc_feature 1..36: note = derived and/or modified sequence opt5 from anti-influenza_CDR
  source 1..36: mol_type = other RNA

SEQ ID NO: 45385 - RNA, 36 nt, synthetic construct; identical to SEQ ID NO: 30101
  misc_feature 1..36: note = derived and/or modified sequence opt5 from anti-influenza_CDR
  source 1..36: mol_type = other RNA

SEQ ID NO: 45386 - RNA, 36 nt, synthetic construct
  misc_feature 1..36: note = derived and/or modified sequence opt5 from anti-influenza_CDR
  source 1..36: mol_type = other RNA
cccctgggcatcctccactactatgccatggacctg

SEQ ID NO: 45387 - RNA, 36 nt, synthetic construct; identical to SEQ ID NO: 30103
  misc_feature 1..36: note = derived and/or modified sequence opt5 from anti-influenza_CDR
  source 1..36: mol_type = other RNA

SEQ ID NO: 45388 - RNA, 36 nt, synthetic construct
  misc_feature 1..36: note = derived and/or modified sequence opt5 from anti-influenza_CDR
  source 1..36: mol_type = other RNA
ggcatcaccaacaaggtgaatagcattatcgacaaa

SEQ ID NO: 45389 - RNA, 36 nt, synthetic construct; identical to SEQ ID NO: 30105
  misc_feature 1..36: note = derived and/or modified sequence opt5 from anti-influenza_CDR
  source 1..36: mol_type = other RNA

SEQ ID NO: 45390 - RNA, 36 nt, synthetic construct; identical to SEQ ID NO: 30106
  misc_feature 1..36: note = derived and/or modified sequence opt5 from anti-influenza_CDR
  source 1..36: mol_type = other RNA

SEQ ID NO: 45391 - RNA, 36 nt, synthetic construct; identical to SEQ ID NO: 30107
  misc_feature 1..36: note = derived and/or modified sequence opt5 from anti-influenza_CDR
  source 1..36: mol_type = other RNA

SEQ ID NO: 45392 - RNA, 36 nt, synthetic construct; identical to SEQ ID NO: 30108
  misc_feature 1..36: note = derived and/or modified sequence opt5 from anti-influenza_CDR
  source 1..36: mol_type = other RNA

SEQ ID NO: 45393 - RNA, 36 nt, synthetic construct; identical to SEQ ID NO: 30109
  misc_feature 1..36: note = derived and/or modified sequence opt5 from anti-influenza_CDR
  source 1..36: mol_type = other RNA

SEQ ID NO: 45394 - RNA, 36 nt, synthetic construct; identical to SEQ ID NO: 30110
  misc_feature 1..36: note = derived and/or modified sequence opt5 from anti-influenza_CDR
  source 1..36: mol_type = other RNA

SEQ ID NO: 45395 - RNA, 36 nt, synthetic construct
  misc_feature 1..36: note = derived and/or modified sequence opt5 from anti-influenza_CDR
  source 1..36: mol_type = other RNA
gccacctgggacagacggcccacagcttacgtggtc

SEQ ID NO: 45396 - RNA, 36 nt, synthetic construct; identical to SEQ ID NO: 30112
  misc_feature 1..36: note = derived and/or modified sequence opt5 from anti-influenza_CDR
  source 1..36: mol_type = other RNA

SEQ ID NO: 45397 - RNA, 36 nt, synthetic construct; identical to SEQ ID NO: 30113
  misc_feature 1..36: note = derived and/or modified sequence opt5 from anti-influenza_CDR
  source 1..36: mol_type = other RNA

SEQ ID NO: 45398 - RNA, 36 nt, synthetic construct; identical to SEQ ID NO: 14830
  misc_feature 1..36: note = derived and/or modified sequence opt5 from anti-influenza_CDR
  source 1..36: mol_type = other RNA

SEQ ID NO: 45399 - RNA, 36 nt, synthetic construct
  misc_feature 1..36: note = derived and/or modified sequence opt5 from anti-influenza_CDR
  source 1..36: mol_type = other RNA
agagccagccagtccgtgtctagctcctacctggct

SEQ ID NO: 45400 - RNA, 36 nt, synthetic construct; identical to SEQ ID NO: 30116
  misc_feature 1..36: note = derived and/or modified sequence opt5 from anti-influenza_CDR
  source 1..36: mol_type = other RNA

SEQ ID NO: 45401 - RNA, 36 nt, synthetic construct
  misc_feature 1..36: note = derived and/or modified sequence opt5 from anti-influenza_CDR
  source 1..36: mol_type = other RNA
agagccagccagtccgtgtctagcaactacctgggc

SEQ ID NO: 45402 - RNA, 36 nt, synthetic construct; identical to SEQ ID NO: 30118
  misc_feature 1..36: note = derived and/or modified sequence opt5 from anti-influenza_CDR
  source 1..36: mol_type = other RNA

SEQ ID NO: 45403 - RNA, 36 nt, synthetic construct; identical to SEQ ID NO: 30119
  misc_feature 1..36: note = derived and/or modified sequence opt5 from anti-influenza_CDR
  source 1..36: mol_type = other RNA

SEQ ID NO: 45404 - RNA, 36 nt, synthetic construct; identical to SEQ ID NO: 30120
  misc_feature 1..36: note = derived and/or modified sequence opt5 from anti-influenza_CDR
  source 1..36: mol_type = other RNA

SEQ ID NO: 45405 - RNA, 36 nt, synthetic construct; identical to SEQ ID NO: 30121
  misc_feature 1..36: note = derived and/or modified sequence opt5 from anti-influenza_CDR
  source 1..36: mol_type = other RNA

SEQ ID NO: 45406 - RNA, 36 nt, synthetic construct; identical to SEQ ID NO: 30122
  misc_feature 1..36: note = derived and/or modified sequence opt5 from anti-influenza_CDR
  source 1..36: mol_type = other RNA

SEQ ID NO: 45407 - RNA, 36 nt, synthetic construct
  misc_feature 1..36: note = derived and/or modified sequence opt5 from anti-influenza_CDR
  source 1..36: mol_type = other RNA
ggcgggctgatcggaaccggcagctactattggggg

SEQ ID NO: 45408 - RNA, 36 nt, synthetic construct
  misc_feature 1..36: note = derived and/or modified sequence opt5 from anti-influenza_CDR
  source 1..36: mol_type = other RNA
gccagatacaactggggcatccggtatttcgacttt

SEQ ID NO: 45409 - RNA, 36 nt, synthetic construct; identical to SEQ ID NO: 30125
  misc_feature 1..36: note = derived and/or modified sequence opt5 from anti-influenza_CDR
  source 1..36: mol_type = other RNA

SEQ ID NO: 45410 - RNA, 36 nt, synthetic construct; identical to SEQ ID NO: 30126
  misc_feature 1..36: note = derived and/or modified sequence opt5 from anti-influenza_CDR
  source 1..36: mol_type = other RNA

SEQ ID NO: 45411 - RNA, 39 nt, synthetic construct
  misc_feature 1..39: note = derived and/or modified sequence opt5 from anti-influenza_CDR
  source 1..39: mol_type = other RNA
gccagaggcgggcggtactatgtggactacttcgattat

SEQ ID NO: 45412 - RNA, 39 nt, synthetic construct; identical to SEQ ID NO: 30128
  misc_feature 1..39: note = derived and/or modified sequence opt5 from anti-influenza_CDR
  source 1..39: mol_type = other RNA

SEQ ID NO: 45413 - RNA, 39 nt, synthetic construct; identical to SEQ ID NO: 30129
  misc_feature 1..39: note = derived and/or modified sequence opt5 from anti-influenza_CDR
  source 1..39: mol_type = other RNA

SEQ ID NO: 45414 - RNA, 39 nt, synthetic construct
  misc_feature 1..39: note = derived and/or modified sequence opt5 from anti-influenza_CDR
  source 1..39: mol_type = other RNA
agcggctcctctagcaacatcgggtccaataccgtgaac

SEQ ID NO: 45415 - RNA, 39 nt, synthetic construct
  misc_feature 1..39: note = derived and/or modified sequence opt5 from anti-influenza_CDR
  source 1..39: mol_type = other RNA
gacagcccctactcctctagctggtccttctttgattat

SEQ ID NO: 45416 - RNA, 39 nt, synthetic construct; identical to SEQ ID NO: 30132
  misc_feature 1..39: note = derived and/or modified sequence opt5 from anti-influenza_CDR
  source 1..39: mol_type = other RNA

SEQ ID NO: 45417 - RNA, 39 nt, synthetic construct; identical to SEQ ID NO: 30133
  misc_feature 1..39: note = derived and/or modified sequence opt5 from anti-influenza_CDR
  source 1..39: mol_type = other RNA

SEQ ID NO: 45418 - RNA, 39 nt, synthetic construct
  misc_feature 1..39: note = derived and/or modified sequence opt5 from anti-influenza_CDR
  source 1..39: mol_type = other RNA
tggctgagcatcattaacgccggcgggggagacatcgat

SEQ ID NO: 45419 - RNA, 39 nt, synthetic construct
  misc_feature 1..39: note = derived and/or modified sequence opt5 from anti-influenza_CDR
  source 1..39: mol_type = other RNA
gccgctagctccctgcagtctggcgtgcccagcagattc

SEQ ID NO: 45420 - RNA, 39 nt, synthetic construct; identical to SEQ ID NO: 30136
  misc_feature 1..39: note = derived and/or modified sequence opt5 from anti-influenza_CDR
  source 1..39: mol_type = other RNA

SEQ ID NO: 45421 - RNA, 39 nt, synthetic construct; identical to SEQ ID NO: 30137
  misc_feature 1..39: note = derived and/or modified sequence opt5 from anti-influenza_CDR
  source 1..39: mol_type = other RNA

SEQ ID NO: 45422 - RNA, 39 nt, synthetic construct
  misc_feature 1..39: note = derived and/or modified sequence opt5 from anti-influenza_CDR
  source 1..39: mol_type = other RNA
accggcagcgagtccacaacggggtacggaatggacgtg

SEQ ID NO: 45423 - RNA, 39 nt, synthetic construct; identical to SEQ ID NO: 30139
  misc_feature 1..39: note = derived and/or modified sequence opt5 from anti-influenza_CDR
  source 1..39: mol_type = other RNA

SEQ ID NO: 45424 - RNA, 39 nt, synthetic construct; identical to SEQ ID NO: 30140
  misc_feature 1..39: note = derived and/or modified sequence opt5 from anti-influenza_CDR
  source 1..39: mol_type = other RNA

SEQ ID NO: 45425 - RNA, 39 nt, synthetic construct
  misc_feature 1..39: note = derived and/or modified sequence opt5 from anti-influenza_CDR
  source 1..39: mol_type = other RNA
agcggctccagatctaacgtgggggacaatagcgtctac

SEQ ID NO: 45426 - RNA, 39 nt, synthetic construct
  misc_feature 1..39: note = derived and/or modified sequence opt5 from anti-influenza_CDR
  source 1..39: mol_type = other RNA
agcggctcctctagcaacatcgggaatgactacgtgtcc

SEQ ID NO: 45427 - RNA, 39 nt, synthetic construct
  misc_feature 1..39: note = derived and/or modified sequence opt5 from anti-influenza_CDR
  source 1..39: mol_type = other RNA
ggcgggggaagctacggcgcctatgaggggttcgactac

SEQ ID NO: 45428 - RNA, 39 nt, synthetic construct
  misc_feature 1..39: note = derived and/or modified sequence opt5 from anti-influenza_CDR
  source 1..39: mol_type = other RNA
agcggctcctctagcaacatcgggtccaattacgtgtat

SEQ ID NO: 45429 - RNA, 39 nt, synthetic construct
  misc_feature 1..39: note = derived and/or modified sequence opt5 from anti-influenza_CDR
  source 1..39: mol_type = other RNA
gccagacggcagcaactgtacaagggctattaccaccat

SEQ ID NO: 45430 - RNA, 39 nt, synthetic construct
  misc_feature 1..39: note = derived and/or modified sequence opt5 from anti-influenza_CDR
  source 1..39: mol_type = other RNA
agcggctccacctctaacatcgggtacaatcccgtgagc

SEQ ID NO: 45431 - RNA, 39 nt, synthetic construct; identical to SEQ ID NO: 30147
  misc_feature 1..39: note = derived and/or modified sequence opt5 from anti-influenza_CDR
  source 1..39: mol_type = other RNA

SEQ ID NO: 45432 - RNA, 39 nt, synthetic construct
  misc_feature 1..39: note = derived and/or modified sequence opt5 from anti-influenza_CDR
  source 1..39: mol_type = other RNA
gccagaggccacagcgggtcctaccggctgttcgacttt

SEQ ID NO: 45433 - RNA, 39 nt, synthetic construct
  misc_feature 1..39: note = derived and/or modified sequence opt5 from anti-influenza_CDR
  source 1..39: mol_type = other RNA
gccaagcccctgagaggcagctaccggtatttcgacctc

SEQ ID NO: 45434 - RNA, 39 nt, synthetic construct; identical to SEQ ID NO: 30150
  misc_feature 1..39: note = derived and/or modified sequence opt5 from anti-influenza_CDR
  source 1..39: mol_type = other RNA

SEQ ID NO: 45435 - RNA, 39 nt, synthetic construct; identical to SEQ ID NO: 30151
  misc_feature 1..39: note = derived and/or modified sequence opt5 from anti-influenza_CDR
  source 1..39: mol_type = other RNA

SEQ ID NO: 45436 - RNA, 39 nt, synthetic construct; identical to SEQ ID NO: 30152
  misc_feature 1..39: note = derived and/or modified sequence opt5 from anti-influenza_CDR
  source 1..39: mol_type = other RNA

SEQ ID NO: 45437 - RNA, 39 nt, synthetic construct
  misc_feature 1..39: note = derived and/or modified sequence opt5 from anti-influenza_CDR
  source 1..39: mol_type = other RNA
cagagctcccaatctgtggacagcaacaatcagctgtcc

SEQ ID NO: 45438 - RNA, 39 nt, synthetic construct; identical to SEQ ID NO: 30154
  misc_feature 1..39: note = derived and/or modified sequence opt5 from anti-influenza_CDR
  source 1..39: mol_type = other RNA

SEQ ID NO: 45439 - RNA, 39 nt, synthetic construct
  misc_feature 1..39: note = derived and/or modified sequence opt5 from anti-influenza_CDR
  source 1..39: mol_type = other RNA
cagagctcccaatctgtgtacaacaataacagactgagc

SEQ ID NO: 45440 - RNA, 39 nt, synthetic construct; identical to SEQ ID NO: 30156
  misc_feature 1..39: note = derived and/or modified sequence opt5 from anti-influenza_CDR
  source 1..39: mol_type = other RNA

SEQ ID NO: 45441 - RNA, 39 nt, synthetic construct
  misc_feature 1..39: note = derived and/or modified sequence opt5 from anti-influenza_CDR
  source 1..39: mol_type = other RNA
ggcgggggattcggctggagccagacctactttgggtat

SEQ ID NO: 45442 - RNA, 42 nt, synthetic construct
  misc_feature 1..42: note = derived and/or modified sequence opt5 from anti-influenza_CDR
  source 1..42: mol_type = other RNA
tggctgggcagaacctactatcggagcaagtggtacaacgac

SEQ ID NO: 45443 - RNA, 42 nt, synthetic construct
  misc_feature 1..42: note = derived and/or modified sequence opt5 from anti-influenza_CDR
  source 1..42: mol_type = other RNA
ggcgggctggtgggaggctacgacgagtatttctttgattac

SEQ ID NO: 45444 - RNA, 42 nt, synthetic construct; identical to SEQ ID NO: 30160
  misc_feature 1..42: note = derived and/or modified sequence opt5 from anti-influenza_CDR
  source 1..42: mol_type = other RNA

SEQ ID NO: 45445 - RNA, 42 nt, synthetic construct
  misc_feature 1..42: note = derived and/or modified sequence opt5 from anti-influenza_CDR
  source 1..42: mol_type = other RNA
accggcagctcctctgacgtgggggccagcaactccgtctct

SEQ ID NO: 45446 - RNA, 42 nt, synthetic construct; identical to SEQ ID NO: 30162
  misc_feature 1..42: note = derived and/or modified sequence opt5 from anti-influenza_CDR
  source 1..42: mol_type = other RNA

SEQ ID NO: 45447 - RNA, 42 nt, synthetic construct
  misc_feature 1..42: note = derived and/or modified sequence opt5 from anti-influenza_CDR
  source 1..42: mol_type = other RNA
accggcagctcctctaacatcgggagcgactacgatgtgcac

SEQ ID NO: 45448 - RNA, 42 nt, synthetic construct; identical to SEQ ID NO: 30164
  misc_feature 1..42: note = derived and/or modified sequence opt5 from anti-influenza_CDR
  source 1..42: mol_type = other RNA

SEQ ID NO: 45449 - RNA, 42 nt, synthetic construct
  misc_feature 1..42: note = derived and/or modified sequence opt5 from anti-influenza_CDR
  source 1..42: mol_type = other RNA
gccagctccaccggcgctgtgacatctagctacttccccaac

SEQ ID NO: 45450 - RNA, 42 nt, synthetic construct
  misc_feature 1..42: note = derived and/or modified sequence opt5 from anti-influenza_CDR
  source 1..42: mol_type = other RNA
accggcgggagctccgacatcggagcctctaacagcgtgtcc

SEQ ID NO: 45451 - RNA, 42 nt, synthetic construct
  misc_feature 1..42: note = derived and/or modified sequence opt5 from anti-influenza_CDR
  source 1..42: mol_type = other RNA
accggcagctcctctgacgtcgggggatacgattatgtgagc

SEQ ID NO: 45452 - RNA, 42 nt, synthetic construct; identical to SEQ ID NO: 30168
  misc_feature 1..42: note = derived and/or modified sequence opt5 from anti-influenza_CDR
  source 1..42: mol_type = other RNA

SEQ ID NO: 45453 - RNA, 42 nt, synthetic construct; identical to SEQ ID NO: 30169
  misc_feature 1..42: note = derived and/or modified sequence opt5 from anti-influenza_CDR
  source 1..42: mol_type = other RNA

SEQ ID NO: 45454 - RNA, 42 nt, synthetic construct; identical to SEQ ID NO: 30170
  misc_feature 1..42: note = derived and/or modified sequence opt5 from anti-influenza_CDR
  source 1..42: mol_type = other RNA

SEQ ID NO: 45455 - RNA, 42 nt, synthetic construct; identical to SEQ ID NO: 30171
  misc_feature 1..42: note = derived and/or modified sequence opt5 from anti-influenza_CDR
  source 1..42: mol_type = other RNA

SEQ ID NO: 45456 - RNA, 42 nt, synthetic construct; identical to SEQ ID NO: 30172
  misc_feature 1..42: note = derived and/or modified sequence opt5 from anti-influenza_CDR
  source 1..42: mol_type = other RNA

SEQ ID NO: 45457 - RNA, 42 nt, synthetic construct; identical to SEQ ID NO: 30173
  misc_feature 1..42: note = derived and/or modified sequence opt5 from anti-influenza_CDR
  source 1..42: mol_type = other RNA

SEQ ID NO: 45458 - RNA, 42 nt, synthetic construct; identical to SEQ ID NO: 30174
  misc_feature 1..42: note = derived and/or modified sequence opt5 from anti-influenza_CDR
  source 1..42: mol_type = other RNA

SEQ ID NO: 45459 - RNA, 42 nt, synthetic construct
  misc_feature 1..42: note = derived and/or modified sequence opt5 from anti-influenza_CDR
  source 1..42: mol_type = other RNA
gccgagagacccaaggtgcggggccaggctgggcgcatgaac

SEQ ID NO: 45460 - RNA, 42 nt, synthetic construct
  misc_feature 1..42: note = derived and/or modified sequence opt5 from anti-influenza_CDR
  source 1..42: mol_type = other RNA
ggcagcagaccctgggtgcgcggggtctcctctcggatcagc

SEQ ID NO: 45461 - RNA, 42 nt, synthetic construct
  misc_feature 1..42: note = derived and/or modified sequence opt5 from anti-influenza_CDR
  source 1..42: mol_type = other RNA
atctggggcgtggccgctcccgggaccgccgcggctcagatt

SEQ ID NO: 45462 - RNA, 42 nt, synthetic construct; identical to SEQ ID NO: 30178
  misc_feature 1..42: note = derived and/or modified sequence opt5 from anti-influenza_CDR
  source 1..42: mol_type = other RNA

SEQ ID NO: 45463 - RNA, 42 nt, synthetic construct
  misc_feature 1..42: note = derived and/or modified sequence opt5 from anti-influenza_CDR
  source 1..42: mol_type = other RNA
gccagaggccccgagggggtgtggggacggagcatcgactcc

SEQ ID NO: 45464 - RNA, 42 nt, synthetic construct
  misc_feature 1..42: note = derived and/or modified sequence opt5 from anti-influenza_CDR
  source 1..42: mol_type = other RNA
gccagagaccccgatacccctttcgtgcgggcttttgacagc

SEQ ID NO: 45465 - RNA, 42 nt, synthetic construct
  misc_feature 1..42: note = derived and/or modified sequence opt5 from anti-influenza_CDR
  source 1..42: mol_type = other RNA
accggcagcacatccgacatcgggtcttacaactatgtgagc

SEQ ID NO: 45466 - RNA, 42 nt, synthetic construct; identical to SEQ ID NO: 30182
  misc_feature 1..42: note = derived and/or modified sequence opt5 from anti-influenza_CDR
  source 1..42: mol_type = other RNA

SEQ ID NO: 45467 - RNA, 42 nt, synthetic construct; identical to SEQ ID NO: 30183
  misc_feature 1..42: note = derived and/or modified sequence opt5 from anti-influenza_CDR
  source 1..42: mol_type = other RNA

SEQ ID NO: 45468 - RNA, 42 nt, synthetic construct
  misc_feature 1..42: note = derived and/or modified sequence opt5 from anti-influenza_CDR
  source 1..42: mol_type = other RNA
ggccccgggtacagcggatatcactacggctggttcgacacc

SEQ ID NO: 45469 - RNA, 42 nt, synthetic construct; identical to SEQ ID NO: 30185
  misc_feature 1..42: note = derived and/or modified sequence opt5 from anti-influenza_CDR
  source 1..42: mol_type = other RNA

SEQ ID NO: 45470 - RNA, 45 nt, synthetic construct
  misc_feature 1..45: note = derived and/or modified sequence opt5 from anti-influenza_CDR
  source 1..45: mol_type = other RNA
gccagagctggcaccacactgacgcggttcaactggtttgacccc

SEQ ID NO: 45471 - RNA, 45 nt, synthetic construct
  misc_feature 1..45: note = derived and/or modified sequence opt5 from anti-influenza_CDR
  source 1..45: mol_type = other RNA
gccagagctggcaccacagtgacgcggttcaactggtttgacccc

SEQ ID NO: 45472 - RNA, 45 nt, synthetic construct
  misc_feature 1..45: note = derived and/or modified sequence opt5 from anti-influenza_CDR
  source 1..45: mol_type = other RNA
gccagaggccagcggtactattacgaccgcgatgggatggacgtg

SEQ ID NO: 45473 - RNA, 45 nt, synthetic construct; identical to SEQ ID NO: 30189
  misc_feature 1..45: note = derived and/or modified sequence opt5 from anti-influenza_CDR
  source 1..45: mol_type = other RNA

SEQ ID NO: 45474 - RNA, 45 nt, synthetic construct; identical to SEQ ID NO: 30190
  misc_feature 1..45: note = derived and/or modified sequence opt5 from anti-influenza_CDR
  source 1..45: mol_type = other RNA

SEQ ID NO: 45475 - RNA, 45 nt, synthetic construct; identical to SEQ ID NO: 30191
  misc_feature 1..45: note = derived and/or modified sequence opt5 from anti-influenza_CDR
  source 1..45: mol_type = other RNA

SEQ ID NO: 45476 - RNA, 45 nt, synthetic construct; identical to SEQ ID NO: 30192
  misc_feature 1..45: note = derived and/or modified sequence opt5 from anti-influenza_CDR
  source 1..45: mol_type = other RNA

SEQ ID NO: 45477 - RNA, 45 nt, synthetic construct; identical to SEQ ID NO: 30193
  misc_feature 1..45: note = derived and/or modified sequence opt5 from anti-influenza_CDR
  source 1..45: mol_type = other RNA

SEQ ID NO: 45478 - RNA, 45 nt, synthetic construct; identical to SEQ ID NO: 30194
  misc_feature 1..45: note = derived and/or modified sequence opt5 from anti-influenza_CDR
  source 1..45: mol_type = other RNA

SEQ ID NO: 45479 - RNA, 45 nt, synthetic construct; identical to SEQ ID NO: 30195
  misc_feature 1..45: note = derived and/or modified sequence opt5 from anti-influenza_CDR
  source 1..45: mol_type = other RNA

SEQ ID NO: 45480 - RNA, 45 nt, synthetic construct; identical to SEQ ID NO: 30196
  misc_feature 1..45: note = derived and/or modified sequence opt5 from anti-influenza_CDR
  source 1..45: mol_type = other RNA

SEQ ID NO: 45481 - RNA, 45 nt, synthetic construct; identical to SEQ ID NO: 30197
  misc_feature 1..45: note = derived and/or modified sequence opt5 from anti-influenza_CDR
  source 1..45: mol_type = other RNA

SEQ ID NO: 45482 - RNA, 45 nt, synthetic construct; identical to SEQ ID NO: 30198
  misc_feature 1..45: note = derived and/or modified sequence opt5 from anti-influenza_CDR
  source 1..45: mol_type = other RNA

SEQ ID NO: 45483 - RNA, 45 nt, synthetic construct
  misc_feature 1..45: note = derived and/or modified sequence opt5 from anti-influenza_CDR
  source 1..45: mol_type = other RNA
gccagagctcacaccgccctgacacggttccgctggctcgacccc

SEQ ID NO: 45484 - RNA, 45 nt, synthetic construct; identical to SEQ ID NO: 30200
  misc_feature 1..45: note = derived and/or modified sequence opt5 from anti-influenza_CDR
  source 1..45: mol_type = other RNA

SEQ ID NO: 45485 - RNA, 45 nt, synthetic construct; identical to SEQ ID NO: 30201
  misc_feature 1..45: note = derived and/or modified sequence opt5 from anti-influenza_CDR
  source 1..45: mol_type = other RNA

SEQ ID NO: 45486 - RNA, 45 nt, synthetic construct
  misc_feature 1..45: note = derived and/or modified sequence opt5 from anti-influenza_CDR
  source 1..45: mol_type = other RNA
gccagacggggcgggggatggcagtactattacggcatggacgtg

SEQ ID NO: 45487 - RNA, 48 nt, synthetic construct; identical to SEQ ID NO: 30203
  misc_feature 1..48: note = derived and/or modified sequence opt5 from anti-influenza_CDR
  source 1..48: mol_type = other RNA

SEQ ID NO: 45488 - RNA, 48 nt, synthetic construct
  misc_feature 1..48: note = derived and/or modified sequence opt5 from anti-influenza_CDR
  source 1..48: mol_type = other RNA
ggcgggcacatcaccgtgttcggactgaacattgacgcctacgatatc

SEQ ID NO: 45489 - RNA, 48 nt, synthetic construct
  misc_feature 1..48: note = derived and/or modified sequence opt5 from anti-influenza_CDR
  source 1..48: mol_type = other RNA
ggcgggcacatcaccgagttcggactgaacattgacgcctacgatatc

SEQ ID NO: 45490 - RNA, 48 nt, synthetic construct
  misc_feature 1..48: note = derived and/or modified sequence opt5 from anti-influenza_CDR
  source 1..48: mol_type = other RNA
ggcgggcacatcaccgtgttcggagtcaacattgacgcctttgatatc

SEQ ID NO: 45491 - RNA, 48 nt, synthetic construct; identical to SEQ ID NO: 30207
  misc_feature 1..48: note = derived and/or modified sequence opt5 from anti-influenza_CDR
  source 1..48: mol_type = other RNA

SEQ ID NO: 45492 - RNA, 48 nt, synthetic construct; identical to SEQ ID NO: 30208
  misc_feature 1..48: note = derived and/or modified sequence opt5 from anti-influenza_CDR
  source 1..48: mol_type = other RNA

SEQ ID NO: 45493 - RNA, 48 nt, synthetic construct; identical to SEQ ID NO: 30209
  misc_feature 1..48: note = derived and/or modified sequence opt5 from anti-influenza_CDR
  source 1..48: mol_type = other RNA

SEQ ID NO: 45494 - RNA, 48 nt, synthetic construct
  misc_feature 1..48: note = derived and/or modified sequence opt5 from anti-influenza_CDR
  source 1..48: mol_type = other RNA
gccagagctggcgtgaagatcttcgggctgattgtcggagccctcgac

SEQ ID NO: 45495 - RNA, 48 nt, synthetic construct; identical to SEQ ID NO: 30211
  misc_feature 1..48: note = derived and/or modified sequence opt5 from anti-influenza_CDR
  source 1..48: mol_type = other RNA

SEQ ID NO: 45496 - RNA, 48 nt, synthetic construct; identical to SEQ ID NO: 30212
  misc_feature 1..48: note = derived and/or modified sequence opt5 from anti-influenza_CDR
  source 1..48: mol_type = other RNA

SEQ ID NO: 45497 - RNA, 48 nt, synthetic construct; identical to SEQ ID NO: 30213
  misc_feature 1..48: note = derived and/or modified sequence opt5 from anti-influenza_CDR
  source 1..48: mol_type = other RNA

SEQ ID NO: 45498 - RNA, 48 nt, synthetic construct; identical to SEQ ID NO: 30214
  misc_feature 1..48: note = derived and/or modified sequence opt5 from anti-influenza_CDR
  source 1..48: mol_type = other RNA

SEQ ID NO: 45499 - RNA, 48 nt, synthetic construct; identical to SEQ ID NO: 30215
  misc_feature 1..48: note = derived and/or modified sequence opt5 from anti-influenza_CDR
  source 1..48: mol_type = other RNA

SEQ ID NO: 45500 - RNA, 48 nt, synthetic construct
  misc_feature 1..48: note = derived and/or modified sequence opt5 from anti-influenza_CDR
  source 1..48: mol_type = other RNA
ctgatctactgggacgatgacaagagatatagcccctccctcaaacgg

SEQ ID NO: 45501 - RNA, 48 nt, synthetic construct; identical to SEQ ID NO: 30217
  misc_feature 1..48: note = derived and/or modified sequence opt5 from anti-influenza_CDR
  source 1..48: mol_type = other RNA

SEQ ID NO: 45502 - RNA, 48 nt, synthetic construct
  misc_feature 1..48: note = derived and/or modified sequence opt5 from anti-influenza_CDR
  source 1..48: mol_type = other RNA
gagatcagccacggcgggagcaccaactacaatccctctctgaagtcc

SEQ ID NO: 45503 - RNA, 48 nt, synthetic construct; identical to SEQ ID NO: 30219
  misc_feature 1..48: note = derived and/or modified sequence opt5 from anti-influenza_CDR
  source 1..48: mol_type = other RNA

SEQ ID NO: 45504 - RNA, 48 nt, synthetic construct
  misc_feature 1..48: note = derived and/or modified sequence opt5 from anti-influenza_CDR
  source 1..48: mol_type = other RNA
ctgatcagctgggacgatgagaagcactactccccctctctccagagc

SEQ ID NO: 45505 - RNA, 48 nt, synthetic construct; identical to SEQ ID NO: 30221
  misc_feature 1..48: note = derived and/or modified sequence opt5 from anti-influenza_CDR
  source 1..48: mol_type = other RNA

SEQ ID NO: 45506 - RNA, 48 nt, synthetic construct
  misc_feature 1..48: note = derived and/or modified sequence opt5 from anti-influenza_CDR
  source 1..48: mol_type = other RNA
tacatctatcacagcggcagcaccaactacaatccctctctgaagtcc

SEQ ID NO: 45507 - RNA, 48 nt, synthetic construct; identical to SEQ ID NO: 30223
  misc_feature 1..48: note = derived and/or modified sequence opt5 from anti-influenza_CDR
  source 1..48: mol_type = other RNA

SEQ ID NO: 45508 - RNA, 48 nt, synthetic construct
  misc_feature 1..48: note = derived and/or modified sequence opt5 from anti-influenza_CDR
  source 1..48: mol_type = other RNA
tacatcagctattccggctctaccaagtacaaccccagcctgagatcc

SEQ ID NO: 45509 - RNA, 48 nt, synthetic construct; identical to SEQ ID NO: 30225
  misc_feature 1..48: note = derived and/or modified sequence opt5 from anti-influenza_CDR
  source 1..48: mol_type = other RNA

SEQ ID NO: 45510 - RNA, 48 nt, synthetic construct; identical to SEQ ID NO: 30226
  misc_feature 1..48: note = derived and/or modified sequence opt5 from anti-influenza_CDR
  source 1..48: mol_type = other RNA

SEQ ID NO: 45511 - RNA, 48 nt, synthetic construct
  misc_feature 1..48: note = derived and/or modified sequence opt5 from anti-influenza_CDR
  source 1..48: mol_type = other RNA
ttcatgtactatagcgccagcacctactataacccctctctgaagtcc

SEQ ID NO: 45512 - RNA, 48 nt, synthetic construct
  misc_feature 1..48: note = derived and/or modified sequence opt5 from anti-influenza_CDR
  source 1..48: mol_type = other RNA
tacgtgtattacagcggcagcaccacatataacccctctctgaagtcc

SEQ ID NO: 45513 - RNA, 48 nt, synthetic construct; identical to SEQ ID NO: 30229
  misc_feature 1..48: note = derived and/or modified sequence opt5 from anti-influenza_CDR
  source 1..48: mol_type = other RNA

SEQ ID NO: 45514 - RNA, 48 nt, synthetic construct; identical to SEQ ID NO: 30230
  misc_feature 1..48: note = derived and/or modified sequence opt5 from anti-influenza_CDR
  source 1..48: mol_type = other RNA

SEQ ID NO: 45515 - RNA, 48 nt, synthetic construct; identical to SEQ ID NO: 30231
  misc_feature 1..48: note = derived and/or modified sequence opt5 from anti-influenza_CDR
  source 1..48: mol_type = other RNA

SEQ ID NO: 45516 - RNA, 48 nt, synthetic construct; identical to SEQ ID NO: 30232
  misc_feature 1..48: note = derived and/or modified sequence opt5 from anti-influenza_CDR
  source 1..48: mol_type = other RNA

SEQ ID NO: 45517 - RNA, 48 nt, synthetic construct; identical to SEQ ID NO: 30233
  misc_feature 1..48: note = derived and/or modified sequence opt5 from anti-influenza_CDR
  source 1..48: mol_type = other RNA

SEQ ID NO: 45518 - RNA, 48 nt, synthetic construct; identical to SEQ ID NO: 30234
  misc_feature 1..48: note = derived and/or modified sequence opt5 from anti-influenza_CDR
  source 1..48: mol_type = other RNA

SEQ ID NO: 45519 - RNA, 48 nt, synthetic construct
  misc_feature 1..48: note = derived and/or modified sequence opt5 from anti-influenza_CDR
  source 1..48: mol_type = other RNA
tacgtgtataacagaggcagcaccaagtactccccctctctgaaaagc

SEQ ID NO: 45520 - RNA, 48 nt, synthetic construct; identical to SEQ ID NO: 30236
  misc_feature 1..48: note = derived and/or modified sequence opt5 from anti-influenza_CDR
  source 1..48: mol_type = other RNA

SEQ ID NO: 45521 - RNA, 48 nt, synthetic construct
  misc_feature 1..48: note = derived and/or modified sequence opt5 from anti-influenza_CDR
  source 1..48: mol_type = other RNA
tacctgtattacagcggctccaccaagtataacccctctctcaaaagc

SEQ ID NO: 45522 - RNA, 48 nt, synthetic construct; identical to SEQ ID NO: 30238
  misc_feature 1..48: note = derived and/or modified sequence opt5 from anti-influenza_CDR
  source 1..48: mol_type = other RNA

SEQ ID NO: 45523 - RNA, 48 nt, synthetic construct
  misc_feature 1..48: note = derived and/or modified sequence opt5 from anti-influenza_CDR
  source 1..48: mol_type = other RNA
cacatcttcgacagcggcagcacctactataacccctctctgaagtcc

SEQ ID NO: 45524 - RNA, 48 nt, synthetic construct; identical to SEQ ID NO: 30240
  misc_feature 1..48: note = derived and/or modified sequence opt5 from anti-influenza_CDR
  source 1..48: mol_type = other RNA

SEQ ID NO: 45525 - RNA, 48 nt, synthetic construct; identical to SEQ ID NO: 30241
  misc_feature 1..48: note = derived and/or modified sequence opt5 from anti-influenza_CDR
  source 1..48: mol_type = other RNA

SEQ ID NO: 45526 - RNA, 48 nt, synthetic construct
  misc_feature 1..48: note = derived and/or modified sequence opt5 from anti-influenza_CDR
  source 1..48: mol_type = other RNA
agaagctcccagtctctgctccacagcaacggctacaattatctggac

SEQ ID NO: 45527 - RNA, 48 nt, synthetic construct
  misc_feature 1..48: note = derived and/or modified sequence opt5 from anti-influenza_CDR
  source 1..48: mol_type = other RNA
accatctaccacagcggcagcacatattacaacccctctctgaagtcc

SEQ ID NO: 45528 - RNA, 48 nt, synthetic construct
  misc_feature 1..48: note = derived and/or modified sequence opt5 from anti-influenza_CDR
  source 1..48: mol_type = other RNA
agaagctcccagtctctgctccacagcaacggccatatctacttcgac

SEQ ID NO: 45529 - RNA, 48 nt, synthetic construct
  misc_feature 1..48: note = derived and/or modified sequence opt5 from anti-influenza_CDR
  source 1..48: mol_type = other RNA
atctggggcgtggccgctcccagcaccgcctccgcgcagacatctctg

SEQ ID NO: 45530 - RNA, 48 nt, synthetic construct
  misc_feature 1..48: note = derived and/or modified sequence opt5 from anti-influenza_CDR
  source 1..48: mol_type = other RNA
agaagctcccagtctctgctctacaccgacggcttcacatatctgagc

SEQ ID NO: 45531 - RNA, 48 nt, synthetic construct
  misc_feature 1..48: note = derived and/or modified sequence opt5 from anti-influenza_CDR
  source 1..48: mol_type = other RNA
gccaagcccagactggactacctcgattatttccacgctgccgacagc

SEQ ID NO: 45532 - RNA, 48 nt, synthetic construct; identical to SEQ ID NO: 30248
  misc_feature 1..48: note = derived and/or modified sequence opt5 from anti-influenza_CDR
  source 1..48: mol_type = other RNA

SEQ ID NO: 45533 - RNA, 48 nt, synthetic construct
  misc_feature 1..48: note = derived and/or modified sequence opt5 from anti-influenza_CDR
  source 1..48: mol_type = other RNA
gccatcgctggcagcgggtccgccgactacgcgtcttgggctaaggga

SEQ ID NO: 45534 - RNA, 48 nt, synthetic construct
  misc_feature 1..48: note = derived and/or modified sequence opt5 from anti-influenza_CDR
  source 1..48: mol_type = other RNA
gccatcgctggcagcgggtccgccgactacgcgtcttgggctaagagc

SEQ ID NO: 45535 - RNA, 48 nt, synthetic construct
  misc_feature 1..48: note = derived and/or modified sequence opt5 from anti-influenza_CDR
  source 1..48: mol_type = other RNA
gccatcggcgggggaggcagcgctgactacgcctcctgggcgaagtct

SEQ ID NO: 45536 - RNA, 48 nt, synthetic construct
  misc_feature 1..48: note = derived and/or modified sequence opt5 from anti-influenza_CDR
  source 1..48: mol_type = other RNA
agaagctcccagtctctgctccggagcaacggctacaattatctggac

SEQ ID NO: 45537 - RNA, 48 nt, synthetic construct; identical to SEQ ID NO: 30253
  misc_feature 1..48: note = derived and/or modified sequence opt5 from anti-influenza_CDR
  source 1..48: mol_type = other RNA

SEQ ID NO: 45538 - RNA, 51 nt, synthetic construct; identical to SEQ ID NO: 30254
  misc_feature 1..51: note = derived and/or modified sequence opt5 from anti-influenza_CDR
  source 1..51: mol_type = other RNA

SEQ ID NO: 45539 - RNA, 51 nt, synthetic construct
  misc_feature 1..51: note = derived and/or modified sequence opt5 from anti-influenza_CDR
  source 1..51: mol_type = other RNA
gccagagctgagaacctgctcagcccctacctggccgaaggcttcgaccct

SEQ ID NO: 45540 - RNA, 51 nt, synthetic construct; identical to SEQ ID NO: 30256
  misc_feature 1..51: note = derived and/or modified sequence opt5 from anti-influenza_CDR
  source 1..51: mol_type = other RNA

SEQ ID NO: 45541 - RNA, 51 nt, synthetic construct
  misc_feature 1..51: note = derived and/or modified sequence opt5 from anti-influenza_CDR
  source 1..51: mol_type = other RNA
ggcaccatccccctgctcgggacaacgaactacgcccagaagttccaagga

SEQ ID NO: 45542 - RNA, 51 nt, synthetic construct
  misc_feature 1..51: note = derived and/or modified sequence opt5 from anti-influenza_CDR
  source 1..51: mol_type = other RNA
ggcatcattgccgtgttcaacaccgctaattacgcccagaagtttcaaggg

SEQ ID NO: 45543 - RNA, 51 nt, synthetic construct; identical to SEQ ID NO: 30259
  misc_feature 1..51: note = derived and/or modified sequence opt5 from anti-influenza_CDR
  source 1..51: mol_type = other RNA

SEQ ID NO: 45544 - RNA, 51 nt, synthetic construct; identical to SEQ ID NO: 30260
  misc_feature 1..51: note = derived and/or modified sequence opt5 from anti-influenza_CDR
  source 1..51: mol_type = other RNA

SEQ ID NO: 45545 - RNA, 51 nt, synthetic construct; identical to SEQ ID NO: 30261
  misc_feature 1..51: note = derived and/or modified sequence opt5 from anti-influenza_CDR
  source 1..51: mol_type = other RNA

SEQ ID NO: 45546 - RNA, 51 nt, synthetic construct
  misc_feature 1..51: note = derived and/or modified sequence opt5 from anti-influenza_CDR
  source 1..51: mol_type = other RNA
ggcatcattcccctgatcaacgcccctaattacgctccgaagttccagggg

SEQ ID NO: 45547 - RNA, 51 nt, synthetic construct; identical to SEQ ID NO: 30263
  misc_feature 1..51: note = derived and/or modified sequence opt5 from anti-influenza_CDR
  source 1..51: mol_type = other RNA

SEQ ID NO: 45548 - RNA, 51 nt, synthetic construct
  misc_feature 1..51: note = derived and/or modified sequence opt5 from anti-influenza_CDR
  source 1..51: mol_type = other RNA
ggcatcattcccctgttcggggccgctaagtacgcccagaaatttcaagga

SEQ ID NO: 45549 - RNA, 51 nt, synthetic construct
  misc_feature 1..51: note = derived and/or modified sequence opt5 from anti-influenza_CDR
  source 1..51: mol_type = other RNA
aagagctcccagagagtgctgtactctagcaacaataaaaactatctcgcc

SEQ ID NO: 45550 - RNA, 51 nt, synthetic construct; identical to SEQ ID NO: 30266
  misc_feature 1..51: note = derived and/or modified sequence opt5 from anti-influenza_CDR
  source 1..51: mol_type = other RNA

SEQ ID NO: 45551 - RNA, 51 nt, synthetic construct; identical to SEQ ID NO: 30267
  misc_feature 1..51: note = derived and/or modified sequence opt5 from anti-influenza_CDR
  source 1..51: mol_type = other RNA

SEQ ID NO: 45552 - RNA, 51 nt, synthetic construct; identical to SEQ ID NO: 30268
  misc_feature 1..51: note = derived and/or modified sequence opt5 from anti-influenza_CDR
  source 1..51: mol_type = other RNA

SEQ ID NO: 45553 - RNA, 51 nt, synthetic construct
  misc_feature 1..51: note = derived and/or modified sequence opt5 from anti-influenza_CDR
  source 1..51: mol_type = other RNA
gtggagggcagctacagagacttctggaacaatcagaaccggtttgatccc

SEQ ID NO: 45554 - RNA, 51 nt, synthetic construct; identical to SEQ ID NO: 30270
  misc_feature 1..51: note = derived and/or modified sequence opt5 from anti-influenza_CDR
  source 1..51: mol_type = other RNA

SEQ ID NO: 45555 - RNA, 51 nt, synthetic construct
  misc_feature 1..51: note = derived and/or modified sequence opt5 from anti-influenza_CDR
  source 1..51: mol_type = other RNA
aagagctcccagtctgtgctgtacagctccaacaataaatctcacctcgcc

SEQ ID NO: 45556 - RNA, 51 nt, synthetic construct; identical to SEQ ID NO: 30272
  misc_feature 1..51: note = derived and/or modified sequence opt5 from anti-influenza_CDR
  source 1..51: mol_type = other RNA

SEQ ID NO: 45557 - RNA, 51 nt, synthetic construct
  misc_feature 1..51: note = derived and/or modified sequence opt5 from anti-influenza_CDR
  source 1..51: mol_type = other RNA
ggcatcattcccgtgttccctaccccgaactacgcccagatgtttcaaggg

SEQ ID NO: 45558 - RNA, 51 nt, synthetic construct; identical to SEQ ID NO: 30274
  misc_feature 1..51: note = derived and/or modified sequence opt5 from anti-influenza_CDR
  source 1..51: mol_type = other RNA

SEQ ID NO: 45559 - RNA, 51 nt, synthetic construct; identical to SEQ ID NO: 30275
  misc_feature 1..51: note = derived and/or modified sequence opt5 from anti-influenza_CDR
  source 1..51: mol_type = other RNA

SEQ ID NO: 45560 - RNA, 51 nt, synthetic construct
  misc_feature 1..51: note = derived and/or modified sequence opt5 from anti-influenza_CDR
  source 1..51: mol_type = other RNA
agaagctcccagtctatcttccacaacagcaataacgagaattacctggcc

SEQ ID NO: 45561 - RNA, 51 nt, synthetic construct; identical to SEQ ID NO: 30277
  misc_feature 1..51: note = derived and/or modified sequence opt5 from anti-influenza_CDR
  source 1..51: mol_type = other RNA

SEQ ID NO: 45562 - RNA, 51 nt, synthetic construct; identical to SEQ ID NO: 30278
  misc_feature 1..51: note = derived and/or modified sequence opt5 from anti-influenza_CDR
  source 1..51: mol_type = other RNA

SEQ ID NO: 45563 - RNA, 51 nt, synthetic construct; identical to SEQ ID NO: 30279
  misc_feature 1..51: note = derived and/or modified sequence opt5 from anti-influenza_CDR
  source 1..51: mol_type = other RNA

SEQ ID NO: 45564 - RNA, 51 nt, synthetic construct
  misc_feature 1..51: note = derived and/or modified sequence opt5 from anti-influenza_CDR
  source 1..51: mol_type = other RNA
aacatcaagcaggacggcagagagaaatactatgtggatagcctgcggggg

SEQ ID NO: 45565 - RNA, 51 nt, synthetic construct
  misc_feature 1..51: note = derived and/or modified sequence opt5 from anti-influenza_CDR
  source 1..51: mol_type = other RNA
ggcatcattgccatcttcgggacccccaagtacgctcagaaatttcaagga

SEQ ID NO: 45566 - RNA, 51 nt, synthetic construct
  misc_feature 1..51: note = derived and/or modified sequence opt5 from anti-influenza_CDR
  source 1..51: mol_type = other RNA
aagagctcccagtctatcctgaacagctccaataacaaaaattacctcgcc

SEQ ID NO: 45567 - RNA, 51 nt, synthetic construct; identical to SEQ ID NO: 30283
  misc_feature 1..51: note = derived and/or modified sequence opt5 from anti-influenza_CDR
  source 1..51: mol_type = other RNA

SEQ ID NO: 45568 - RNA, 51 nt, synthetic construct; identical to SEQ ID NO: 30284
  misc_feature 1..51: note = derived and/or modified sequence opt5 from anti-influenza_CDR
  source 1..51: mol_type = other RNA

SEQ ID NO: 45569 - RNA, 51 nt, synthetic construct
  misc_feature 1..51: note = derived and/or modified sequence opt5 from anti-influenza_CDR
  source 1..51: mol_type = other RNA
ggcatcattgccatcttccacacccccaagtacgctcagaaatttcaaggg

SEQ ID NO: 45570 - RNA, 51 nt, synthetic construct
  misc_feature 1..51: note = derived and/or modified sequence opt5 from anti-influenza_CDR
  source 1..51: mol_type = other RNA
ggcatcagccccatgttcgggaccacaacgtacgcccagaagtttcaagga

SEQ ID NO: 45571 - RNA, 51 nt, synthetic construct
  misc_feature 1..51: note = derived and/or modified sequence opt5 from anti-influenza_CDR
  source 1..51: mol_type = other RNA
aagagctcccagtctgtgctgtacagctccaacaataaaaactatctcgcc

SEQ ID NO: 45572 - RNA, 51 nt, synthetic construct
  misc_feature 1..51: note = derived and/or modified sequence opt5 from anti-influenza_CDR
  source 1..51: mol_type = other RNA
ggcatcattcccatcttcgggaccacaaagtacgcccctaaatttcaggga

SEQ ID NO: 45573 - RNA, 51 nt, synthetic construct; identical to SEQ ID NO: 30289
  misc_feature 1..51: note = derived and/or modified sequence opt5 from anti-influenza_CDR
  source 1..51: mol_type = other RNA

SEQ ID NO: 45574 - RNA, 51 nt, synthetic construct
  misc_feature 1..51: note = derived and/or modified sequence opt5 from anti-influenza_CDR
  source 1..51: mol_type = other RNA
ggcatcatggggatgttcggaaccacaaactacgcccagaagtttcaaggc

SEQ ID NO: 45575 - RNA, 51 nt, synthetic construct
  misc_feature 1..51: note = derived and/or modified sequence opt5 from anti-influenza_CDR
  source 1..51: mol_type = other RNA
ggcatcattgggatgttcggaagcaccaactacgcccagaattttcaaggc

SEQ ID NO: 45576 - RNA, 51 nt, synthetic construct; identical to SEQ ID NO: 30292
  misc_feature 1..51: note = derived and/or modified sequence opt5 from anti-influenza_CDR
  source 1..51: mol_type = other RNA

SEQ ID NO: 45577 - RNA, 51 nt, synthetic construct
  misc_feature 1..51: note = derived and/or modified sequence opt5 from anti-influenza_CDR
  source 1..51: mol_type = other RNA
gccatcagctcctctggcgacagcacctactatgctgattccgtgaagggg

SEQ ID NO: 45578 - RNA, 51 nt, synthetic construct
  misc_feature 1..51: note = derived and/or modified sequence opt5 from anti-influenza_CDR
  source 1..51: mol_type = other RNA
agcatctcctctagctcctcttacatttattacgtggacagcgtcaagggc

SEQ ID NO: 45579 - RNA, 51 nt, synthetic construct; identical to SEQ ID NO: 30295
  misc_feature 1..51: note = derived and/or modified sequence opt5 from anti-influenza_CDR
  source 1..51: mol_type = other RNA

SEQ ID NO: 45580 - RNA, 51 nt, synthetic construct; identical to SEQ ID NO: 30296
  misc_feature 1..51: note = derived and/or modified sequence opt5 from anti-influenza_CDR
  source 1..51: mol_type = other RNA

SEQ ID NO: 45581 - RNA, 51 nt, synthetic construct
  misc_feature 1..51: note = derived and/or modified sequence opt5 from anti-influenza_CDR
  source 1..51: mol_type = other RNA
ggcatcattgccatcttcgggaccgctaactacgcccagaagtttcaagga

SEQ ID NO: 45582 - RNA, 51 nt, synthetic construct
  misc_feature 1..51: note = derived and/or modified sequence opt5 from anti-influenza_CDR
  source 1..51: mol_type = other RNA
ggcatcattcccatcttcgggaccacaaactacgcccagaagtttcaagga

SEQ ID NO: 45583 - RNA, 51 nt, synthetic construct; identical to SEQ ID NO: 30299
  misc_feature 1..51: note = derived and/or modified sequence opt5 from anti-influenza_CDR
  source 1..51: mol_type = other RNA

SEQ ID NO: 45584 - RNA, 51 nt, synthetic construct
  misc_feature 1..51: note = derived and/or modified sequence opt5 from anti-influenza_CDR
  source 1..51: mol_type = other RNA
ggcatcattgggatgttcggaaccgccaactacgctcagaagtttcaaggc

SEQ ID NO: 45585 - RNA, 51 nt, synthetic construct; identical to SEQ ID NO: 30301
  misc_feature 1..51: note = derived and/or modified sequence opt5 from anti-influenza_CDR
  source 1..51: mol_type = other RNA

SEQ ID NO: 45586 - RNA, 51 nt, synthetic construct
  misc_feature 1..51: note = derived and/or modified sequence opt5 from anti-influenza_CDR
  source 1..51: mol_type = other RNA
ggcatcctgggggtgttcggaagcccctcctacgcccagaagtttcaaggc

SEQ ID NO: 45587 - RNA, 51 nt, synthetic construct
  misc_feature 1..51: note = derived and/or modified sequence opt5 from anti-influenza_CDR
  source 1..51: mol_type = other RNA
ggcatcttcgggatgtttggaaccgccaactacgctcagaagttccaaggc

SEQ ID NO: 45588 - RNA, 51 nt, synthetic construct; identical to SEQ ID NO: 30304
  misc_feature 1..51: note = derived and/or modified sequence opt5 from anti-influenza_CDR
  source 1..51: mol_type = other RNA

SEQ ID NO: 45589 - RNA, 51 nt, synthetic construct; identical to SEQ ID NO: 30305
  misc_feature 1..51: note = derived and/or modified sequence opt5 from anti-influenza_CDR
  source 1..51: mol_type = other RNA

SEQ ID NO: 45590 - RNA, 51 nt, synthetic construct
  misc_feature 1..51: note = derived and/or modified sequence opt5 from anti-influenza_CDR
  source 1..51: mol_type = other RNA
ggcatcagcgggtccggagagtctacctactatgccgacagcgtgaagggc

SEQ ID NO: 45591 - RNA, 51 nt, synthetic construct; identical to SEQ ID NO: 30307
  misc_feature 1..51: note = derived and/or modified sequence opt5 from anti-influenza_CDR
  source 1..51: mol_type = other RNA

SEQ ID NO: 45592 - RNA, 51 nt, synthetic construct
  misc_feature 1..51: note = derived and/or modified sequence opt5 from anti-influenza_CDR
  source 1..51: mol_type = other RNA
ggcagcatctcctactctgggagcacctattaccacccctccctgaagtct

SEQ ID NO: 45593 - RNA, 51 nt, synthetic construct
  misc_feature 1..51: note = derived and/or modified sequence opt5 from anti-influenza_CDR
  source 1..51: mol_type = other RNA
accagaggccggcccatcgggcgcaactgggagcctagagacaaggattac

SEQ ID NO: 45594 - RNA, 51 nt, synthetic construct; identical to SEQ ID NO: 30310
  misc_feature 1..51: note = derived and/or modified sequence opt5 from anti-influenza_CDR
  source 1..51: mol_type = other RNA

SEQ ID NO: 45595 - RNA, 51 nt, synthetic construct; identical to SEQ ID NO: 30311
  misc_feature 1..51: note = derived and/or modified sequence opt5 from anti-influenza_CDR
  source 1..51: mol_type = other RNA

SEQ ID NO: 45596 - RNA, 51 nt, synthetic construct; identical to SEQ ID NO: 30312
  misc_feature 1..51: note = derived and/or modified sequence opt5 from anti-influenza_CDR
  source 1..51: mol_type = other RNA

SEQ ID NO: 45597 - RNA, 51 nt, synthetic construct; identical to SEQ ID NO: 30313
  misc_feature 1..51: note = derived and/or modified sequence opt5 from anti-influenza_CDR
  source 1..51: mol_type = other RNA

SEQ ID NO: 45598 - RNA, 51 nt, synthetic construct; identical to SEQ ID NO: 30314
  misc_feature 1..51: note = derived and/or modified sequence opt5 from anti-influenza_CDR
  source 1..51: mol_type = other RNA

SEQ ID NO: 45599 - RNA, 51 nt, synthetic construct; identical to SEQ ID NO: 30315
  misc_feature 1..51: note = derived and/or modified sequence opt5 from anti-influenza_CDR
  source 1..51: mol_type = other RNA

SEQ ID NO: 45600 - RNA, 51 nt, synthetic construct; identical to SEQ ID NO: 30316
  misc_feature 1..51: note = derived and/or modified sequence opt5 from anti-influenza_CDR
  source 1..51: mol_type = other RNA

SEQ ID NO: 45601 - RNA, 51 nt, synthetic construct; identical to SEQ ID NO: 30317
  misc_feature 1..51: note = derived and/or modified sequence opt5 from anti-influenza_CDR
  source 1..51: mol_type = other RNA

SEQ ID NO: 45602 - RNA, 51 nt, synthetic construct
  misc_feature 1..51: note = derived and/or modified sequence opt5 from anti-influenza_CDR
  source 1..51: mol_type = other RNA
atgatgtaccccggcagctccgacaccatctattctcctagcttccagggg

SEQ ID NO: 45603 - RNA, 51 nt, synthetic construct; identical to SEQ ID NO: 30319
  misc_feature 1..51: note = derived and/or modified sequence opt5 from anti-influenza_CDR
  source 1..51: mol_type = other RNA

SEQ ID NO: 45604 - RNA, 51 nt, synthetic construct; identical to SEQ ID NO: 30320
  misc_feature 1..51: note = derived and/or modified sequence opt5 from anti-influenza_CDR
  source 1..51: mol_type = other RNA

SEQ ID NO: 45605 - RNA, 51 nt, synthetic construct; identical to SEQ ID NO: 30321
  misc_feature 1..51: note = derived and/or modified sequence opt5 from anti-influenza_CDR
  source 1..51: mol_type = other RNA

SEQ ID NO: 45606 - RNA, 51 nt, synthetic construct; identical to SEQ ID NO: 30322
  misc_feature 1..51: note = derived and/or modified sequence opt5 from anti-influenza_CDR
  source 1..51: mol_type = other RNA

SEQ ID NO: 45607 - RNA, 51 nt, synthetic construct; identical to SEQ ID NO: 30323
  misc_feature 1..51: note = derived and/or modified sequence opt5 from anti-influenza_CDR
  source 1..51: mol_type = other RNA

SEQ ID NO: 45608 - RNA, 51 nt, synthetic construct; identical to SEQ ID NO: 30324
  misc_feature 1..51: note = derived and/or modified sequence opt5 from anti-influenza_CDR
  source 1..51: mol_type = other RNA

SEQ ID NO: 45609 - RNA, 51 nt, synthetic construct
  misc_feature 1..51: note = derived and/or modified sequence opt5 from anti-influenza_CDR
  source 1..51: mol_type = other RNA
atcattagctgggactccggcagaatcgggtacgccgattctgtgcgggga

SEQ ID NO: 45610 - RNA, 51 nt, synthetic construct
  misc_feature 1..51: note = derived and/or modified sequence opt5 from anti-influenza_CDR
  source 1..51: mol_type = other RNA
cacggcggggtgtactattacggaagcgcctcctctggctggttcgacccc

SEQ ID NO: 45611 - RNA, 54 nt, synthetic construct
  misc_feature 1..54: note = derived and/or modified sequence opt5 from anti-influenza_CDR
  source 1..54: mol_type = other RNA
agaacctactatcggagcaagtggtacaacgactatgccgagtccgtgaaatct

SEQ ID NO: 45612 - RNA, 54 nt, synthetic construct
  misc_feature 1..54: note = derived and/or modified sequence opt5 from anti-influenza_CDR
  source 1..54: mol_type = other RNA
agaacctactatcggagcaagtggtactatgactacgccgagtccgtgaaatct

SEQ ID NO: 45613 - RNA, 54 nt, synthetic construct
  misc_feature 1..54: note = derived and/or modified sequence opt5 from anti-influenza_CDR
  source 1..54: mol_type = other RNA
agaacctactatcggagcaagtggtacaacgactatgccgtgtccgtcaaatct

SEQ ID NO: 45614 - RNA, 54 nt, synthetic construct
  misc_feature 1..54: note = derived and/or modified sequence opt5 from anti-influenza_CDR
  source 1..54: mol_type = other RNA
agaacctactatcggagcaagtggtacaacgactatgccgatttcctgaaacgc

SEQ ID NO: 45615 - RNA, 54 nt, synthetic construct
  misc_feature 1..54: note = derived and/or modified sequence opt5 from anti-influenza_CDR
  source 1..54: mol_type = other RNA
agaacctactatcggagcggctggtacaacgactatgccgagtccgtgaagtct

SEQ ID NO: 45616 - RNA, 54 nt, synthetic construct
  misc_feature 1..54: note = derived and/or modified sequence opt5 from anti-influenza_CDR
  source 1..54: mol_type = other RNA
gccagactgggcgggaacaaggactacggagattatctctggtacttcgacctg

SEQ ID NO: 45617 - RNA, 54 nt, synthetic construct
  misc_feature 1..54: note = derived and/or modified sequence opt5 from anti-influenza_CDR
  source 1..54: mol_type = other RNA
gccaaggacaccgctgatcacggcgactacgtggatctggggttctttgacgcc

SEQ ID NO: 45618 - RNA, 54 nt, synthetic construct
  misc_feature 1..54: note = derived and/or modified sequence opt5 from anti-influenza_CDR
  source 1..54: mol_type = other RNA
gccagaagcggcatcttcgactggtccgctcccctggtggaggcctttgatatt

SEQ ID NO: 45619 - RNA, 54 nt, synthetic construct
  misc_feature 1..54: note = derived and/or modified sequence opt5 from anti-influenza_CDR
  source 1..54: mol_type = other RNA
gccagacacgctagctgctccgcccggtcttgttactggggccccgtggactat

SEQ ID NO: 45620 - RNA, 54 nt, synthetic construct; identical to SEQ ID NO: 30336
  misc_feature 1..54: note = derived and/or modified sequence opt5 from anti-influenza_CDR
  source 1..54: mol_type = other RNA

SEQ ID NO: 45621 - RNA, 54 nt, synthetic construct; identical to SEQ ID NO: 30337
  misc_feature 1..54: note = derived and/or modified sequence opt5 from anti-influenza_CDR
  source 1..54: mol_type = other RNA

SEQ ID NO: 45622 - RNA, 54 nt, synthetic construct; identical to SEQ ID NO: 30338
  misc_feature 1..54: note = derived and/or modified sequence opt5 from anti-influenza_CDR
  source 1..54: mol_type = other RNA

SEQ ID NO: 45623 - RNA, 54 nt, synthetic construct
  misc_feature 1..54: note = derived and/or modified sequence opt5 from anti-influenza_CDR
  source 1..54: mol_type = other RNA
cacgtgagcgtctcccatggcgggagaaccaagtctaaccccagcgttatgtcc

SEQ ID NO: 45624 - RNA, 54 nt, synthetic construct; identical to SEQ ID NO: 30340
  misc_feature 1..54: note = derived and/or modified sequence opt5 from anti-influenza_CDR
  source 1..54: mol_type = other RNA

SEQ ID NO: 45625 - RNA, 54 nt, synthetic construct; identical to SEQ ID NO: 30341
  misc_feature 1..54: note = derived and/or modified sequence opt5 from anti-influenza_CDR
  source 1..54: mol_type = other RNA

SEQ ID NO: 45626 - RNA, 54 nt, synthetic construct
  misc_feature 1..54: note = derived and/or modified sequence opt5 from anti-influenza_CDR
  source 1..54: mol_type = other RNA
gccgtgcccggccctgtcttcgggatctttccgccctggagctacttcgacaac

SEQ ID NO: 45627 - RNA, 54 nt, synthetic construct
  misc_feature 1..54: note = derived and/or modified sequence opt5 from anti-influenza_CDR
  source 1..54: mol_type = other RNA
ggcgggatcattcccatcttcggagccgctaactacgcccagaagtttcaaggc

SEQ ID NO: 45628 - RNA, 54 nt, synthetic construct; identical to SEQ ID NO: 30344
  misc_feature 1..54: note = derived and/or modified sequence opt5 from anti-influenza_CDR
  source 1..54: mol_type = other RNA

SEQ ID NO: 45629 - RNA, 54 nt, synthetic construct
  misc_feature 1..54: note = derived and/or modified sequence opt5 from anti-influenza_CDR
  source 1..54: mol_type = other RNA
ggctggatcaaccccaatttcgggggaacccactacgccagaaagtttcagggc

SEQ ID NO: 45630 - RNA, 54 nt, synthetic construct
  misc_feature 1..54: note = derived and/or modified sequence opt5 from anti-influenza_CDR
  source 1..54: mol_type = other RNA
gtgagatggcgggccgctgccgtcatcatggaccagttctacaagatggatgtt

SEQ ID NO: 45631 - RNA, 54 nt, synthetic construct
  misc_feature 1..54: note = derived and/or modified sequence opt5 from anti-influenza_CDR
  source 1..54: mol_type = other RNA
gccgtgcccggccctatcttcgggatttttccgccctggagctacttcgaccac

SEQ ID NO: 45632 - RNA, 54 nt, synthetic construct
  misc_feature 1..54: note = derived and/or modified sequence opt5 from anti-influenza_CDR
  source 1..54: mol_type = other RNA
gccgctagcaccgccacatccggcacgtactatgcgatgagacccttcgacttt

SEQ ID NO: 45633 - RNA, 57 nt, synthetic construct
  misc_feature 1..57: note = derived and/or modified sequence opt5 from anti-influenza_CDR
  source 1..57: mol_type = other RNA
gccagaggcaagcggcccgggtactgcagcggaggcgtgtgttcctctgactattgg

SEQ ID NO: 45634 - RNA, 57 nt, synthetic construct; identical to SEQ ID NO: 30350
  misc_feature 1..57: note = derived and/or modified sequence opt5 from anti-influenza_CDR
  source 1..57: mol_type = other RNA

SEQ ID NO: 45635 - RNA, 57 nt, synthetic construct
  misc_feature 1..57: note = derived and/or modified sequence opt5 from anti-influenza_CDR
  source 1..57: mol_type = other RNA
ggcagcgggggatacggcgggttcgactattttggaaagctgagaacctgggatttc

SEQ ID NO: 45636 - RNA, 57 nt, synthetic construct
  misc_feature 1..57: note = derived and/or modified sequence opt5 from anti-influenza_CDR
  source 1..57: mol_type = other RNA
ttcatcagaacccggccctggggcgggacagccgacacggctgccagcgtgaaggga

SEQ ID NO: 45637 - RNA, 57 nt, synthetic construct; identical to SEQ ID NO: 30353
  misc_feature 1..57: note = derived and/or modified sequence opt5 from anti-influenza_CDR
  source 1..57: mol_type = other RNA

SEQ ID NO: 45638 - RNA, 57 nt, synthetic construct; identical to SEQ ID NO: 30354
  misc_feature 1..57: note = derived and/or modified sequence opt5 from anti-influenza_CDR
  source 1..57: mol_type = other RNA

SEQ ID NO: 45639 - RNA, 57 nt, synthetic construct
  misc_feature 1..57: note = derived and/or modified sequence opt5 from anti-influenza_CDR
  source 1..57: mol_type = other RNA
gccgtgcccggccctatcttcgggatttttccgccctggagctacttcgaccactgg

SEQ ID NO: 45640 - RNA, 57 nt, synthetic construct
  misc_feature 1..57: note = derived and/or modified sequence opt5 from anti-influenza_CDR
  source 1..57: mol_type = other RNA
gccagagctatgatccagggcgtggtcaccctgtacctccggcccggggactattgg

SEQ ID NO: 45641 - RNA, 57 nt, synthetic construct; identical to SEQ ID NO: 30357
  misc_feature 1..57: note = derived and/or modified sequence opt5 from anti-influenza_CDR
  source 1..57: mol_type = other RNA

SEQ ID NO: 45642 - RNA, 57 nt, synthetic construct; identical to SEQ ID NO: 30358
  misc_feature 1..57: note = derived and/or modified sequence opt5 from anti-influenza_CDR
  source 1..57: mol_type = other RNA

SEQ ID NO: 45643 - RNA, 57 nt, synthetic construct
  misc_feature 1..57: note = derived and/or modified sequence opt5 from anti-influenza_CDR
  source 1..57: mol_type = other RNA
tactgcgccagaggccgggtgaacagcgggtatgactggggacccaatttcgattcc

SEQ ID NO: 45644 - RNA, 57 nt, synthetic construct; identical to SEQ ID NO: 30360
  misc_feature 1..57: note = derived and/or modified sequence opt5 from anti-influenza_CDR
  source 1..57: mol_type = other RNA

SEQ ID NO: 45645 - RNA, 57 nt, synthetic construct
  misc_feature 1..57: note = derived and/or modified sequence opt5 from anti-influenza_CDR
  source 1..57: mol_type = other RNA
agaatcaagagcaacaccgacggcgggacaacggattacgccgctcccgtgaaagga

SEQ ID NO: 45646 - RNA, 57 nt, synthetic construct
  misc_feature 1..57: note = derived and/or modified sequence opt5 from anti-influenza_CDR
  source 1..57: mol_type = other RNA
ctgagactccagggcgaggtggtcgttccccctagccaatccaactggttcgacccg

SEQ ID NO: 45647 - RNA, 60 nt, synthetic construct; identical to SEQ ID NO: 30363
  misc_feature 1..60: note = derived and/or modified sequence opt5 from anti-influenza_CDR
  source 1..60: mol_type = other RNA

SEQ ID NO: 45648 - RNA, 60 nt, synthetic construct
  misc_feature 1..60: note = derived and/or modified sequence opt5 from anti-influenza_CDR
  source 1..60: mol_type = other RNA
gccagagctggcggggacagctccggatactatggcgccctggggcggttctttcagcac

SEQ ID NO: 45649 - RNA, 60 nt, synthetic construct; identical to SEQ ID NO: 30365
  misc_feature 1..60: note = derived and/or modified sequence opt5 from anti-influenza_CDR
  source 1..60: mol_type = other RNA

SEQ ID NO: 45650 - RNA, 60 nt, synthetic construct
  misc_feature 1..60: note = derived and/or modified sequence opt5 from anti-influenza_CDR
  source 1..60: mol_type = other RNA
ggcagcgggtcctctgacagaagcgattacgacccccactattactattacctggatgtg

SEQ ID NO: 45651 - RNA, 60 nt, synthetic construct; identical to SEQ ID NO: 30367
  misc_feature 1..60: note = derived and/or modified sequence opt5 from anti-influenza_CDR
  source 1..60: mol_type = other RNA

SEQ ID NO: 45652 - RNA, 60 nt, synthetic construct
  misc_feature 1..60: note = derived and/or modified sequence opt5 from anti-influenza_CDR
  source 1..60: mol_type = other RNA
ggcaccagccacgtgtccagatacttcgactggctgccccctacaaactggtttgatccg

SEQ ID NO: 45653 - RNA, 60 nt, synthetic construct; identical to SEQ ID NO: 30369
  misc_feature 1..60: note = derived and/or modified sequence opt5 from anti-influenza_CDR
  source 1..60: mol_type = other RNA

SEQ ID NO: 45654 - RNA, 60 nt, synthetic construct
  misc_feature 1..60: note = derived and/or modified sequence opt5 from anti-influenza_CDR
  source 1..60: mol_type = other RNA
ggcaccgaccccgatacagaggtgtactgcagagccgggaactgtgctgccttcgacttt

SEQ ID NO: 45655 - RNA, 60 nt, synthetic construct
  misc_feature 1..60: note = derived and/or modified sequence opt5 from anti-influenza_CDR
  source 1..60: mol_type = other RNA
agaggcgggcacagcttcggatacggctccgggggagacacccattctgagtttgatagc

SEQ ID NO: 45656 - RNA, 60 nt, synthetic construct; identical to SEQ ID NO: 30372
  misc_feature 1..60: note = derived and/or modified sequence opt5 from anti-influenza_CDR
  source 1..60: mol_type = other RNA

SEQ ID NO: 45657 - RNA, 60 nt, synthetic construct
  misc_feature 1..60: note = derived and/or modified sequence opt5 from anti-influenza_CDR
  source 1..60: mol_type = other RNA
gacagcagactgcggtccctcctgtacttcgagtggctttctcagggctattttaacccc

SEQ ID NO: 45658 - RNA, 60 nt, synthetic construct; identical to SEQ ID NO: 30374
  misc_feature 1..60: note = derived and/or modified sequence opt5 from anti-influenza_CDR
  source 1..60: mol_type = other RNA

SEQ ID NO: 45659 - RNA, 63 nt, synthetic construct
  misc_feature 1..63: note = derived and/or modified sequence opt5 from anti-influenza_CDR
  source 1..63: mol_type = other RNA
accacaggcgggacgaccacatgcaccgccgctggatgtggcgggggatgctgtacatgctgt

SEQ ID NO: 45660 - RNA, 63 nt, synthetic construct
  misc_feature 1..63: note = derived and/or modified sequence opt5 from anti-influenza_CDR
  source 1..63: mol_type = other RNA
gccagagctgccgacgagagcgtggaatccctgaccatcaaggcgttccggacaaactaccac

SEQ ID NO: 45661 - RNA, 63 nt, synthetic construct
  misc_feature 1..63: note = derived and/or modified sequence opt5 from anti-influenza_CDR
  source 1..63: mol_type = other RNA
gccagaatgcccctggctaactacgacctcctgaccggcctttatatcggggccttcgatctg

SEQ ID NO: 45662 - RNA, 63 nt, synthetic construct; identical to SEQ ID NO: 30378
  misc_feature 1..63: note = derived and/or modified sequence opt5 from anti-influenza_CDR
  source 1..63: mol_type = other RNA

SEQ ID NO: 45663 - RNA, 63 nt, synthetic construct; identical to SEQ ID NO: 30379
  misc_feature 1..63: note = derived and/or modified sequence opt5 from anti-influenza_CDR
  source 1..63: mol_type = other RNA

SEQ ID NO: 45664 - RNA, 66 nt, synthetic construct
  misc_feature 1..66: note = derived and/or modified sequence opt5 from anti-influenza_CDR
  source 1..66: mol_type = other RNA
gccaaggaccccagactgcggcacctcctgtacttcccttttaccagcatgatctatttcgattac

SEQ ID NO: 45665 - RNA, 66 nt, synthetic construct
  misc_feature 1..66: note = derived and/or modified sequence opt5 from anti-influenza_CDR
  source 1..66: mol_type = other RNA
gccaaggacagccagctgagatccctcctgtacttcgagtggctttctcaaggctattttgatccc

SEQ ID NO: 45666 - RNA, 66 nt, synthetic construct
  misc_feature 1..66: note = derived and/or modified sequence opt5 from anti-influenza_CDR
  source 1..66: mol_type = other RNA
gccaaggacagccagctgagatccctcctgtacttcgagtggctttctcaaggctattttgattac

SEQ ID NO: 45667 - RNA, 66 nt, synthetic construct
  misc_feature 1..66: note = derived and/or modified sequence opt5 from anti-influenza_CDR
  source 1..66: mol_type = other RNA
gccaaggacagccagctgagatccctcctgtacttcgagtggctttctcaaggctattttgaaccc

SEQ ID NO: 45668 - RNA, 66 nt, synthetic construct
  misc_feature 1..66: note = derived and/or modified sequence opt5 from anti-influenza_CDR
  source 1..66: mol_type = other RNA
gccaaggagagacccctgcggctcctgcgctacttcgactggcttagcggcggggctaacgattat

SEQ ID NO: 45669 - RNA, 66 nt, synthetic construct
  misc_feature 1..66: note = derived and/or modified sequence opt5 from anti-influenza_CDR
  source 1..66: mol_type = other RNA
gccagagacgtgcacaactacgatttcctgaccggctatcccctccatctgtacgggatggacgtc

SEQ ID NO: 45670 - RNA, 66 nt, synthetic construct
  misc_feature 1..66: note = derived and/or modified sequence opt5 from anti-influenza_CDR
  source 1..66: mol_type = other RNA
gccagagacggccgggaggggtacttctatggaagcggctccttttacaacctgaaggggctcaat

SEQ ID NO: 45671 - RNA, 66 nt, synthetic construct
  misc_feature 1..66: note = derived and/or modified sequence opt5 from anti-influenza_CDR
  source 1..66: mol_type = other RNA
agcaccgacagaggccacgtgctgcggtacttcgggtggatgctccccggagatgcctttgacgtc

SEQ ID NO: 45672 - RNA, 66 nt, synthetic construct
  misc_feature 1..66: note = derived and/or modified sequence opt5 from anti-influenza_CDR
  source 1..66: mol_type = other RNA
ctgaactactatgacagaagcggctaccactcccccgatgggccttctaataactggttcgacccg

SEQ ID NO: 45673 - RNA, 66 nt, synthetic construct
  misc_feature 1..66: note = derived and/or modified sequence opt5 from anti-influenza_CDR
  source 1..66: mol_type = other RNA
gccagagtgccccgggaccgcctgctcaccctgtactatgagagctccacatacggcttcgattat

SEQ ID NO: 45674 - RNA, 66 nt, synthetic construct
  misc_feature 1..66: note = derived and/or modified sequence opt5 from anti-influenza_CDR
  source 1..66: mol_type = other RNA
gccagaaagtggggccggatgaccgtgttcggggtcgctacagaccagctgtactattttgattac

SEQ ID NO: 45675 - RNA, 66 nt, synthetic construct; identical to SEQ ID NO: 30391
  misc_feature 1..66: note = derived and/or modified sequence opt5 from anti-influenza_CDR
  source 1..66: mol_type = other RNA

SEQ ID NO: 45676 - RNA, 69 nt, synthetic construct
  misc_feature 1..69: note = derived and/or modified sequence opt5 from anti-influenza_CDR
  source 1..69: mol_type = other RNA
gccagaaacctgcccgacatcgctgtggtcaccgccgttcaggatgcgacacctgtgtggttcgacccg

SEQ ID NO: 45677 - RNA, 69 nt, synthetic construct
  misc_feature 1..69: note = derived and/or modified sequence opt5 from anti-influenza_CDR
  source 1..69: mol_type = other RNA
gacggcccctacagcgatgacttcagatccgggtatgccgctcggtaccgctattttggaatggatgtg

SEQ ID NO: 45678 - RNA, 72 nt, synthetic construct
  misc_feature 1..72: note = derived and/or modified sequence opt5 from anti-influenza_CDR
  source 1..72: mol_type = other RNA
ggcagagagctgctccggctgcagcacttccttaccgacagccaatccgaacgcagagattgctttgacccc

SEQ ID NO: 45679 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacgagtggggctgccggtgtaatgactcctctgat

SEQ ID NO: 45680 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgaagaacgagtgggaatgcagatgtaatgactcctctgat

SEQ ID NO: 45681 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtgggaatgccggtgtaatgactcctctgat

SEQ ID NO: 45682 - RNA, 72 nt, synthetic construct; identical to SEQ ID NO: 30398
  misc_feature 1..72: note = derived and/or modified sequence opt5 from anti-influenza_CDR
  source 1..72: mol_type = other RNA

SEQ ID NO: 45683 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagatccgagtggggctgccggtgtaacgactctagcgat

SEQ ID NO: 45684 - RNA, 72 nt, synthetic construct
  misc_feature 1..72: note = derived and/or modified sequence opt5 from anti-influenza_CDR
  source 1..72: mol_type = other RNA
atgagcttcctgcccgaggtggaaacccctatcagaaacgagtggggctgccggtgtaatgactcctctgat

SEQ ID NO: 45685 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtggggctgccggtgtaatgactcctctaac

SEQ ID NO: 45686 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaaggagtggggctgccggtgtaacgactcctctgat

SEQ ID NO: 45687 - RNA, 72 nt, synthetic construct
  misc_feature 1..72: note = derived and/or modified sequence opt5 from anti-influenza_CDR
  source 1..72: mol_type = other RNA
atgagcttcctgaccgaggtggaaacacccatcagaaacgagtggggctgccggtgtaatgactcctctgat

SEQ ID NO: 45688 - RNA, 72 nt, synthetic construct
  misc_feature 1..72: note = derived and/or modified sequence opt5 from anti-influenza_CDR
  source 1..72: mol_type = other RNA
atgagcctgcccaccgaggtggaaacacctatcagatccgagtggggctgccggtgtaacgactctagcgat

SEQ ID NO: 45689 - RNA, 72 nt, synthetic construct
  misc_feature 1..72: note = derived and/or modified sequence opt5 from anti-influenza_CDR
  source 1..72: mol_type = other RNA
atgagcctgctccccgaggtggaaacccctatcagaaacgagtggggctgccggtgtaatgactcctctgat

SEQ ID NO: 45690 - RNA, 72 nt, synthetic construct
  misc_feature 1..72: note = derived and/or modified sequence opt5 from anti-influenza_CDR
  source 1..72: mol_type = other RNA
atgagcctgctccccgaggtggaaacccctatcagaaacggctgggggtgccggtgtaatgactcctctgat

SEQ ID NO: 45691 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggagtgccggtgttccgggtctagcgac

SEQ ID NO: 45692 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtgggaataccggtgcaatgactcctctgat

SEQ ID NO: 45693 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtgggaataccggtgctccgactctagcgat

SEQ ID NO: 45694 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggagtgccggtactccgactctagcgat

SEQ ID NO: 45695 - RNA, 72 nt, synthetic construct
  misc_feature 1..72: note = derived and/or modified sequence opt5 from anti-influenza_CDR
  source 1..72: mol_type = other RNA
atgagcttcctgaccgaggtggaaacactcacgagaaacggctgggagtgccggtgttccgactctagcgat

SEQ ID NO: 45696 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacactgacgagaaacggctgggagtgcaagtgtcgggactcctctgat

SEQ ID NO: 45697 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtggggctgccggtgtaatgactcctctgat

SEQ ID NO: 45698 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagatccgagtggggctgccggtgtaacgactctggggat

SEQ ID NO: 45699 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtgggaatgccggtgtaatggctcctctgac

SEQ ID NO: 45700 - RNA, 72 nt, synthetic construct
  misc_feature 1..72: note = derived and/or modified sequence opt5 from anti-influenza_CDR
  source 1..72: mol_type = other RNA
atgagcctgcccaccgaggtggaaacacctatcagaaacgagtggggctgccggtgtaatgactcctctgat

SEQ ID NO: 45701 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaacgagtggggctgccggtgtaatgggtcctctgac

SEQ ID NO: 45702 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggacacactgacgagaaacggctgggggtgccggtgttccgattctagcgac

SEQ ID NO: 45703 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacactgacgaagaacggctgggggtgcagatgttccgactctagcgat

SEQ ID NO: 45704 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggagtgcaagtgttccgactctagcgat

SEQ ID NO: 45705 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacacacgagaaacggctgggagtgcaagtgttccgactctagcgat

SEQ ID NO: 45706 - RNA, 72 nt, synthetic construct
  misc_feature 1..72: note = derived and/or modified sequence opt5 from anti-influenza_CDR
  source 1..72: mol_type = other RNA
atgagcctgctcaccgaggtgaagacacccacgagaaacggctgggaatgcaaatgttccgactctagcgat

SEQ ID NO: 45707 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacactgacgagaaacggctgggggtgccggtgttccgactctagcgat

SEQ ID NO: 45708 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagagacggctgggagtgcaagtgttccgattctagcgac

SEQ ID NO: 45709 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggggtgccggtgttccgactctagcgat

SEQ ID NO: 45710 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggagtgcaagtgtaatgactcctctgat

SEQ ID NO: 45711 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacactgacgagaaacggctgggagtgcaagtgttccgactctagcgat

SEQ ID NO: 45712 - RNA, 72 nt, synthetic construct; identical to SEQ ID NO: 30428
  misc_feature 1..72: note = derived and/or modified sequence opt5 from anti-influenza_CDR
  source 1..72: mol_type = other RNA

SEQ ID NO: 45713 - RNA, 72 nt, synthetic construct
  misc_feature 1..72: note = derived and/or modified sequence opt5 from anti-influenza_CDR
  source 1..72: mol_type = other RNA
atgagcttcctgaccgaggtggaaacacccatcagaaacgagtggggctgccggtgtaatgggtcctctgac

SEQ ID NO: 45714 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacggctgggagtgccggtgtaatgactcctctgat

SEQ ID NO: 45715 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccatcagaaagggctgggagtgcaactgttccgactctagcgat

SEQ ID NO: 45716 - RNA, 72 nt, synthetic construct
  misc_feature 1..72: note = derived and/or modified sequence opt5 from anti-influenza_CDR
  source 1..72: mol_type = other RNA
atgagcctgctcaccgaggtggaaacacccacgagaaacgagtgggaatgccggtgttccgactctagcgat

SEQ ID NO: 45717 - RNA, 72 nt, synthetic construct
  misc_feature 1..72: note = derived and/or modified sequence opt5 from anti-influenza_CDR
  source 1..72: mol_type = other RNA
atgagcctgctcaccggcgtggagacacacacgagaaacgggtggggatgcaagtgttccgactctagcgat

SEQ ID NO: 45718 - RNA, 72 nt, synthetic construct
  misc_feature 1..72: note = derived and/or modified sequence opt5 from anti-influenza_CDR
  source 1..72: mol_type = other RNA
atgagcctgctccccgaggtggaaacccacacaagaaacggctgggggtgccggtgttccgactctagcgat

SEQ ID NO: 45719 - RNA, 72 nt, synthetic construct
  misc_feature 1..72: note = derived and/or modified sequence opt5 from anti-influenza_CDR
  source 1..72: mol_type = other RNA
accgacggcccctacagcgatgacttcagatccgggtatgccgctcggtaccgctattttggaatggatgtg

SEQ ID NO: 45720 - RNA, 75 nt, synthetic construct
  misc_feature 1..75: note = derived and/or modified sequence opt5 from anti-influenza_CDR
  source 1..75: mol_type = other RNA
gccaagcacatgagcctgcagcaagtggtctccgctggctgggagagagccgacctcgttggggatgcgttcgac

SEQ ID NO: 45721 - RNA, 75 nt, synthetic construct
  misc_feature 1..75: note = derived and/or modified sequence opt5 from anti-influenza_CDR
  source 1..75: mol_type = other RNA
gccaagcacctgagcatgcagcaagtggtctccgctggctgggagagagccgacctcgttggggatgcgttcgac

SEQ ID NO: 45722 - RNA, 75 nt, synthetic construct
  misc_feature 1..75: note = derived and/or modified sequence opt5 from anti-influenza_CDR
  source 1..75: mol_type = other RNA
gccaagcacgctagcctgcagcaagtggtctccgccggctgggagagagcggacctcgttggggatgctttcgac

SEQ ID NO: 45723 - RNA, 75 nt, synthetic construct
  misc_feature 1..75: note = derived and/or modified sequence opt5 from anti-influenza_CDR
  source 1..75: mol_type = other RNA
gccaagcacagctccctgcagcaagtggtctctgctggctgggagagagccgacctcgttggggatgcgttcgac

SEQ ID NO: 45724 - RNA, 75 nt, synthetic construct
  misc_feature 1..75: note = derived and/or modified sequence opt5 from anti-influenza_CDR
  source 1..75: mol_type = other RNA
gccaagcacctgagcctccagcaagtggtctccgctggctgggagagagccgacctggttggggatgcgttcgac

SEQ ID NO: 45725 - RNA, 75 nt, synthetic construct
  misc_feature 1..75: note = derived and/or modified sequence opt5 from anti-influenza_CDR
  source 1..75: mol_type = other RNA
gccaagcacatgagcatgcagcaagtggtctccgctggctgggagagagccgacctggttggggatgcgttcgac

SEQ ID NO: 45726 - RNA, 75 nt, synthetic construct; identical to SEQ ID NO: 30442
  misc_feature 1..75: note = derived and/or modified sequence opt5 from anti-influenza_CDR
  source 1..75: mol_type = other RNA

SEQ ID NO: 45727 - RNA, 75 nt, synthetic construct
  misc_feature 1..75: note = derived and/or modified sequence opt5 from anti-influenza_CDR
  source 1..75: mol_type = other RNA
accacagacggcccctacagcgatgacttcagatccgggtatgccgctcggtaccgctattttggaatggatgtg

SEQ ID NO: 45728 - RNA, 75 nt, synthetic construct
  misc_feature 1..75: note = derived and/or modified sequence opt5 from anti-influenza_CDR
  source 1..75: mol_type = other RNA
accgacggcccctacagcgatgacttcagatccgggtatgccgctcggtaccgctattttggaatggatgtgtgg

SEQ ID NO: 45729 - RNA, 78 nt, synthetic construct
  misc_feature 1..78: note = derived and/or modified sequence opt5 from anti-influenza_CDR
  source 1..78: mol_type = other RNA
gacatccagatgacccaaagcccctcctctctgagcgcctccgtgggcgatagagtcacaattacgtgccggtctagc

SEQ ID NO: 45730 - RNA, 78 nt, synthetic construct
  misc_feature 1..78: note = derived and/or modified sequence opt5 from anti-influenza_CDR
  source 1..78: mol_type = other RNA
gccaccggcagagctgccacagggagcgcgtcctgcacgggaggcgggacctactggacatattgtacctgcacaacc

SEQ ID NO: 45731 - RNA, 81 nt, synthetic construct
  misc_feature 1..81: note = derived and/or modified sequence opt5 from anti-influenza_CDR
  source 1..81: mol_type = other RNA
ggctacatccccgaggcccctagagacgggcaggcttatgtgcggaaggatggagaatgggtcctgctcagcaccttcctg

SEQ ID NO: 45732 - RNA, 90 nt, synthetic construct
  misc_feature 1..90: note = derived and/or modified sequence opt5 from anti-influenza_CDR
  source 1..90: mol_type = other RNA
caggtgcaactgctcgagaccggcgggggactggtcaagcccggccagagccttaaactgtcctgcgccgcttctgggttcacatttacg

SEQ ID NO: 45733 - RNA, 96 nt, synthetic construct
  misc_feature 1..96: note = derived and/or modified sequence opt5 from anti-influenza_CDR
  source 1..96: mol_type = other RNA
agattcaccatcagccgggacaactccaagaatacactgtacctccagatgaactctctgcgcgccgaggatacggctgtgtattactgcgccaaa

SEQ ID NO: 45734 - RNA, 96 nt, synthetic construct
  misc_feature 1..96: note = derived and/or modified sequence opt5 from anti-influenza_CDR
  source 1..96: mol_type = other RNA
ggcgtgcccagcagattctccgggtctggaagcggcaccgactttacactgacgatctcctctctccagcctgaggatttcgccacctactattgc

SEQ ID NO: 45735 - RNA, 15 nt, synthetic construct
  misc_feature 1..15: note = derived and/or modified sequence opt5 from anti-OX40_HeavyChain_CDR1
  source 1..15: mol_type = other RNA
agctactccatgaac

SEQ ID NO: 45736 - RNA, 15 nt, synthetic construct
  misc_feature 1..15: note = derived and/or modified sequence opt5 from anti-OX40_HeavyChain_CDR1
  source 1..15: mol_type = other RNA
gactacgccatgcac

SEQ ID NO: 45737 - RNA, 15 nt, synthetic construct
  misc_feature 1..15: note = derived and/or modified sequence opt5 from anti-OX40_HeavyChain_CDR1
  source 1..15: mol_type = other RNA
gacagctacatgtcc

SEQ ID NO: 45738 - RNA, 15 nt, synthetic construct
  misc_feature 1..15: note = derived and/or modified sequence opt5 from anti-OX40_HeavyChain_CDR1
  source 1..15: mol_type = other RNA
gacgcctacatgagc

SEQ ID NO: 45739 - RNA, 15 nt, synthetic construct
  misc_feature 1..15: note = derived and/or modified sequence opt5 from anti-OX40_HeavyChain_CDR1
  source 1..15: mol_type = other RNA
gagagctacatgtcc

SEQ ID NO: 45740 - RNA, 15 nt, synthetic construct
  misc_feature 1..15: note = derived and/or modified sequence opt5 from anti-OX40_HeavyChain_CDR1
  source 1..15: mol_type = other RNA
agcggctactggaac

SEQ ID NO: 45741 - RNA, 21 nt, synthetic construct
  misc_feature 1..21: note = derived and/or modified sequence opt5 from anti-OX40_LightChain_CDR2
  source 1..21: mol_type = other RNA
tacaccagcagactgcactcc

SEQ ID NO: 45742 - RNA, 21 nt, synthetic construct
  misc_feature 1..21: note = derived and/or modified sequence opt5 from anti-OX40_LightChain_CDR2
  source 1..21: mol_type = other RNA
gccgctagctccctgcagtct

SEQ ID NO: 45743 - RNA, 21 nt, synthetic construct
  misc_feature 1..21: note = derived and/or modified sequence opt5 from anti-OX40_LightChain_CDR2
  source 1..21: mol_type = other RNA
gacgccagcaacagagctacc

SEQ ID NO: 45744 - RNA, 21 nt, synthetic construct
  misc_feature 1..21: note = derived and/or modified sequence opt5 from anti-OX40_LightChain_CDR2
  source 1..21: mol_type = other RNA
tacaccagcagactgcggtcc

SEQ ID NO: 45745 - RNA, 24 nt, synthetic construct
  misc_feature 1..24: note = derived and/or modified sequence opt5 from anti-OX40_LightChain_CDR3
  source 1..24: mol_type = other RNA
cagcaaagaagcaactggcccacc

SEQ ID NO: 45746 - RNA, 24 nt, synthetic construct
  misc_feature 1..24: note = derived and/or modified sequence opt5 from anti-OX40_HeavyChain_CDR3
  source 1..24: mol_type = other RNA
gcccccagatggtacttcagcgtg

SEQ ID NO: 45747 - RNA, 24 nt, synthetic construct
  misc_feature 1..24: note = derived and/or modified sequence opt5 from anti-OX40_HeavyChain_CDR3
  source 1..24: mol_type = other RNA
gcccccagatggtacttcagcgct

SEQ ID NO: 45748 - RNA, 24 nt, synthetic construct
  misc_feature 1..24: note = derived and/or modified sequence opt5 from anti-OX40_HeavyChain_CDR3
  source 1..24: mol_type = other RNA
gcccccagatggtacttcgctgtg

SEQ ID NO: 45749 - RNA, 27 nt, synthetic construct
  misc_feature 1..27: note = derived and/or modified sequence opt5 from anti-OX40_LightChain_CDR3
  source 1..27: mol_type = other RNA
cagcaaggcaacaccctgccctggaca

SEQ ID NO: 45750 - RNA, 27 nt, synthetic construct
  misc_feature 1..27: note = derived and/or modified sequence opt5 from anti-OX40_HeavyChain_CDR3
  source 1..27: mol_type = other RNA
gagagcggctggtacctgttcgactat

SEQ ID NO: 45751 - RNA, 27 nt, synthetic construct
  misc_feature 1..27: note = derived and/or modified sequence opt5 from anti-OX40_LightChain_CDR3
  source 1..27: mol_type = other RNA
cagcaatacaacagctatccccctacc

SEQ ID NO: 45752 - RNA, 27 nt, synthetic construct
  misc_feature 1..27: note = derived and/or modified sequence opt5 from anti-OX40_LightChain_CDR3
  source 1..27: mol_type = other RNA
cagcaaggccacaccctgccccctaca

SEQ ID NO: 45753 - RNA, 27 nt, synthetic construct
  misc_feature 1..27: note = derived and/or modified sequence opt5 from anti-OX40_LightChain_CDR3
  source 1..27: mol_type = other RNA
cagcaaggccacaccctgcccgccaca

SEQ ID NO: 45754 - RNA, 27 nt, synthetic construct
  misc_feature 1..27: note = derived and/or modified sequence opt5 from anti-OX40_LightChain_CDR3
  source 1..27: mol_type = other RNA
cagcaaggccacaccgcccctcccaca

SEQ ID NO: 45755 - RNA, 27 nt, synthetic construct
  misc_feature 1..27: note = derived and/or modified sequence opt5 from anti-OX40_LightChain_CDR3
  source 1..27: mol_type = other RNA
cagcaaggcgccaccctgccccctaca

SEQ ID NO: 45756 - RNA, 27 nt, synthetic construct
  misc_feature 1..27: note = derived and/or modified sequence opt5 from anti-OX40_LightChain_CDR3
  source 1..27: mol_type = other RNA
cagcaaggccacgccctgccccctacc

SEQ ID NO: 45757 - RNA, 27 nt, synthetic construct
  misc_feature 1..27: note = derived and/or modified sequence opt5 from anti-OX40_LightChain_CDR3
  source 1..27: mol_type = other RNA
cagcaagcccacaccctgccccctaca

SEQ ID NO: 45758 - RNA, 27 nt, synthetic construct
  misc_feature 1..27: note = derived and/or modified sequence opt5 from anti-OX40_LightChain_CDR3
  source 1..27: mol_type = other RNA
cagcaaggccacaccctggcccccaca

SEQ ID NO: 45759 - RNA, 27 nt, synthetic construct
  misc_feature 1..27: note = derived and/or modified sequence opt5 from anti-OX40_LightChain_CDR3
  source 1..27: mol_type = other RNA
caggccggccacaccctgccccctaca

SEQ ID NO: 45760 - RNA, 30 nt, synthetic construct; identical to SEQ ID NO: 30476
  misc_feature 1..30: note = derived and/or modified sequence opt5 from anti-OX40_HeavyChain_CDR1
  source 1..30: mol_type = other RNA

SEQ ID NO: 45761 - RNA, 30 nt, synthetic construct; identical to SEQ ID NO: 30477
  misc_feature 1..30: note = derived and/or modified sequence opt5 from anti-OX40_HeavyChain_CDR3
  source 1..30: mol_type = other RNA

SEQ ID NO: 45762 - RNA, 33 nt, synthetic construct; identical to SEQ ID NO: 30478
  misc_feature 1..33: note = derived and/or modified sequence opt5 from anti-OX40_LightChain_CDR1
  source 1..33: mol_type = other RNA

SEQ ID NO: 45763 - RNA, 33 nt, synthetic construct; identical to SEQ ID NO: 30479
  misc_feature 1..33: note = derived and/or modified sequence opt5 from anti-OX40_LightChain_CDR1
  source 1..33: mol_type = other RNA

SEQ ID NO: 45764 - RNA, 33 nt, synthetic construct; identical to SEQ ID NO: 45282
  misc_feature 1..33: note = derived and/or modified sequence opt5 from anti-OX40_LightChain_CDR1
  source 1..33: mol_type = other RNA

SEQ ID NO: 45765 - RNA, 39 nt, synthetic construct; identical to SEQ ID NO: 30481
  misc_feature 1..39: note = derived and/or modified sequence opt5 from anti-OX40_HeavyChain_CDR3
  source 1..39: mol_type = other RNA

SEQ ID NO: 45766 - RNA, 39 nt, synthetic construct; identical to SEQ ID NO: 30482
  misc_feature 1..39: note = derived and/or modified sequence opt5 from anti-OX40_HeavyChain_CDR3
  source 1..39: mol_type = other RNA

SEQ ID NO: 45767 - RNA, 39 nt, synthetic construct; identical to SEQ ID NO: 30483
  misc_feature 1..39: note = derived and/or modified sequence opt5 from anti-OX40_HeavyChain_CDR3
  source 1..39: mol_type = other RNA

SEQ ID NO: 45768 - RNA, 45 nt, synthetic construct; identical to SEQ ID NO: 30484
  misc_feature 1..45: note = derived and/or modified sequence opt5 from anti-OX40_HeavyChain_CDR3
  source 1..45: mol_type = other RNA

SEQ ID NO: 45769 - RNA, 48 nt, synthetic construct; identical to SEQ ID NO: 30485
  misc_feature 1..48: note = derived and/or modified sequence opt5 from anti-OX40_HeavyChain_CDR2
  source 1..48: mol_type = other RNA

SEQ ID NO: 45770 - RNA, 48 nt, synthetic construct; identical to SEQ ID NO: 30486
  misc_feature 1..48: note = derived and/or modified sequence opt5 from anti-OX40_HeavyChain_CDR2
  source 1..48: mol_type = other RNA

SEQ ID NO: 45771 - RNA, 48 nt, synthetic construct
  misc_feature 1..48: note = derived and/or modified sequence opt5 from anti-OX40_HeavyChain_CDR2
  source 1..48: mol_type = other RNA
tacatcagctatagcggcattacctaccacaacccctctctgaagtcc

SEQ ID NO: 45772 - RNA, 51 nt, synthetic construct; identical to SEQ ID NO: 30488
  misc_feature 1..51: note = derived and/or modified sequence opt5 from anti-OX40_HeavyChain_CDR2
  source 1..51: mol_type = other RNA

SEQ ID NO: 45773 - RNA, 51 nt, synthetic construct
  misc_feature 1..51: note = derived and/or modified sequence opt5 from anti-OX40_HeavyChain_CDR2
  source 1..51: mol_type = other RNA
tacatcagctcctctagctccaccattgactatgccgattctgtgaagggc

SEQ ID NO: 45774 - RNA, 51 nt, synthetic construct
  misc_feature 1..51: note = derived and/or modified sequence opt5 from anti-OX40_HeavyChain_CDR2
  source 1..51: mol_type = other RNA
ggcatcagctggaactccgggtctattggatacgccgacagcgtgaagggc

SEQ ID NO: 45775 - RNA, 51 nt, synthetic construct; identical to SEQ ID NO: 30491
  misc_feature 1..51: note = derived and/or modified sequence opt5 from anti-OX40_HeavyChain_CDR2
  source 1..51: mol_type = other RNA

SEQ ID NO: 45776 - RNA, 51 nt, synthetic construct; identical to SEQ ID NO: 30492
  misc_feature 1..51: note = derived and/or modified sequence opt5 from anti-OX40_HeavyChain_CDR2
  source 1..51: mol_type = other RNA

SEQ ID NO: 45777 - RNA, 51 nt, synthetic construct; identical to SEQ ID NO: 30493
  misc_feature 1..51: note = derived and/or modified sequence opt5 from anti-OX40_HeavyChain_CDR2
  source 1..51: mol_type = other RNA

SEQ ID NO: 45778 - RNA, 51 nt, synthetic construct; identical to SEQ ID NO: 30494
  misc_feature 1..51: note = derived and/or modified sequence opt5 from anti-OX40_HeavyChain_CDR2
  source 1..51: mol_type = other RNA

SEQ ID NO: 45779 - RNA, 51 nt, synthetic construct; identical to SEQ ID NO: 30495
  misc_feature 1..51: note = derived and/or modified sequence opt5 from anti-OX40_HeavyChain_CDR2
  source 1..51: mol_type = other RNA

SEQ ID NO: 45780 - RNA, 51 nt, synthetic construct; identical to SEQ ID NO: 30496
  misc_feature 1..51: note = derived and/or modified sequence opt5 from anti-OX40_HeavyChain_CDR2
  source 1..51: mol_type = other RNA

SEQ ID NO: 45781 - RNA, 309 nt, synthetic construct
  misc_feature 1..309: note = derived and/or modified sequence opt5 from Ig_LightChain_kappa_constant_domain
  source 1..309: mol_type = other RNA
accgtggccgctcccagcgtcttcatctttcctccgtccgacgagcagctgaagtctggcacagccagcgttgtgtgcctcctgaacaatttctaccccagagaagcgaaagtgcaatggaaggtcgataacgcccttcagtccggaaattctcaggagagcgtgacggaacaggactccaaagattctacctatagcctgtccagcacactcaccctgtctaaggctgactacgagaaacacaaggtttatgcctgtgaagtgacacatcaagggctttccagccctgtcaccaagtcttttaaccgg

SEQ ID NO: 45782 - RNA, 309 nt, synthetic construct
  misc_feature 1..309: note = derived and/or modified sequence opt5 from Ig_LightChain_kappa_constant_domain
  source 1..309: mol_type = other RNA
accgtggccgctcccagcgtcttcatctttcctccgtccgacgagcagctgaagtctggcacagccagcgttgtgtgcctcctgaacaatttctaccccagagaagcgaaagtgcaatggaaggtcgataacgcccttcagtccggaaattctcaggagagcgtgacggaacaggactccaaagattctacctatagcctgtccaacacactcaccctgagcaaggctgactacgagaaacacaaggtttatgcctgtgaagtgacacatcaagggctttcttcccctgtcaccaagagctttaatcgg

SEQ ID NO: 45783 - RNA, 312 nt, synthetic construct
  misc_feature 1..312: note = derived and/or modified sequence opt5 from Ig_LightChain_lambda_constant_domain
  source 1..312: mol_type = other RNA
cccaaggccgctcctagcgtgaccctgttcccgccctcctctgaggaactccaggccaacaaggcgacactggtctgccttatcagcgacttttaccctggcgctgttacggtggcctggaaggccgattcctctcccgtgaaagctggggtcgagaccacaacccctagcaagcaatccaataacaaatatgccgcttctagctacctgtccctcacacccgaacagtggaaaagccacagatcttattcctgtcaggtgacccatgagggaagcacagttgaaaagaccgtggcccctacggagtgctct

SEQ ID NO: 45784 - RNA, 312 nt, synthetic construct
  misc_feature 1..312: note = derived and/or modified sequence opt5 from Ig_LightChain_lambda_constant_domain
  source 1..312: mol_type = other RNA
cccaaggccgctcctagcgtgaccctgttcccgccctcctctgaggaactccaggccaacaaggcgacactggtctgccttatcagcgacttttaccctggcgctgttacggtggcctggaaggccgattcctctcccgtgaaagctggggtcgagaccacaacccctagcaagcaatccaataacaaatatgccgcttctagctacctgtccctcacacccgaacagtggaaaagccacagatcttattcctgtcaggtgacccatgagggaagcacagttgaaaagaccgtggcccctgcggagtgctct

SEQ ID NO: 45785 - RNA, 312 nt, synthetic construct
  misc_feature 1..312: note = derived and/or modified sequence opt5 from Ig_LightChain_lambda_constant_domain
  source 1..312: mol_type = other RNA
cccaaggccgctcctagcgtgaccctgttcccgccctcctctgaggaactccaggccaacaaagcgacactggtctgccttatcagcgacttttaccctggcgctgttacggtggcctggaaggccgattcctctcccgtgaaagctggggtcgagaccacaacccctagcaagcaatccaataacaaatatgccgcttctagctacctgtccctcacacccgaacagtggaaaagccacaagtcttattcctgtcaggtgacccatgagggaagcacagttgaaaagaccgtggcccctacggagtgctct

SEQ ID NO: 45786 - RNA, 312 nt, synthetic construct
  misc_feature 1..312: note = derived and/or modified sequence opt5 from Ig_LightChain_lambda_constant_domain
  source 1..312: mol_type = other RNA
cccaaggccgctcctagcgtgaccctgttcccgccctcctctgaggaactccaggccaacaaagcgacactggtctgccttatcagcgacttttaccctggcgctgttacggtggcctggaaggccgattcctctcccgtgaaagctggggtcgagaccacaacccctagcaagcaatccaataacaaatatgccgcttctagctacctgtccctcacacccgaacagtggaaaagccacaagtcttattcctgtcaggtgacccatgagggaagcacagttgaaaagaccgtggcccctgcggagtgctct

SEQ ID NO: 45787 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgttccctctggctccgagctccaaatctacaagcgggggaacggccgcgctcggctgcctggtcaaggactactttcccgagcctgttaccgtgtcctggaactctggggtgcacacattccccgctgtccttcagagctccggactgtatagcctctcttccgtggttaccgtgccttctagctccctgggcacacaaacctacatctgtaatgtcaaccataaacccagcaatacaaaggtggataaaaaggtt

SEQ ID NO: 45788 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgttccctctggccccgtctagcaagtccacctctgggggaacagctgccctcggctgcctggtcaaagactactttcccgagcctgttacggtgagctggaactccggggtgcacaccttccccgcggtccttcagtctagcggactgtattccctcagctctgtggttacagtgccttccagctctctgggcacccaaacatacatctgtaatgtcaaccataagccctccaataccaaagtggataagaaagtt

SEQ ID NO: 45789 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgttccctctggccccgtctagcaagtccacctctgggggaacagctgccctcggctgcctggtcaaagactactttcccgagcctgttacggtgagctggaactccggggtgcacaccttccccgcggtccttcagtctagcggactgtattccctcagctctgtggttacagtgccttccagctctctgggcacccaaacatacatctgtaatgtcaaccataagccctccaataccaaagtggataagaaagct

SEQ ID NO: 45790 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgttccctctggccccgtctagcaagtccacctctgggggaacagctgccctcggctgcctggtcaaagactactttcccgagcctgttacggtgagctggaactccggggtgcacaccttccccgcggtccttcagtctagcggactgtattccctcagctctgtggttacagtgccttccagctctctgggcacccaaacatacatctgtaatgtcaaccataagccctccaataccaaagtggataagagagtt

SEQ ID NO: 45791 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgttccctctggccccgtctagcaagtccacctctgggggaacagctgccctcggctgcctggtcaaagactactttcccgagcctgttacggtgagctggaactccggggtgcacaccttccccgcggtccttcagtctagcggactgtattccctcagctctgtggttacagtgccttccagctctctgggcacccaaacatacatctgtaatgtcaaccataagccctccaataccaaagtggataagagagct

SEQ ID NO: 45792 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgctgcctctcgccccgtctagcaagtccacctctgggggaacagctgccctgggctgccttgtcaaagactacttccccgagcctgttacggtgagctggaactccggggtgcacacctttcccgcggtcctgcagtctagcggactctattccctgagctctgtggttacagtgccttccagctctcttggcacccaaacatacatctgtaatgtcaaccataagccctccaataccaaagtggataagaaagtt

SEQ ID NO: 45793 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgctgcctctcgccccgtctagcaagtccacctctgggggaacagctgccctgggctgccttgtcaaagactacttccccgagcctgttacggtgagctggaactccggggtgcacacctttcccgcggtcctgcagtctagcggactctattccctgagctctgtggttacagtgccttccagctctcttggcacccaaacatacatctgtaatgtcaaccataagccctccaataccaaagtggataagaaagct

SEQ ID NO: 45794 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgctgcctctcgccccgtctagcaagtccacctctgggggaacagctgccctgggctgccttgtcaaagactacttccccgagcctgttacggtgagctggaactccggggtgcacacctttcccgcggtcctgcagtctagcggactctattccctgagctctgtggttacagtgccttccagctctcttggcacccaaacatacatctgtaatgtcaaccataagccctccaataccaaagtggataagagagtt

SEQ ID NO: 45795 - RNA, 270 nt, synthetic construct
  misc_feature 1..270: note = derived and/or modified sequence opt5 from IgG1_HeavyChain_CH1_constant_domain
  source 1..270: mol_type = other RNA
agcggcccctccgtgctgcctctcgccccgtctagcaagtccacctctgggggaacagctgccctgggctgccttgtcaaagactacttccccgagcctgttacggtgagctggaactccggggtgcacacctttcccgcggtcctgcagtctagcggactctattccctgagctctgtggttacagtgccttccagctctcttggcacccaaacatacatctgtaatgtcaaccataagccctccaataccaaagtggataagagagct

SEQ ID NO: 45796 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgttccctctggctccgagctccaaatctacaagcgggggaacggccgcgctcggctgcctggtcaaggactactttcccgagcctgttaccgtgtcctggaactctggggtgcacacattccccgctgtccttcagagctccggactgtatagcctctcttccgtggttaccgtgccttctagctccctgggcacacaaacctacatctgtaatgtcaaccataaacccagcaatacaaaggtggataaaaaggcc

SEQ ID NO: 45797 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgttccctctggctccgagctccaaatctacaagcgggggaacggccgcgctcggctgcctggtcaaggactactttcccgagcctgttaccgtgtcctggaactctggggtgcacacattccccgctgtccttcagagctccggactgtatagcctctcttccgtggttaccgtgccttctagctccctgggcacacaaacctacatctgtaatgtcaaccataaacccagcaatacaaaggtggataaaagagtt

SEQ ID NO: 45798 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgttccctctggctccgagctccaaatctacaagcgggggaacggccgcgctcggctgcctggtcaaggactactttcccgagcctgttaccgtgtcctggaactctggggtgcacacattccccgctgtccttcagagctccggactgtatagcctctcttccgtggttaccgtgccttctagctccctgggcacacaaacctacatctgtaatgtcaaccataaacccagcaatacaaaggtggataaaagagcc

SEQ ID NO: 45799 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgctgcctctcgctccgagctccaaatctacaagcgggggaacggccgcgctgggctgccttgtcaaggactacttccccgagcctgttaccgtgtcctggaactctggggtgcacacatttcccgctgtcctgcagagctccggactctatagcctgtcttccgtggttaccgtgccttctagctcccttggcacacaaacctacatctgtaatgtcaaccataaacccagcaatacaaaggtggataaaaaggtt

SEQ ID NO: 45800 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgctgcctctcgctccgagctccaaatctacaagcgggggaacggccgcgctgggctgccttgtcaaggactacttccccgagcctgttaccgtgtcctggaactctggggtgcacacatttcccgctgtcctgcagagctccggactctatagcctgtcttccgtggttaccgtgccttctagctcccttggcacacaaacctacatctgtaatgtcaaccataaacccagcaatacaaaggtggataaaaaggcc

SEQ ID NO: 45801 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgctgcctctcgctccgagctccaaatctacaagcgggggaacggccgcgctgggctgccttgtcaaggactacttccccgagcctgttaccgtgtcctggaactctggggtgcacacatttcccgctgtcctgcagagctccggactctatagcctgtcttccgtggttaccgtgccttctagctcccttggcacacaaacctacatctgtaatgtcaaccataaacccagcaatacaaaggtggataaaagagtt

SEQ ID NO: 45802 - RNA, 282 nt, synthetic construct
  misc_feature 1..282: note = derived and/or modified sequence opt5 from IgG1_HeavyChain_CH1_constant_domain
  source 1..282: mol_type = other RNA
agcgcctccaccaagggcccctctgtgctgcctctcgctccgagctccaaatctacaagcgggggaacggccgcgctgggctgccttgtcaaggactacttccccgagcctgttaccgtgtcctggaactctggggtgcacacatttcccgctgtcctgcagagctccggactctatagcctgtcttccgtggttaccgtgccttctagctcccttggcacacaaacctacatctgtaatgtcaaccataaacccagcaatacaaaggtggataaaagagcc

SEQ ID NO: 45803 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgggcctagcgtgttcctgtttccgcccaagcctaaagacacccttatgatctccagaacacccgaagtcacgtgcgttgtggtggatgtctctcacgaggaccctgaagtgaagttcaactggtacgttgatggagtggaggtccataatgctaaaaccaagccccgggaggaacagtataacagcacataccgcgtggtttccgtgctgaccgtcctccaccaagactggctgaatggcaaagagtataagtgtaaggtgtctaacaaagcccttcctgcgccgattgaaaagacaatcagcaaagctaag

SEQ ID NO: 45804 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgggcctagcgtgttcctgtttccgcccaagcctaaagacacccttatgatctccagaacacccgaagtcacgtgcgttgtggtggatgtctctcacgaggaccctgaagtgaagttcaacgtttacgtggatggagtcgaggtgcataatgctaaaaccaagccccgggaggaacagtataacagcacataccgcgttgtgtccgtcctgaccgtgctccaccaagactggctgaatggcaaagagtataagtgtaaggtgtctaacaaagcccttcctgcgccgattgaaaagacaatcagcaaagctaag

SEQ ID NO: 45805 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgggcctagcgtgttcctgtttccgcccaagcctaaagacacccttatgatctccagaacacccgaagtcacgtgcgttgtggtggatgtctctcacgaggaccctgaagtgaagttcaacgtttacgtggatggagtcgaggtgcataatgctaaaaccaagccccgggaggaacagtatgccagcacataccgcgttgtgtccgtcctgaccgtgctccaccaagactggctgaacggcaaagagtataagtgtaaggtgtctaataaagcgcttcctgctccgattgaaaagacaatcagcaaagccaag

SEQ ID NO: 45806 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgggcctagcgtgttcctgtttccgcccaagcctaaagacacccttatgatctccagaacacccgaagtcacgtgcgttgtggtggatgtctctcacgaggaccctgaagtgaagttcaactggtacgttgatggagtggaggtccataatgctaaaaccaagccccgggaggaacagtatgccagcacataccgcgtggtttccgtgctgaccgtcctccaccaagactggctgaacggcaaagagtataagtgtaaggtgtctaataaagcgcttcctgctccgattgaaaagacaatcagcaaagccaag

SEQ ID NO: 45807 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgctcctagcgtgttcctgtttccgcccaagcctaaagacacccttatgatctccagaacacccgaagtcacgtgcgttgtggtggatgtctctcacgaggaccctgaagtgaagttcaacgtttacgtggatggggtcgaggtgcataatgccaaaaccaagccccgggaggaacagtataacagcacataccgcgttgtgtccgtcctgaccgtgctccaccaagactggctgaatggaaaagagtataagtgtaaggtgtctaacaaagcgcttcctgctccgattgaaaagacaatcagcaaagccaag

SEQ ID NO: 45808 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgctcctagcgtgttcctgtttccgcccaagcctaaagacacccttatgatctccagaacacccgaagtcacgtgcgttgtggtggatgtctctcacgaggaccctgaagtgaagttcaacgtttacgtggatggggtcgaggtgcataatgccaaaaccaagccccgggaggaacagtatgcgagcacataccgcgttgtgtccgtcctgaccgtgctccaccaagactggctgaacggaaaagagtataagtgtaaggtgtctaataaagcccttcctgctccgattgaaaagacaatcagcaaagccaag

SEQ ID NO: 45809 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgctcctagcgtgttcctgtttccgcccaagcctaaagacacccttatgatctccagaacacccgaagtcacgtgcgttgtggtggatgtctctcacgaggaccctgaagtgaagttcaactggtacgttgatggggtggaggtccataatgccaaaaccaagccccgggaggaacagtataacagcacataccgcgtggtttccgtgctgaccgtcctccaccaagactggctgaatggaaaagagtataagtgtaaggtgtctaacaaagcgcttcctgctccgattgaaaagacaatcagcaaagccaag

SEQ ID NO: 45810 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctgctcggcgctcctagcgtgttcctgtttccgcccaagcctaaagacacccttatgatctccagaacacccgaagtcacgtgcgttgtggtggatgtctctcacgaggaccctgaagtgaagttcaactggtacgttgatggggtggaggtccataatgccaaaaccaagccccgggaggaacagtatgcgagcacataccgcgtggtttccgtgctgaccgtcctccaccaagactggctgaacggaaaagagtataagtgtaaggtgtctaataaagcccttcctgctccgattgaaaagacaatcagcaaagccaag

SEQ ID NO: 45811 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgggcctagcgtgttcctctttccgcccaagcctaaagacaccctgatgatctccagaacacccgaagtcacgtgcgttgtggtggatgtctctcacgaggaccctgaagtgaagttcaacgtttacgtggatggagtcgaggtgcataatgccaaaaccaagccccgggaggaacagtataacagcacataccgcgttgtgtccgtccttaccgtgctgcaccaagactggctcaatggcaaagagtataagtgtaaggtgtctaacaaagcgctgcctgctccgattgaaaagacaatcagcaaagccaag

SEQ ID NO: 45812 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgggcctagcgtgttcctctttccgcccaagcctaaagacaccctgatgatctccagaacacccgaagtcacgtgcgttgtggtggatgtctctcacgaggaccctgaagtgaagttcaacgtttacgtggatggagtcgaggtgcataatgccaaaaccaagccccgggaggaacagtatgcgagcacataccgcgttgtgtccgtccttaccgtgctgcaccaagactggctcaacggcaaagagtataagtgtaaggtgtctaataaagctctgcctgccccgattgaaaagacaatcagcaaagccaag

SEQ ID NO: 45813 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgggcctagcgtgttcctctttccgcccaagcctaaagacaccctgatgatctccagaacacccgaagtcacgtgcgttgtggtggatgtctctcacgaggaccctgaagtgaagttcaactggtacgttgatggagtggaggtccataatgccaaaaccaagccccgggaggaacagtataacagcacataccgcgtggtttccgtgcttaccgtcctgcaccaagactggctcaatggcaaagagtataagtgtaaggtgtctaacaaagcgctgcctgctccgattgaaaagacaatcagcaaagccaag

SEQ ID NO: 45814 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgggcctagcgtgttcctctttccgcccaagcctaaagacaccctgatgatctccagaacacccgaagtcacgtgcgttgtggtggatgtctctcacgaggaccctgaagtgaagttcaactggtacgttgatggagtggaggtccataatgccaaaaccaagccccgggaggaacagtatgcgagcacataccgcgtggtttccgtgcttaccgtcctgcaccaagactggctcaacggcaaagagtataagtgtaaggtgtctaataaagctctgcctgccccgattgaaaagacaatcagcaaagccaag

SEQ ID NO: 45815 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgcccctagcgtgttcctctttccgcccaagcctaaagacaccctgatgatctccagaacacccgaagtcacgtgcgttgtggtggatgtctctcacgaggaccctgaagtgaagttcaacgtttacgtggatggggtcgaggtgcataatgcgaaaaccaagccccgggaggaacagtataacagcacataccgcgttgtgtccgtccttaccgtgctgcaccaagactggctcaatggaaaagagtataagtgtaaggtgtctaacaaagctctgcctgccccgattgaaaagacaatcagcaaagccaag

SEQ ID NO: 45816 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgcccctagcgtgttcctctttccgcccaagcctaaagacaccctgatgatctccagaacacccgaagtcacgtgcgttgtggtggatgtctctcacgaggaccctgaagtgaagttcaacgtttacgtggatggggtcgaggtgcataatgcgaaaaccaagccccgggaggaacagtatgctagcacataccgcgttgtgtccgtccttaccgtgctgcaccaagactggctcaacggaaaagagtataagtgtaaggtgtctaataaagccctgcctgccccgattgaaaagacaatcagcaaagctaag

SEQ ID NO: 45817 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgcccctagcgtgttcctctttccgcccaagcctaaagacaccctgatgatctccagaacacccgaagtcacgtgcgttgtggtggatgtctctcacgaggaccctgaagtgaagttcaactggtacgttgatggggtggaggtccataatgcgaaaaccaagccccgggaggaacagtataacagcacataccgcgtggtttccgtgcttaccgtcctgcaccaagactggctcaatggaaaagagtataagtgtaaggtgtctaacaaagctctgcctgccccgattgaaaagacaatcagcaaagccaag

SEQ ID NO: 45818 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgagctggctggcgcccctagcgtgttcctctttccgcccaagcctaaagacaccctgatgatctccagaacacccgaagtcacgtgcgttgtggtggatgtctctcacgaggaccctgaagtgaagttcaactggtacgttgatggggtggaggtccataatgcgaaaaccaagccccgggaggaacagtatgctagcacataccgcgtggtttccgtgcttaccgtcctgcaccaagactggctcaacggaaaagagtataagtgtaaggtgtctaataaagccctgcctgccccgattgaaaagacaatcagcaaagctaag

SEQ ID NO: 45819 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgggcctagcgtgttcctctttccgcccaagcctaaagacaccctgatgatctccagaacacccgaagtcacgtgcgttgtggtggatgtctctcacgaggaccctgaagtgaagttcaacgtttacgtggatggagtcgaggtgcataatgccaaaaccaagccccgggaggaacagtataacagcacataccgcgttgtgtccgtccttaccgtgctgcaccaagactggctcaatggcaaagagtataagtgtaaggtgtctaacaaagcgctgcctgctccgattgaaaagacaatcagcaaagccaag

SEQ ID NO: 45820 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgggcctagcgtgttcctctttccgcccaagcctaaagacaccctgatgatctccagaacacccgaagtcacgtgcgttgtggtggatgtctctcacgaggaccctgaagtgaagttcaacgtttacgtggatggagtcgaggtgcataatgccaaaaccaagccccgggaggaacagtatgcgagcacataccgcgttgtgtccgtccttaccgtgctgcaccaagactggctcaacggcaaagagtataagtgtaaggtgtctaataaagctctgcctgccccgattgaaaagacaatcagcaaagccaag

SEQ ID NO: 45821 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgggcctagcgtgttcctctttccgcccaagcctaaagacaccctgatgatctccagaacacccgaagtcacgtgcgttgtggtggatgtctctcacgaggaccctgaagtgaagttcaactggtacgttgatggagtggaggtccataatgccaaaaccaagccccgggaggaacagtataacagcacataccgcgtggtttccgtgcttaccgtcctgcaccaagactggctcaatggcaaagagtataagtgtaaggtgtctaacaaagcgctgcctgctccgattgaaaagacaatcagcaaagccaag

SEQ ID NO: 45822 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgggcctagcgtgttcctctttccgcccaagcctaaagacaccctgatgatctccagaacacccgaagtcacgtgcgttgtggtggatgtctctcacgaggaccctgaagtgaagttcaactggtacgttgatggagtggaggtccataatgccaaaaccaagccccgggaggaacagtatgcgagcacataccgcgtggtttccgtgcttaccgtcctgcaccaagactggctcaacggcaaagagtataagtgtaaggtgtctaataaagctctgcctgccccgattgaaaagacaatcagcaaagccaag

SEQ ID NO: 45823 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgcccctagcgtgttcctctttccgcccaagcctaaagacaccctgatgatctccagaacacccgaagtcacgtgcgttgtggtggatgtctctcacgaggaccctgaagtgaagttcaacgtttacgtggatggggtcgaggtgcataatgcgaaaaccaagccccgggaggaacagtataacagcacataccgcgttgtgtccgtccttaccgtgctgcaccaagactggctcaatggaaaagagtataagtgtaaggtgtctaacaaagctctgcctgccccgattgaaaagacaatcagcaaagccaag

SEQ ID NO: 45824 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgcccctagcgtgttcctctttccgcccaagcctaaagacaccctgatgatctccagaacacccgaagtcacgtgcgttgtggtggatgtctctcacgaggaccctgaagtgaagttcaacgtttacgtggatggggtcgaggtgcataatgcgaaaaccaagccccgggaggaacagtatgctagcacataccgcgttgtgtccgtccttaccgtgctgcaccaagactggctcaacggaaaagagtataagtgtaaggtgtctaataaagccctgcctgccccgattgaaaagacaatcagcaaagctaag

SEQ ID NO: 45825 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgcccctagcgtgttcctctttccgcccaagcctaaagacaccctgatgatctccagaacacccgaagtcacgtgcgttgtggtggatgtctctcacgaggaccctgaagtgaagttcaactggtacgttgatggggtggaggtccataatgcgaaaaccaagccccgggaggaacagtataacagcacataccgcgtggtttccgtgcttaccgtcctgcaccaagactggctcaatggaaaagagtataagtgtaaggtgtctaacaaagctctgcctgccccgattgaaaagacaatcagcaaagccaag

SEQ ID NO: 45826 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctctgggcgcccctagcgtgttcctctttccgcccaagcctaaagacaccctgatgatctccagaacacccgaagtcacgtgcgttgtggtggatgtctctcacgaggaccctgaagtgaagttcaactggtacgttgatggggtggaggtccataatgcgaaaaccaagccccgggaggaacagtatgctagcacataccgcgtggtttccgtgcttaccgtcctgcaccaagactggctcaacggaaaagagtataagtgtaaggtgtctaataaagccctgcctgccccgattgaaaagacaatcagcaaagctaag

SEQ ID NO: 45827 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgggcctagcgtgttcctgtttccgcccaagcctaaagacaccctcatgatctccagaacacccgaagtcacgtgcgttgtggtggatgtctctcacgaggaccctgaagtgaagttcaacgtttacgtggatggagtcgaggtgcataatgcgaaaaccaagccccgggaggaacagtataacagcacataccgcgttgtgtccgtcctgaccgtgcttcaccaagactggctgaatggcaaagagtataagtgtaaggtgtctaacaaagctctccctgccccgattgaaaagacaatcagcaaagccaag

SEQ ID NO: 45828 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgggcctagcgtgttcctgtttccgcccaagcctaaagacaccctcatgatctccagaacacccgaagtcacgtgcgttgtggtggatgtctctcacgaggaccctgaagtgaagttcaacgtttacgtggatggagtcgaggtgcataatgcgaaaaccaagccccgggaggaacagtatgctagcacataccgcgttgtgtccgtcctgaccgtgcttcaccaagactggctgaacggcaaagagtataagtgtaaggtgtctaataaagccctccctgccccgattgaaaagacaatcagcaaagctaag

SEQ ID NO: 45829 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgggcctagcgtgttcctgtttccgcccaagcctaaagacaccctcatgatctccagaacacccgaagtcacgtgcgttgtggtggatgtctctcacgaggaccctgaagtgaagttcaactggtacgttgatggagtggaggtccataatgcgaaaaccaagccccgggaggaacagtataacagcacataccgcgtggtttccgtgctgaccgtccttcaccaagactggctgaatggcaaagagtataagtgtaaggtgtctaacaaagctctccctgccccgattgaaaagacaatcagcaaagccaag

SEQ ID NO: 45830 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgggcctagcgtgttcctgtttccgcccaagcctaaagacaccctcatgatctccagaacacccgaagtcacgtgcgttgtggtggatgtctctcacgaggaccctgaagtgaagttcaactggtacgttgatggagtggaggtccataatgcgaaaaccaagccccgggaggaacagtatgctagcacataccgcgtggtttccgtgctgaccgtccttcaccaagactggctgaacggcaaagagtataagtgtaaggtgtctaataaagccctccctgccccgattgaaaagacaatcagcaaagctaag

SEQ ID NO: 45831 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgcgcctagcgtgttcctgtttccgcccaagcctaaagacaccctcatgatctccagaacacccgaagtcacgtgcgttgtggtggatgtctctcacgaggaccctgaagtgaagttcaacgtttacgtggatggggtcgaggtgcataatgctaaaaccaagccccgggaggaacagtataacagcacataccgcgttgtgtccgtcctgaccgtgcttcaccaagactggctgaatggaaaagagtataagtgtaaggtgtctaacaaagccctccctgccccgattgaaaagacaatcagcaaagctaag

SEQ ID NO: 45832 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgcgcctagcgtgttcctgtttccgcccaagcctaaagacaccctcatgatctccagaacacccgaagtcacgtgcgttgtggtggatgtctctcacgaggaccctgaagtgaagttcaacgtttacgtggatggggtcgaggtgcataatgctaaaaccaagccccgggaggaacagtatgccagcacataccgcgttgtgtccgtcctgaccgtgcttcaccaagactggctgaacggaaaagagtataagtgtaaggtgtctaataaagccctccctgctccgattgaaaagacaatcagcaaagccaag

SEQ ID NO: 45833 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgcgcctagcgtgttcctgtttccgcccaagcctaaagacaccctcatgatctccagaacacccgaagtcacgtgcgttgtggtggatgtctctcacgaggaccctgaagtgaagttcaactggtacgttgatggggtggaggtccataatgctaaaaccaagccccgggaggaacagtataacagcacataccgcgtggtttccgtgctgaccgtccttcaccaagactggctgaatggaaaagagtataagtgtaaggtgtctaacaaagccctccctgccccgattgaaaagacaatcagcaaagctaag

SEQ ID NO: 45834 - RNA, 330 nt, synthetic construct
  misc_feature 1..330: note = derived and/or modified sequence opt5 from IgG1_HeavyChain_CH2_constant_domain
  source 1..330: mol_type = other RNA
gcccccgaggctgccggcgcgcctagcgtgttcctgtttccgcccaagcctaaagacaccctcatgatctccagaacacccgaagtcacgtgcgttgtggtggatgtctctcacgaggaccctgaagtgaagttcaactggtacgttgatggggtggaggtccataatgctaaaaccaagccccgggaggaacagtatgccagcacataccgcgtggtttccgtgctgaccgtccttcaccaagactggctgaacggaaaagagtataagtgtaaggtgtctaataaagccctccctgctccgattgaaaagacaatcagcaaagccaag

SEQ ID NO: 45835 - RNA, 318 nt, synthetic construct
  misc_feature 1..318: note = derived and/or modified sequence opt5 from IgG1_HeavyChain_CH3_constant_domain
  source 1..318: mol_type = other RNA
ggccagcccagagagcctcaagtgtacaccctgccgcccagccgggaagagatgacaaagaaccaggtctccctcacgtgcctggttaaagggttctatccttctgacatcgccgtggaatgggagagcaatggacagcccgaaaacaattacaagaccacacctcccgtgcttgattccgacggcagctttttcctgtattctaaactcaccgtcgataagtcccgctggcagcaagggaacgtgttttcttgtagcgttatgcacgaggctctgcataatcactacacacagaaatcccttagcctgtctcctgga

SEQ ID NO: 45836 - RNA, 318 nt, synthetic construct
  misc_feature 1..318: note = derived and/or modified sequence opt5 from IgG1_HeavyChain_CH3_constant_domain
  source 1..318: mol_type = other RNA
ggccagcccagagagcctcaagtgtacaccctgccgcccagccgggaggaactcacaaagaaccaggtctccctgacgtgccttgttaaagggttctatccttctgacatcgctgtggaatgggagagcaatggacagcccgaaaacaattacaagaccacacctcccgtgctggattccgacggcagctttttcctctattctaaactgaccgtcgataagtcccgctggcagcaagggaacgtgttttcttgtagcgttatgcacgaggcccttcataatcactacacacagaaatccctgagcctctctcctgga

SEQ ID NO: 45837 - RNA, 318 nt, synthetic construct
  misc_feature 1..318: note = derived and/or modified sequence opt5 from IgG1_HeavyChain_CH3_constant_domain
  source 1..318: mol_type = other RNA
ggccagcccagagagcctcaagtgtacaccctgccgcccagccgggacgaaatgacaaagaaccaggtctccctcacgtgcctggttaaagggttctatccttctgatatcgccgtggagtgggaaagcaatggacagcccgagaacaattacaagaccacacctcccgtgcttgactccgatggcagctttttcctgtattctaaactcaccgtcgacaagtcccgctggcagcaagggaacgtgttttcttgtagcgttatgcacgaagctctgcataatcactacacacagaaatcccttagcctgtctcctgga

SEQ ID NO: 45838 - RNA, 318 nt, synthetic construct
  misc_feature 1..318: note = derived and/or modified sequence opt5 from IgG1_HeavyChain_CH3_constant_domain
  source 1..318: mol_type = other RNA
ggccagcccagagagcctcaagtgtacaccctgccgcccagccgggacgaactcacaaagaaccaggtctccctgacgtgccttgttaaagggttctatccttctgatatcgctgtggagtgggaaagcaatggacagcccgagaacaattacaagaccacacctcccgtgctggactccgatggcagctttttcctctattctaaactgaccgtcgacaagtcccgctggcagcaagggaacgtgttttcttgtagcgttatgcacgaagcccttcataatcactacacacagaaatccctgagcctctctcctgga

SEQ ID NO: 45839 - RNA, 297 nt, synthetic construct
  misc_feature 1..297: note = derived and/or modified sequence opt5 from IgG2_HeavyChain_CH1_constant_domain
  source 1..297: mol_type = other RNA
agcgcctccaccaagggcccctctgtgttccctctggctccgtgcagcagatccacatctgagagcacggccgcgctcgggtgtctggtcaaagactactttcccgaacctgttaccgtgtcctggaactctggagctcttacaagcggcgtgcacaccttccccgccgtcctgcagtccagcgggctctactctctgtccagcgtggttacagtgccttcttccaattttggaacccaaacatatacctgcaacgtcgatcataagcccagcaatacgaaagtggacaagaccgtt

SEQ ID NO: 45840 - RNA, 297 nt, synthetic construct
  misc_feature 1..297: note = derived and/or modified sequence opt5 from IgG2_HeavyChain_CH1_constant_domain
  source 1..297: mol_type = other RNA
agcgcctccaccaagggcccctctgtgttccctctggctccgtgcagcagatccacatctgagagcacggccgcgctcgggtgtctggtcaaagactactttcccgaacctgttaccgtgtcctggaactctggagctcttacaagcggcgtgcacaccttccccgccgtcctgcagtccagcgggctctattctctgtccagcgtggttacagtgacctcttccaattttggaacacaaacctacacgtgcaacgtcgatcataagcctagcaataccaaagtggacaagacagtt

SEQ ID NO: 45841 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatggggtcgaagtgcataatgccaagaccaaacctcgggaggaacaatttaacagcacattccgcgttgtgtccgtcctgaccgtggtgcaccaggactggcttaatggaaaggagtataaatgtaaggtctctaacaagggcctgccggcgcccattgagaaaacaatcagcaagaccaaa

SEQ ID NO: 45842 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatggggtcgaagtgcataatgccaagaccaaacctcgggaggaacaatttaacagcacattccgcgttgtgtccgtcctgaccgtggtgcaccaggactggcttaatggaaaggagtataaatgtaaggtctctaacaagggcctgccggcgagcattgagaaaacaatctccaagaccaaa

SEQ ID NO: 45843 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatggggtcgaagtgcataatgccaagaccaaacctcgggaggaacaatttaacagcacattccgcgttgtgtccgtcctgaccgtggtgcaccaggactggcttaatggaaaggagtataaatgtaaggtctctaacaagggcctgccgagccccattgagaaaacaatctccaagaccaaa

SEQ ID NO: 45844 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatggggtcgaagtgcataatgccaagaccaaacctcgggaggaacaatttaacagcacattccgcgttgtgtccgtcctgaccgtggtgcaccaggactggcttaatggaaaggagtataaatgtaaggtctctaacaagggcctgccgagctccattgagaaaacaatctctaagaccaaa

SEQ ID NO: 45845 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatgggatggaagtccataatgccaagaccaaacctcgggaggaacaatttaacagcacattccgcgtggtttccgtgctgaccgtcgtgcaccaggactggcttaatggaaaggagtataaatgtaaggtgtctaacaagggcctgccggcgcccattgagaaaacaatcagcaagaccaaa

SEQ ID NO: 45846 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatgggatggaagtccataatgccaagaccaaacctcgggaggaacaatttaacagcacattccgcgtggtttccgtgctgaccgtcgtgcaccaggactggcttaatggaaaggagtataaatgtaaggtgtctaacaagggcctgccggcgagcattgagaaaacaatctccaagaccaaa

SEQ ID NO: 45847 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatgggatggaagtccataatgccaagaccaaacctcgggaggaacaatttaacagcacattccgcgtggtttccgtgctgaccgtcgtgcaccaggactggcttaatggaaaggagtataaatgtaaggtgtctaacaagggcctgccgagccccattgagaaaacaatctccaagaccaaa

SEQ ID NO: 45848 - RNA, 327 nt, synthetic construct
  misc_feature 1..327: note = derived and/or modified sequence opt5 from IgG2_HeavyChain_CH2_constant_domain
  source 1..327: mol_type = other RNA
gctccccctgtggccggcccgagcgtcttcctgtttccccctaagcccaaagacaccctcatgatctccagaacacctgaggttacgtgcgtggtggtcgatgtgtctcacgaagaccccgaggttcagttcaactggtacgtggatgggatggaagtccataatgccaagaccaaacctcgggaggaacaatttaacagcacattccgcgtggtttccgtgctgaccgtcgtgcaccaggactggcttaatggaaaggagtataaatgtaaggtgtctaacaagggcctgccgagctccattgagaaaacaatctctaagaccaaa

SEQ ID NO: 45849 - RNA, 318 nt, synthetic construct
  misc_feature 1..318: note = derived and/or modified sequence opt5 from IgG2_HeavyChain_CH3_constant_domain
  source 1..318: mol_type = other RNA
ggccagcccagagagcctcaagtgtacaccctgccgcccagccgggaagagatgacaaagaaccaggtctccctcacgtgcctggttaaagggttctatccttctgacatcgccgtggaatgggagagcaatggacagcccgaaaacaattacaagaccacacctcccatgcttgattccgacggcagctttttcctgtattctaaactcaccgtggataagtcccgctggcagcaagggaacgtcttttcttgtagcgtgatgcacgaggctctgcataatcactacacacagaaatcccttagcctgtctcctgga

SEQ ID NO: 45850 - RNA, 297 nt, synthetic construct
  misc_feature 1..297: note = derived and/or modified sequence opt5 from IgG4_HeavyChain_CH1_constant_domain
  source 1..297: mol_type = other RNA
agcgcctccaccaagggcccctctgtgttccctctggctccgtgcagcagatccacatctgagagcacggccgcgctcgggtgtctggtcaaagactactttcccgaacctgttaccgtgtcctggaactctggagctcttacaagcggcgtgcacaccttccccgccgtcctgcagtccagcgggctctactctctgtccagcgtggttacagtgccttcttccagccttggaaccaagacatatacctgcaatgtcgatcataaaccctctaacacgaaggtggacaaacgggtt

SEQ ID NO: 45851 - RNA, 330 nt, synthetic construct
  misc_feature 1..330: note = derived and/or modified sequence opt5 from IgG4_HeavyChain_CH2_constant_domain
  source 1..330: mol_type = other RNA
gcccccgagttcctgggcgggcctagcgtgtttctcttcccgcccaagcctaaagacaccctgatgatctccagaacacccgaagtcacgtgcgttgtggtggatgtctctcaggaggaccctgaagtgcaatttaactggtacgttgatggagtggaggtccacaatgctaagaccaaaccccgggaagaacagttcaacagcacatatcgcgtggtttccgtgcttaccgtcctgcatcaggactggctcaatggcaaggagtacaaatgtaaggtgtctaacaaggggctgcctagctccattgagaaaacaatctctaaggccaaa

SEQ ID NO: 45852 - RNA, 318 nt, synthetic construct
  misc_feature 1..318: note = derived and/or modified sequence opt5 from IgG4_HeavyChain_CH3_constant_domain
  source 1..318: mol_type = other RNA
ggccagcccagagagcctcaagtgtacaccctgccgcccagccaggaagagatgacaaagaaccaggtctccctcacgtgcctggttaaagggttctatccttctgacatcgccgtggaatgggagagcaatggacagcccgaaaacaattacaagaccacacctcccgtgcttgattccgacggcagctttttcctgtattctcggctcaccgtcgataaatcccgctggcaagaggggaacgtgttttcttgtagcgttatgcacgaggctctgcataatcactacacacagaagtcccttagcctgtctctcgga

SEQ ID NO: 45853 - RNA, 1347 nt, synthetic construct
  misc_feature 1..1347: note = derived and/or modified sequence opt6 from AAB-003_gamma1-Chain
  source 1..1347: mol_type = other RNA
gaagtacaactattagaaagcggaggaggactagtacaaccaggaggctcactacgattatcctgcgcagcatcaggatttactttctcaaactacggaatgtcatgggtaagacaagcaccaggaaaaggattagaatgggtagcatcaatacgaagcggaggaggaagaacatattattccgacaacgtaaaaggacgtttcacaatctcacgagataactcaaaaaacacactatatctacaaatgaactcactaagagcagaagacacagctgtctattactgcgtcagatacgaccattactcaggctcatcagactactggggtcagggaacacttgttaccgtatcatcagcatccacaaaaggaccatccgtattccctctagccccctcatctaaaagtacatcaggaggaacagcagcattaggatgcctagttaaagattacttcccagaaccagtaacagtatcctggaactcaggagcattaacatcaggagtacacaccttccccgcagtattacaatcatcaggattatattcactatcatcagtagtaactgtccctagctcctctctaggaacacaaacttacatttgcaatgtaaaccacaaaccatcaaacacaaaagtcgacaaaaaagtagaacctaaatcctgcgataaaacacatacatgtcccccttgcccagccccagaggcagccggagctccatccgtctttttattcccaccaaaaccaaaagatactctaatgatatcaagaacccccgaagtaacatgcgtagttgtagatgtatcccatgaagaccctgaagtaaaattcaattggtacgtagacggagttgaagtacataacgcaaaaacaaaacctcgagaggaacaatacaactcaacatacagagtagtatccgtattaacagtattacaccaagactggctaaacggcaaagaatacaaatgtaaagtatccaacaaagcactaccagcaccaattgaaaaaactatttcaaaagcaaaaggacaacccagagaaccccaagtatacacacttccaccttcccgagaagaaatgactaaaaatcaagtatccctaacatgcttagtaaaaggattctacccatcagatatagcagtagaatgggaaagcaacggacaaccagaaaacaactataaaacaacccccccagtattagattcagacggatccttcttcttatattcaaaactaacggtagacaaatcaagatggcaacaaggaaacgtattttcatgttcagtaatgcatgaagcactacataaccactatacacaaaaatcattatcattaagcccaggaaaa

SEQ ID NO: 45854 - RNA, 1329 nt, synthetic construct
  misc_feature 1..1329: note = derived and/or modified sequence opt6 from Abagovomab_HeavyChain
  source 1..1329: mol_type = other RNA
caagtaaaactacaagaatccggagccgaattagcaagaccaggcgcatcagtcaaattatcttgcaaagcatcaggatacacttttacaaactactggatgcaatgggtaaaacaaagacctggacaaggactagactggataggagcaatatacccaggagacggaaatacaagatacacacataaattcaaaggtaaagcaacactaaccgctgataaatcttcatcaacagcatacatgcaattatcatcactagcatccgaagacagcggagtatattactgtgcaagaggagaaggaaactatgcatggtttgcatattggggccaaggtacaaccgtcaccgtatcatcagcaaaaacaacaccaccctcagtttaccccctcgccccgggatccgcagcacaaacaaattcaatggtaaccttaggttgcttagttaaaggatacttcccagaaccagtaacagtcacctggaactcaggatcactttcctccggtgtacacacattccctgccgtactacaatctgacctctacacactatcatcatctgtaacagtaccatcctccacatggccatcagaaacagtaacatgcaatgtagcacatcctgcatcttccacaaaagtagacaaaaaaatagtaccaagagattgtggctgcaaaccctgcatatgcaccgtaccagaagtatcatcagtattcatattcccaccaaaaccaaaagacgtactaacaataactctaacaccaaaagtcacatgtgttgtagtagacatatcaaaagacgatccagaagtccaattctcctggtttgtagatgatgtagaagtacatacagcacaaacacaaccaagagaagagcaattcaactcaacattcagatcagtatcagaactaccaataatgcatcaagactggttaaatggtaaagaattcaaatgcagagtcaactcagcagcatttccagctcctatagaaaaaacaatatccaaaactaaaggaagaccaaaagcaccacaagtatacacaatacccccaccaaaagaacaaatggcaaaagacaaagtatcactaacatgtatgataaccgacttttttccagaagacataacagttgaatggcagtggaatggacaaccagcagaaaactacaaaaatacacaacccataatggatacagacggatcctacttcgtctattcaaaattaaacgtacaaaaatccaattgggaagcagggaataccttcacttgttcagttctacatgaaggacttcataatcatcacacagaaaaatcactatcacactcaccaggcaaa

SEQ ID NO: 45855 - RNA, 642 nt, synthetic construct
  misc_feature 1..642: note = derived and/or modified sequence opt6 from Abagovomab_LightChain
  source 1..642: mol_type = other RNA
gatatagaattaacacaatctcccgcatcactatcagcatcagtaggagaaacagtaaccataacatgccaagcatcagaaaacatatactcatacttagcatggcaccaacaaaaacaaggaaaatcaccacaactactagtttacaacgcaaaaacactagcaggaggagtatcctcaagattctcaggatcaggatcaggaacacacttcagcttaaaaataaaatccctacaacccgaagacttcggcatatactactgccaacaccactacggaatactaccaacattcggaggaggaacaaaactagaaataaaaagagcagacgcagcaccaactgtaagcatattcccaccatcctcagaacaattaacatctggaggagcatcagtagtatgcttcttaaacaacttttacccaaaagacataaacgtaaaatggaaaatagatggatcagaaagacaaaacggagtactaaactcatggaccgaccaagactcaaaagactcaacatactcaatgtcatcaacactaacactaacaaaagacgaatacgaaagacacaactcatacacatgcgaagccacacacaaaacatccacatcaccaatagtaaaatcatttaacagaaacgaatgc

SEQ ID NO: 45856 - RNA, 1350 nt, synthetic construct
  misc_feature 1..1350: note = derived and/or modified sequence opt6 from Abciximab_HeavyChain
  source 1..1350: mol_type = other RNA
gaagtacaactacaacaatcaggcgccgaacttgtaaaaccaggcgcctcagtcaaactatcatgtaccgcttcaggattcaacattaaagatacttatgtacactgggtaaaacaacgaccagaacaaggattagaatggataggacgaatagaccccgcaaacggatacaccaaatacgaccccaaatttcaaggaaaagcaaccataacagcagatacatcctcaaacactgcatatttacaattatcatccctcacatctgaagatacagcagtatattattgcgtaagaccattatacgactattacgcaatggactattggggacaaggaacatcagtaactgtctcaagcgctaaaacaactgcaccatcagtctacccactagccccagtctgcggcgacacaacaggttcctcagtcacactaggatgcttagtaaagggatacttccccgaaccagtaacccttacttggaactcaggatcactctccagcggagtacatacattcccagcagtgttgcaaagtgatttatacacactatcctcctcagtaaccgtaacatcatcaacatggccatcacaatccataacatgcaacgttgcccaccccgcatcaagtacaaaagtagataaaaaaatagaaccaagaccaaaatcatgtgataaaacacacacatgtccaccatgcccagcacctgaactattaggaggaccttcagtttttctattcccaccaaaaccaaaagacacactaatgatatcaagaacacccgaagtaacatgtgtcgttgtagacgtatcacacgaagaccctgaagtaaaattcaactggtatgtagatggcgtagaagtacacaacgctaaaacaaaacccagagaagaacaatataactccacataccgtgtcgtaagcgtactaacagtattacaccaagactggctaaatggaaaagaatacaaatgtaaagtatcaaacaaagccctcccagcaccaatagaaaaaacaatatctaaagcaaaaggccaaccaagagaaccacaagtatacacattaccaccttccagagatgaactaacaaaaaaccaagtttcactaacatgcctagtaaaaggcttctacccctctgacatcgcagtagaatgggaatcaaatggacaacctgaaaacaactacaaaacaacacctccagtactcgattcagatggttcctttttcctatactcaaagttaacagtagacaaatcaagatggcaacaaggaaacgtattctcctgttcagtaatgcacgaagcattacacaatcactacacacaaaaaagcctatccttatcaccaggaaaa

SEQ ID NO: 45857 - RNA, 642 nt, synthetic construct
  misc_feature 1..642: note = derived and/or modified sequence opt6 from Abciximab_LightChain
  source 1..642: mol_type = other RNA
gacatattaatgacacaatcaccctcatcaatgtcagtaagcttaggtgatacagtatcaataacatgccacgcatcacaaggaatatcatcaaacataggatggctccaacaaaaaccaggaaaatcattcatgggattaatatactacggaacaaacctagtagacggagtaccatccagattctccggatcaggatccggcgcagactactcactaacaatatcatcactagactcagaagacttcgcagactactactgcgtacaatacgcacaactaccatacacattcggaggaggaacaaaactagaaataaaaagagcagatgcagcaccaacagtaagcatattcccaccatcatcagaacaactaacatcaggaggagcatcagtagtatgcttcctaaacaacttctaccctaaagacataaacgtaaaatggaaaatagacggatcagaaagacaaaatggcgtactaaactcatggaccgaccaagactcaaaagactccacatactcaatgtcatccacactaacactaactaaagacgaatacgaaagacacaactcatacacatgcgaagcaacacacaaaacatcaacatccccaatagtaaaatcattcaacagaaacgaatgc

SEQ ID NO: 45858 - RNA, 1341 nt, synthetic construct
  misc_feature 1..1341: note = derived and/or modified sequence opt6 from Abituzumab_HeavyChain1
  source 1..1341: mol_type = other RNA
caagtacaactacaacaatcaggaggcgaattagcaaaaccaggcgcaagtgtaaaagtatcctgcaaagcatccggatatacattctcatcattttggatgcactgggttcgacaagcaccaggacaaggcttagaatggataggttacatcaacccaagatccggctatacagaatacaacgaaatattcagagataaagcaactatgaccacagacacttcaacatctacagcatacatggaactatcatcattacgatcagaagacacagccgtatactactgcgcatcattcttaggaagaggagcaatggactactggggacaaggtaccacagtcacagtatcctccgcatctacaaaaggaccatccgtattcccactagcaccctgctcacgatcaacctcagaatcaacagcagcattaggatgcctagtaaaagactacttccccgaaccggttacagtatcatggaattcaggagcactaacatcaggagtacatacatttcctgctgtactacaatcatccggattatattcactatcatcagtagtaacagtgccatcatcaaactttggcacacaaacatacacatgtaacgttgaccataaaccttcaaatacaaaagttgacaaaacagtagaacccaaatcatcagacaaaactcatacatgcccaccatgtccagcacccccagtcgcaggaccatctgtattcctattcccaccaaaacccaaagacacactaatgatatcaagaacaccagaagtaacttgcgtagtagtagacgtcagtcacgaagaccctgaagtccaattcaactggtacgtagacggagtagaagtacacaatgcaaaaacaaaacctagagaagaacaagcacaatcaacattccgagtagtctcagtcctaacagtagtacatcaagactggctaaacggaaaagaatataaatgcaaagtttcaaataaaggactaccagcacccatagaaaaaacaatatccaaaacaaaaggacaacctagagaaccacaagtatacaccctaccaccctcaagagaagaaatgacaaaaaaccaagtatctttaacatgtctagtaaaaggcttctatccatccgacatcgcagttgaatgggaatccaatggccaacccgaaaataactataaaactacaccaccaatgctagattccgacgggtcattctttctatactcaaaactaacagtagataaatcaagatggcaacaaggaaacgtattttcatgttccgtcatgcacgaagctttacacaaccactacacccaaaaatcactctcattatcacccggaaaa

SEQ ID NO: 45859 - RNA, 642 nt, synthetic construct
  misc_feature 1..642: note = derived and/or modified sequence opt6 from Abituzumab_LightChain1
  source 1..642: mol_type = other RNA
gacatacaaatgacacaatccccctcttcactatcagcatcagtaggagacagagtaacaataacctgtagagcatcacaagacatatcaaactacctagcatggtaccaacaaaaaccaggaaaagcaccaaaactattaatatactacacatcaaaaatccactcaggagtaccatcaagattctcaggatcaggatcaggaacagactacacattcacaatatcatcactacaaccagaagacatagcaacatactactgccaacaaggaaacacattcccatacacattcggacaaggaacaaaagtagaaataaaaagaacagtcgcagcaccatccgtattcatattcccaccatcagacgaacaattaaaatcaggaacagcatcagtagtctgcctattaaacaacttctacccaagagaagcaaaagtacaatggaaagtagacaacgcacttcaatcaggaaactctcaagaatcagtaacagaacaagactcaaaagactcaacatactcattatcctcaacactaaccctatccaaagcagactacgaaaaacacaaagtatatgcatgcgaagtaacacaccaaggactatcatcaccagtaaccaaatcattcaacagaggcgaatgc

SEQ ID NO: 45860 - RNA, 1332 nt, synthetic construct
  misc_feature 1..1332: note = derived and/or modified sequence opt6 from Abrilumab_HeavyChain1
  source 1..1332: mol_type = other RNA
caagtacaattagtacaatcaggagccgaagttaaaaaaccaggagccagtgtcaaagtatcatgcaaagtatccggctacactctatccgacttatctatacattgggtcagacaagcccctggcaaaggactagaatggatgggaggctttgatccacaagacggagaaaccatatacgctcaaaaattccaaggtcgagtaacaatgaccgaagatacctcaacagacacagcttacatggaactaagctccctaaaatccgaagacacagcagtttactattgcgcaacaggctcatcatcatcatggtttgacccctggggacaaggaaccttagtaacagtatcatcagcatcaacaaaaggcccatcagtcttcccactagccccatgctctcgatctacatcagaatctacagcagcactaggatgtttagtaaaagattacttcccagaaccagtaacagtaagctggaattcaggagcactaacatcaggagttcatacatttccagcagtcttacaatcaagtggactatattcactaagttccgtagtaacagtaccatccagcaactttggcacacaaacttacacctgtaacgtagaccataaaccaagtaatactaaagtagataaaacagtcgaaagaaaatgctgcgtagaatgcccaccatgcccagcaccaccagtcgcaggcccatcagttttcctctttccaccaaaaccaaaagacactctaatgatctcaagaacaccagaagttacctgtgtagtagtagatgtatcccacgaagatccagaagtacaattcaattggtacgtagatggagtagaggtacacaatgcaaaaacaaaacctagagaagaacaatttaactcaacctttagagtagtatcagttttaactgtagtacatcaagactggttaaacggaaaagaatataaatgcaaagtatcaaacaaaggattaccagcaccaatagaaaaaacaatatcaaaaacaaaaggacaaccaagagaaccccaagtatacacactccctccatcaagagaagaaatgactaaaaaccaagtctcactaacatgcctagtaaaaggattttatccaagcgacatagcagtagaatgggaaagtaacggccaaccagaaaataattataaaacaacaccaccaatgctagactccgatggatctttcttcttatactcaaaattaacagtagacaaatcaagatggcaacaaggaaacgtattttcatgcagcgtaatgcacgaagctttacacaaccactatactcaaaaatcactatccctctcaccaggaaaa

SEQ ID NO: 45861 - RNA, 642 nt, synthetic construct
  misc_feature 1..642: note = derived and/or modified sequence opt6 from Abrilumab_LightChain1
  source 1..642: mol_type = other RNA
gacatacaaatgacacaatcaccctcatcagtatcagcatcagtaggagaccgcgtaacaataacatgccgagcatcacaaggaatatcctcatggttagcatggtaccaacaaaaaccaggaaaagccccaaaactattaatatacggagcatcaaacttagaatcaggagtaccatcaagattctcaggctcaggatcaggaacagacttcacattaaccatatcatcactacaaccagaagactttgcaaattactactgccaacaagcaaactcattcccctggacattcggacaaggaacaaaagtcgaaataaaaagaacagtagcagcaccatcagtattcatattcccaccatcagacgaacaactaaaatcaggaacagcatccgtagtatgcctactaaacaacttctacccaagagaagccaaagtccaatggaaagtagataacgcactacaaagcggaaactcacaagaatcagtaacagaacaagactcaaaagactcaacatactcactatcatcaacattaaccctatcaaaagcagactacgaaaaacacaaagtatacgcatgcgaagtaacacaccaaggattatcatcaccagtaacaaaatcattcaacagaggcgaatgc

SEQ ID NO: 45862 - RNA, 639 nt, synthetic construct
  misc_feature 1..639: note = derived and/or modified sequence opt6 from Abrilumab_LightChain1_variant2
  source 1..639: mol_type = other RNA
caaatagtcctcacacaatcaccagcaataatgtcagcatcaccaggagaaaaagtcacaataacatgctccgcatcatcctcagtatcctatatgaactggttccaacaaaaaccaggaacatcaccaaaactatggatatactcaacatcaaacttagcatcaggagtaccagcaagattctcaggatcaggatcaggaacctcatactcactaacaatatcaagaatggaagcagaagacgcagcaacatactactgccaacaaagatcatcatacccaaatacattcggaggaggaacaaaattagaaataaaaagagcagacgcagcaccaacagtatcaatattcccaccatcatcagaacaattaacatcaggaggagcatcagtagtatgcttcctcaacaacttctacccaaaagacataaacgtaaaatggaaaatagacggatcagaaagacaaaacggagtcctaaattcatggacagaccaagactcaaaagactcaacatattcaatgtcatcaacactaacactaacaaaagacgaatatgaaagacacaactcatacacatgcgaagcaacacataaaacatcaacatccccaatagtaaaatcattcaacagaaacgaatgc

SEQ ID NO: 45863 - RNA, 1347 nt, synthetic construct
  misc_feature 1..1347: note = derived and/or modified sequence opt6 from Actoxumab_HeavyChain1
  source 1..1347: mol_type = other RNA
gaagtacaacttgtacagtcaggagccgaagtcaaaaaatcaggtgaatcactcaaaatctcctgcaaaggatcaggatactcattcacatcatactggattggatgggtaagacaaatgcccggcaaaggattagaatggatgggaatattttaccctggagactcctcaacacgctactcaccatctttccaaggacaagtaacaatatccgctgacaaatccgtaaatacagcatatctccaatggtcatcactaaaagcatcagacacagcaatgtactattgcgcaagaagaagaaactggggaaacgcattcgacatatggggacaaggaacaatggtcacagtttcatcagcatcgacaaaaggaccatctgtcttcccactagcaccatcatcaaaatcaacttctggaggaacagccgctctcggctgtttagtaaaagactattttccagaacctgtaacagtcagttggaactcaggagcattaacatcaggagtacacacatttccagccgttttacaatcatccggactttactcattgtcatcagtagtaacagtaccatcatcctcattaggcacacaaacatacatatgcaacgtaaatcacaaaccctcaaatacaaaagtcgacaaaagagtagaaccaaaatcatgcgacaaaacacatacttgtccaccatgtccagcaccagaattactaggaggtccctctgtctttttatttccaccaaaaccaaaagacacactaatgatatctcgtactccagaagtaacatgtgtcgtagtagacgtatctcacgaagaccctgaagttaaatttaactggtacgtcgacggcgtagaggtacacaacgccaaaactaaaccaagagaagaacaatataactcaacataccgagtagtatcagttttaactgtactacaccaagactggttaaatggtaaagaatataaatgcaaagtatcaaataaagcattaccagcaccaatagaaaaaaccatatctaaagcaaaaggacaaccaagagaaccacaagtatatacccttcccccatcacgagaagaaatgacaaaaaaccaagtatcactaacatgcttagttaaaggcttctatccctcagatatagcagtagaatgggaatcaaatggccaaccagaaaataattataaaaccacccccccagtactagactcagacggatctttttttctatactccaaactaacagtagataaatcaagatggcaacaaggcaatgttttttcttgctcagtaatgcatgaagctttacataaccactacacccaaaaatcactttcattatctccaggcaaa

SEQ ID NO: 45864 - RNA, 645 nt, synthetic construct
  misc_feature 1..645: note = derived and/or modified sequence opt6 from Actoxumab_LightChain1
  source 1..645: mol_type = other RNA
gaaatagtactaacacaatcaccaggcacactatcactatccccaggagaaagagcaactctatcttgtagagcatcacaatcagtatcatcatcatacctagcatggtaccaacaaaaaccaggacaagcaccaagattactaatatacggagcatcatcaagagcaacaggaatcccagacagattctccggatcaggatcaggaacagacttcaccctaacaataagcagactagaaccagaagacttcgcagtatactactgccaacaatacggatcatcaacatggacattcggacaaggaacaaaagtagaaatcaaacgcacagtagccgcaccatccgtattcatattcccaccctcagacgaacaactaaaatcaggaacagcatcagtagtatgtttattaaacaacttctacccacgagaagccaaagtacaatggaaagtagacaacgcactacaatcaggaaactcacaagaatcagtaacagaacaagactcaaaagactcaacatactcactctcatctacattaacactatcaaaagcagattacgaaaaacacaaagtatatgcatgcgaagttacacaccaaggattatcttccccagtaacaaaatcattcaacagaggagaatgc

SEQ ID NO: 45865 - RNA, 672 nt, synthetic construct
  misc_feature 1..672: note = derived and/or modified sequence opt6 from Adalimumab_HeavyChain
  source 1..672: mol_type = other RNA
gaagtacaactagtagaatcaggaggcggattagtccaacccggaagatcactaagattatcatgtgcagcatcaggattcacattcgatgactacgcaatgcattgggtaagacaagcaccaggaaaaggactagaatgggtatcagcaataacatggaactcaggacacatagactacgcagactcagtagaaggaagatttacaatatcaagagacaacgcaaaaaactcactatatctacaaatgaattcattacgagcagaagacacagcagtatactactgcgcaaaagtatcatacctatcaacagcatcatcattagactattggggacaaggaacacttgttacagtaagttcagcatcaacaaaaggaccatcagtattcccactagcaccatcatcaaaaagtacaagcggaggaacagcagcactaggatgccttgtaaaagactacttcccagaaccagtaacagtatcatggaactccggagcactaacaagcggagtacacacattcccagctgtactacaatcatcaggattatactcactatcatcagtagtaacagtaccatcatcatccttaggaacacaaacatatatatgcaatgtaaaccacaaaccatcaaacacaaaagtagacaaaaaagtagaaccaaaatcatgc

SEQ ID NO: 45866 - RNA, 642 nt, synthetic construct
  misc_feature 1..642: note = derived and/or modified sequence opt6 from Adalimumab_LightChain
  source 1..642: mol_type = other RNA
gatatacaaatgacacaatcaccctcctcactatcagcctcagtaggagacagagtaactataacatgtagagcatcacaaggaatccgaaactacttagcatggtaccaacaaaaaccaggaaaagcaccaaaattactaatatacgcagcatcaacattacaatcaggagtaccatcaagattctcaggatcaggatcaggaacagacttcacactaacaatatcatcactacaacccgaagacgtagcaacatattactgccaaagatacaacagagcaccatacacattcggacaaggaacaaaagtagaaataaaacgaactgtcgcagcaccatccgtattcatattcccaccctctgacgaacaattaaaatcaggaacagcatcagtcgtatgcctactaaataacttctacccacgagaagcaaaagttcaatggaaagtcgacaacgcattacaatctggaaactcacaagaatcagtaacagaacaagactcaaaagactcaacatactccctatcatcaactctaacattatcaaaagcagactacgaaaaacacaaagtatacgcatgcgaagtaacccaccaaggactatcctcaccagtaacaaaatcatttaacagaggcgaatgc

SEQ ID NO: 45867 - RNA, 1359 nt, synthetic construct
  misc_feature 1..1359: note = derived and/or modified sequence opt6 from Aducanumab_HeavyChain1
  source 1..1359: mol_type = other RNA
caagttcaactcgtagaatcaggaggcggagtagtacagccaggaagatccctcagactttcatgcgctgcatccggatttgcattttcctcatacggaatgcactgggtacgacaagcaccaggcaaaggactcgaatgggtagccgtaatttggttcgacggaaccaaaaaatactatacagattccgttaaaggaagatttacaatatctagagacaactctaaaaacacactatatttacaaatgaacacactaagagccgaagatacagcagtatactactgtgcacgagatcgaggaataggagcgagaagaggtccatattacatggatgtatggggtaaaggaaccaccgtcacagtatcctcagcatccactaaaggaccatcagtatttcccctcgcccccagctcaaaatcaacatcaggaggtactgcagcactaggatgcctagtaaaagactattttccagaaccagttacagtatcatggaattcaggcgcattaacatccggagtacatacatttccagcagtacttcaatcttcaggattatatagtctatcttcagtagtaacagtcccttcatcgtcccttggtactcaaacatacatatgcaacgtaaaccacaaaccatcaaacacaaaagtagacaaacgagttgaaccaaaatcctgtgacaaaacacatacatgcccaccatgtcccgcacccgaactactaggcggaccatcagtatttctatttccaccaaaaccgaaagacacattaatgatatcacgcacaccagaagtaacctgcgtagtagtagatgttagtcacgaagatccagaagtaaaattcaactggtatgttgatggtgtagaagttcataatgcaaaaacaaaaccaagagaagaacaatacaattcaacatatagagtagtatcagtcctaaccgtattacatcaagactggctcaacggaaaagaatacaaatgcaaagtctccaacaaagcactaccagccccaatagaaaaaacaatatcaaaagctaaaggccaaccgagagaaccacaagtatatactctaccaccatcacgagaagaaatgacaaaaaaccaagtttcacttacctgcttagtaaaaggattctacccatcagacatagcagttgaatgggaatcaaacggacaaccagaaaataattacaaaaccacacctccagtactagattcagacggatcctttttcctatattcaaaactaacagtcgacaaatccagatggcaacaaggtaatgtcttctcatgttcagtaatgcacgaagcattacacaaccattacacacaaaaaagcttatccctatcaccagga

SEQ ID NO: 45868 - RNA, 642 nt, synthetic construct
  misc_feature 1..642: note = derived and/or modified sequence opt6 from Aducanumab_LightChain1
  source 1..642: mol_type = other RNA
gacatacaaatgacacaatcaccatcatccctaagcgcatcagtaggcgaccgagtaacaataacatgccgcgcatcacaatcaatatcatcatacctaaactggtaccaacaaaaaccaggaaaagcacccaaactactaatatacgccgcatcatcattacaatcaggagtaccaagcagattctcaggatcaggatcaggaacagacttcacactaaccatatcatcactacaaccagaagacttcgcaacatactactgccaacaatcatactcaacaccactaacattcggaggcggaacaaaagtagaaataaaaagaacagtagccgcaccatccgtattcatattcccaccatcagacgaacaactaaaatcaggaacagcatcagtagtatgcttactaaacaacttctacccaagagaagccaaagtccaatggaaagttgacaacgcactacaatcaggaaactcacaagaatcagtaaccgaacaagactcaaaagactcaacatactcattatcctccacactaaccttatcaaaagcagactacgaaaaacacaaagtatacgcctgcgaagtcacccaccaaggactatcatcacccgtaaccaaatcattcaatagaggagaatgc

SEQ ID NO: 45869 - RNA, 1359 nt, synthetic construct
  misc_feature 1..1359: note = derived and/or modified sequence opt6 from Afasevikumab_HeavyChain1
  source 1..1359: mol_type = other RNA
gaagtacaactagtagaatctggaggaggactagtacaaccaggaagatcattacgattatcctgcgcagcatctggatttacatttgacgactacgccatgcattgggtcagacaagcaccaggaaaaggtctagaatgggtctcaggaataaactggagctcgggaggaataggttatgcagactctgtaaaaggaagattcacaataagtagagataacgcaaaaaattcattatatttacaaatgaactccctaagagctgaagacacagccttatactattgtgctagagatatcggtggatttggtgaattctattggaactttggactatggggacgtggaacactagtaactgtatcatccgcaagtacaaaaggaccttcagttttcccattagcaccctcaagcaagtcaacatcaggaggcacagcagcactaggatgcttagttaaagactatttccctgaacctgtaacagtttcatggaatagcggagcactaactagcggagtacacacgttccccgccgttctacaatcatcaggactttactcactatcatcagttgtcactgtacctagttcctcattaggaacacaaacatacatatgcaatgtaaaccataaaccatcaaacaccaaagtagataaaagagtagaaccaaaatcctgtgataaaacacatacttgcccaccttgtccagcaccagaactattaggaggaccatcagtatttttatttccacctaaacctaaagatacattaatgatatcaagaacaccagaagtaacatgtgtagtagtagatgtttcccacgaggatccagaagttaaatttaactggtacgtagatggagtagaagtacacaacgcgaaaacaaaaccaagagaagaacaatataattcaacatacagagttgtttcagtcctaacagtattacaccaagattggctcaatggaaaagaatataaatgcaaagtatcaaacaaagccctaccagccccaatagaaaaaacaatatctaaagctaaaggacaacctagagaaccacaagtttatacattacccccaagtagagaagaaatgacaaaaaaccaagtatcattaacatgtctcgtaaagggattttatccaagtgacatagccgttgaatgggaatcaaatggtcaaccagaaaacaactataaaactacaccacccgttctagattcagatggatcattctttttatatagtaaactaacagtagataaatctagatggcaacaaggaaatgtatttagctgttctgtaatgcatgaagctctacacaatcattacacacaaaaatcacttagtctatcaccaggaaaa

SEQ ID NO: 45870 - RNA, 645 nt, synthetic construct
  misc_feature 1..645: note = derived and/or modified sequence opt6 from Afasevikumab_LightChain1
  source 1..645: mol_type = other RNA
gaaatagtactaacccaatcaccagcaacactatccctatcaccaggagaaagagcaacactatcatgccgagcatcacaatcagtaagatcatacctagcatggtatcaacaaaaaccaggacaagcaccaagactactaatatacgacgcatccaacagagccacaggaataccagcaagattctcaggaagcggatcaggaacagactttacactaacaatatcatcactagaaccagaagacttcgcagtatactactgccaacaaagatcaaactggccaccagcaacattcggaggaggaacaaaagtagaaataaaaagaacagtagcagcaccatcagtattcatcttcccaccatcagacgaacaattaaaatccggaaccgcatcagtagtatgcttactaaataacttctacccacgagaagcaaaagtacaatggaaagtagacaacgcactacaatcaggaaactcacaagaatcagtaacagaacaagactcaaaagactcaacatactcactatcatcaacattaacactatcaaaagcagactacgaaaaacacaaagtatacgcatgcgaagtaacacaccaaggattatcatctccagtaacaaaatcattcaatagaggagaatgc

SEQ ID NO: 45871 - RNA, 1293 nt, synthetic construct
  misc_feature 1..1293: note = derived and/or modified sequence opt6 from Aflibercept_Fusion_protein1
  source 1..1293: mol_type = other RNA
tctgacacaggaagaccatttgtagaaatgtactcagaaataccagaaataatacacatgaccgaaggaagagaacttgtcatcccatgcagagtaacatcaccaaatataacagtaacactaaaaaaatttccactagacacactaatcccagacggaaaaagaataatatgggactcaagaaaaggatttataatatcaaatgccacatacaaagaaataggactactaacttgcgaagcaacagtaaatggacatttatataaaacaaactatctaacacatagacaaacaaataccataatagacgtagttctatccccctctcacggaatagaattatcagtaggagaaaaactcgtattaaactgcacagcacgaaccgaactaaatgtaggaatagacttcaattgggaatatccatcatcaaaacatcaacacaaaaaactagtcaacagagatctaaaaacccaatcaggctcagaaatgaaaaaattcctatccacattaacaatagatggcgtcacccgttcagatcaaggactatacacatgcgctgcctcatcaggcctaatgacaaaaaaaaattcaaccttcgtaagagtccatgaaaaagataaaacccacacatgtccaccctgcccagcaccagaactactaggaggaccatcagttttcttattcccaccaaaaccaaaagacaccttaatgatctcacgcacaccagaagtaacatgcgtagttgtagacgtatcacatgaagatcctgaagtaaaatttaattggtacgtagatggagtagaagtacacaacgcaaaaacaaaaccaagagaagaacaatacaactccacatacagagtagtcagtgtattaaccgtcctacaccaagactggctaaacggaaaagaatacaaatgcaaagtaagcaataaagcacttccagcccctattgaaaaaacaatatccaaagcaaaaggacaaccaagagaaccacaagtttacacactacctccatctagagacgaactcacaaaaaaccaggtctccctcacctgcctagtaaaaggattctacccctcagacatagcagtagaatgggaatccaacggacaaccagaaaataattacaaaactactccaccagtattagactctgatggatcattcttcctctatagtaaacttaccgtagataaatcaagatggcaacaaggaaacgtcttcagctgtagcgtaatgcacgaagccttacacaatcactacacacaaaaaagcctatccttatcaccagga

SEQ ID NO: 45872 - RNA, 1332 nt, synthetic construct
  misc_feature 1..1332: note = derived and/or modified sequence opt6 from Afutuzuab_HeavyChain1
  source 1..1332: mol_type = other RNA
caagttcaattagtacaatcaggagccgaagtcaaaaaaccaggatcatcagtaaaagtatcctgcaaagcatctggatacgcctttagttactcatggattaattgggtaagacaagctccaggacaaggattagaatggggtagaatatttcccggagatggcgacaccgattacaacggaaaattcaaaggaagagtaacaataacagcagacaaatcaacatctacggcatatgaactatcttcgctaagatctgaagacacagctgtatattattgtgcaagaaacgttttcgacggatactggttagtatactggggccaaggaacactagtaacagtctcttcagcatcaacaaaaggaccatctgtattcccattagcaccatctagcaaatctacatcgggaggaactgcagcactaggatgtttagttaaagattactttcccgaaccagtaacagtctcatggaattcaggagccctaacaagcggagtacatacatttccagcagtattacaatcatcaggattatactccttatccagcgtagtaacagtaccatcatcatctttaggcacacaaacatatatatgtaacgtcaaccataaaccatcaaatacaaaagttgataaaaaagtcgaacctaaatcatgtgataaaactcacacatgtccaccatgcccagcaccagaattactaggaggaccttccgtcttcttatttcctccaaaacccaaagacacattaatctcacgtacaccagaagtaacatgcgtagtagtcgatgtatctcacgaagacccagaagttaaatttaactggtatgttgacggagtagaagtacataatgcaaaaaccaaaccaagagaagaacaatataattcaacttacagagtagtatcagtactaactgtactccaccaagattggcttaacggaaaagaatacaaatgtaaagtctcaaataaagcactacctgcaccaatagaaaaaactatatctaaagccaaaggccaacctagagaaccacaagtatatacacttcccccctccagagatgaattaacaaaaaatcaagttagcctaacatgtttagtaaaaggattttatccatcagatatagcagtagaatgggaaagtaatggtcaaccagaaaataattataaaacaacacctccagtattagattcagacggatcattctttctctattccaaattaaccgtagataaatctcgatggcaacaaggaaacgtattttcatgcagcgtacacgaagcattacacaatcactacactcaaaaatctttaagtctctcaccagga

SEQ ID NO: 45873 - RNA, 651 nt, synthetic construct
  misc_feature 1..651: note = derived and/or modified sequence opt6 from Afutuzuab_LightChain1
  source 1..651: mol_type = other RNA
gacatagtaacccaaacaccactatcactaccagtaacaccaggagaaccagcatcaatatcatgcagatcatcaaaatcactactacactctaacggaataacatacctatattggtacctccaaaaacccggacaaagcccacaactactaatataccaatccaatctagtatcaggagtaccagacagattctcaggatcaggatcaggaacagacttcacactaaaaatatcaagagtagaagccgaagacgtaggagtatactactgtgcacaaaacctagaattaccatacacattcggaggaggaacaaaagtagaaataaaaagaacagtagcagcaccatcagtattcatattcccaccatcagacgaacaactaaaatccggaacagcatcagtagtatgcttactaaacaacttctacccacgcgaagcaaaagtacaatggaaagtcgacaacgcattacaatccggaaactcacaagaatcagtaacagaacaagactcaaaagactcaacatactcactatcatcaacactaacattaagcaaagcagactacgaaaaacacaaagtatatgcatgcgaagttacacaccaaggattatcctcaccagtaacaaaatcattcaacagaggagaatgt

SEQ ID NO: 45874 - RNA, 1347 nt, synthetic construct
  misc_feature 1..1347: note = derived and/or modified sequence opt6 from Afutuzumab_HeavyChain1
  source 1..1347: mol_type = other RNA
caagtacaattggttcaatccggtgctgaagtaaaaaaaccaggatccagcgtaaaagtatcatgtaaagcaagcggctacgctttctcctattcatggattaactgggtaagacaagcacccggccaaggtttagaatggatgggaagaatattcccaggcgatggtgacacagattacaacggaaaattcaaaggaagagtaacaataactgctgacaaatcaacatccacagcatatatggaactctcatcacttagatctgaagacacagcagtctactattgtgccagaaacgtattcgatggatattggttagtttactggggacaaggcacattagtaaccgtatcatcagcatcaacaaaaggtccatcagtttttccattagccccatcctctaaatcaacatcaggaggaacagcagcactaggatgtctagttaaagattactttccagaacccgtaacagtcagctggaactctggagccctaacttcaggagttcacacatttccagcagtactacaatcttcaggtctatactcactctcatcagtagttaccgtaccctcatcatcactaggtacacaaacatacatatgtaacgtaaaccacaaaccatccaacacaaaagtagataaaaaagtagaaccaaaatcctgtgacaaaacacatacatgccctccatgccctgctccagaactactaggaggtccatcagtattcttattcccaccaaaaccaaaagatacactaatgatatcaagaactccagaagtaacatgtgtagttgtcgatgttagccacgaagatccagaagtaaaattcaactggtacgtagatggagtagaagtacacaacgcaaaaactaaaccaagagaagaacaatataactcaacataccgcgtagtatccgtacttacagtactacaccaagattggttaaacggtaaagaatataaatgcaaagtctcaaataaagcattaccagcaccaatcgaaaaaacaatatcaaaagccaaaggacaacctagagaaccacaagtatatactctacctccatcaagagacgaattaacaaaaaaccaagtatcactaacatgccttgtcaagggattttatccatcagacatagcagtcgaatgggaatcaaatggacaaccagaaaacaattacaaaactacaccaccagttttagacagtgatggctcattcttcttatactcaaaactaacagtagacaaaagccgatggcaacaaggtaacgttttctcatgttctgtcatgcatgaagccctacacaaccactacacacaaaaatcattatccctgtccccaggaaaa

SEQ ID NO: 45875 - RNA, 657 nt, synthetic construct
  misc_feature 1..657: note = derived and/or modified sequence opt6 from Afutuzumab_LightChain1
  source 1..657: mol_type = other RNA
gacatagtaatgacacaaaccccattatcactaccagtcaccccaggagaaccagcatcaatatcttgtagatcatcaaaatcactcctacactcaaacggaataacatacctatactggtatctacaaaaaccaggacaatcaccacaactactaatataccaaatgtcaaacctagtatcaggagtaccagacagattttcaggatcaggatcaggcacagacttcacattaaaaatatcaagagtagaagcagaagacgtaggagtatactactgcgcacaaaacttagaactaccatacacattcggaggaggaaccaaagtagaaataaaaagaacagtcgcagcaccatcagtattcatatttccaccatccgacgaacaactaaaatcaggaacagcatcagtagtctgcctactaaacaacttctacccaagagaagcaaaagtccaatggaaagtagacaatgcactacaatcaggaaattcacaagaatccgtaacagaacaagacagcaaagactcaacatactcactatcatcaacactaactttatcaaaagcagactacgaaaaacacaaagtatacgcatgcgaagtcacacaccaaggactatcctcacctgtaacaaaatcattcaacagaggagaatgc

SEQ ID NO: 45876 - RNA, 684 nt, synthetic construct
  misc_feature 1..684: note = derived and/or modified sequence opt6 from Alacizumab_pegol_HeavyChain1
  source 1..684: mol_type = other RNA
gaagtacaactagtagaatcaggaggaggattagtacaaccaggcggtagtctaagactatcatgcgcagcatcaggattcacattctcatcatatggaatgtcatgggtacgacaagcaccaggaaaaggactagaatgggtagcaacaataacatcaggaggaagctacacttactatgtagatagcgtaaaaggaagatttacaatttcaagagacaacgcaaaaaacacattatatttacaaatgaattcattaagagcagaagatacagctgtatattactgtgtaagaataggagaagatgcactagactattggggacaaggaacattagtaactgtctcaagcgcatcaacaaaaggaccatcagtatttccattagccccaagtagcaaatcaacatcaggaggaacagcagcattaggatgtttagtaaaagattactttccagaaccagtaaccgtatcatggaactcaggagcactaacatcaggtgtacatacatttccagcagtattacaatcatccggattatattcattatcaagtgtagtaacagtaccaagttcatcactaggaacacaaacatatatatgtaatgtaaatcacaaaccatcaaatacaaaagtcgataaaaaagtagaaccaaaatcatgtgataaaacacatacatgtgcagca

SEQ ID NO: 45877 - RNA, 642 nt, synthetic construct
  misc_feature 1..642: note = derived and/or modified sequence opt6 from Alacizumab_pegol_LightChain1
  source 1..642: mol_type = other RNA
gacatacaaatgacacaatcaccatccagcttatccgcatccgtaggagacagagtaacaataacatgcagagcaagccaagacatagcaggttcactaaactggctacaacaaaaaccaggcaaagcaataaaaagattaatatatgcaacaagctcactagactcaggagtacccaaaagattctccggatcaagatcaggatcagattacacattaacaataagctcactacaaccagaagacttcgccacatactactgcctacaatacggatcattcccaccaacattcggacaaggaaccaaagtagaaataaaaagaacagtagcagcaccatcagtattcatattcccaccatcagacgaacaactaaaatctggaacagcatcagtagtatgcttactaaacaacttctacccaagagaagcaaaagtacaatggaaagtcgacaacgcactacaatcaggaaactcacaagaatccgtaacagaacaagactcaaaagactcaacatactcactatcatccacactaacactatcaaaagcagactacgaaaaacacaaagtatacgcatgcgaagtaacacaccaaggactaagctcaccagtaacaaaatccttcaacagaggagaatgc

SEQ ID NO: 45878 - RNA, 1353 nt, synthetic construct
  misc_feature 1..1353: note = derived and/or modified sequence opt6 from Alemtuzumab_HeavyChain
  source 1..1353: mol_type = other RNA
caagtacaactacaagaatcaggtccaggtctagttagaccatctcaaaccttatccttaacatgcacagtaagtggattcaccttcacagacttctacatgaactgggtacgacaacctcctggaagaggactcgaatggataggattcattagagataaagcaaaaggatacacaacagaatacaacccatcagtaaaaggtcgagtaacaatgctagtagacacatccaaaaatcagttctccttaagactatcatcagtaacagccgcagacacagcagtctactactgtgctcgcgaaggacacacagccgccccatttgactactggggacaaggatccctagtaaccgtatcttcagcctcaacaaaaggaccatctgtcttcccactagcaccttcaagcaaatctacatctggaggaacagcagccctaggttgtctagtaaaagactacttcccagaaccagtaacagtatcttggaactctggcgcattaacttcaggagtacatacattccctgctgtactacaatcatcaggattatattcattatcatctgtagtaacagtaccctcatcatcattaggcacacaaacatatatatgtaatgtaaaccacaaaccatccaataccaaagtcgataaaaaagttgaaccaaagtcatgcgacaaaacacatacatgtccaccatgcccagcaccagaactactaggaggaccatccgtatttttattcccacccaaaccaaaagacaccctaatgatatcaagaaccccagaagtaacatgcgtagttgtcgacgtatcacacgaagacccagaagtaaaattcaactggtatgtagatggagttgaagtacacaatgcaaaaacaaaaccaagagaagaacaatacaactcaacatacagagtagtctcagtactaaccgtactacatcaagactggttaaatggaaaagaatacaaatgtaaagtatcaaataaagcactaccagcaccaatagaaaaaactatatccaaagcaaaaggacaaccaagagaacctcaagtctacacactaccaccatcaagagacgaactaacaaaaaaccaagtatcacttacctgccttgttaaaggcttctacccaagtgatatagcagtagaatgggaatcaaatggacaaccagaaaacaactacaaaaccacacctccagtactagactcagacggttcattcttcctctactctaaattaaccgtagataaatcacgttggcaacaaggaaacgtattcagttgctccgttatgcacgaagcactacacaaccactacacccaaaaatcactctcactatcaccaggaaaa

SEQ ID NO: 45879 - RNA, 657 nt, synthetic construct
  misc_feature 1..657: note = derived and/or modified sequence opt6 from Alemtuzumab_HeavyChain_variant_1bey_H
  source 1..657: mol_type = other RNA
caagtacaattacaagaatcaggaccaggcttagtaagaccatcccaaacattatccctaacatgtacagtatcaggctttactttcacagacttctacatgaactgggtaagacaacctccaggaagaggactagaatggataggatttataagagacaaagcaaaaggatacacaactgaatataacccatcagtaaaaggaagagttacaatgctagtagacacttcaaaaaaccaattctcactaagactatcatcagtaacagcagcagatacagcagtatactactgcgcaagagaaggacacacagcagctccattcgactactggggacaaggatcactagtaacagtatcctcagcatcaacaaaaggaccatcagtatttccattagcaccatcctcaaaatcaacatcaggaggaacagccgcactaggatgcctagtaaaagattacttcccagaaccagtaacagtctcatggaactctggagcactaacatccggtgtacacacatttccagcagtactacaatcatcaggactatattcattatcatcagtagtaacagttccctcatcatcactaggaacacaaacatacatatgtaacgtaaaccacaaaccttcaaacacaaaagtagacaaaaaagta

SEQ ID NO: 45880 - RNA, 660 nt, synthetic construct
  misc_feature 1..660: note = derived and/or modified sequence opt6 from Alemtuzumab_HeavyChain_variant_1ce1_H
  source 1..660: mol_type = other RNA
caagtacaattacaagaatccggaccaggactagtaagaccatcacaaacactatcattaacatgcacagtatccggattcacattcacagacttttatatgaactgggtaagacaaccaccaggaagaggactagaatggataggattcatcagagataaagcaaaaggatacacaacagaatacaacccatcagtaaaaggtagagtaacaatgctagtagacacctcaaaaaaccaattctcactcagactatcctcagtaacagcagcagacaccgcagtatattactgcgcacgagaaggacacacagcagcaccattcgactactggggacaaggatccttagtaacagtatcttcagcatcaacaaaaggaccatctgtatttccattagcaccatcatctaaatcaacatcaggaggaacagcagcactaggatgcctagtaaaagactattttccagaaccagtaacagtctcatggaactcaggagcattaacatccggagtacacacattcccagcagtattacaatcatcaggcctatactcattatcatcagtagtaacagtaccatcctcctcactaggaacacaaacatacatatgcaacgtaaaccacaaaccatcaaacacaaaagtagacaaaaaagtagaa

SEQ ID NO: 45881 - RNA, 1311 nt, synthetic construct
  misc_feature 1..1311: note = derived and/or modified sequence opt6 from Alemtuzumab_HeavyChain_variant_8005_H
  source 1..1311: mol_type = other RNA
caagtgcaattacaagaatcaggaccaggactcgtcagaccatcacaaacattatcactaacctgcactgtttcaggattcacatttacagacttctacatgaattgggtaagacaaccaccaggcagaggcttagaatggataggattcataagagacaaagcaaaaggatacaccacagaatacaacccatcagtaaaaggaagagttacaatgttagtagacacatctaaaaatcaattttcactacgtctctcatcagtcacagctgcagacaccgcagtatactattgcgcaagagaaggacacacggcagcaccattcgattattggggccaaggatcactagtaacagtaagttctgcatcaaccaaaggaccatctgtctttccactagccccatcatcaaaatcaacttcaggcggaacagcagcactaggttgcttagtaaaagactacttcccagaaccagtaaccgtatcttggaactcaggagcacttacatcaggagtacacactttcccagctgtactacaatcatcaggcctttactcactgtcttcagtagtaaccgtaccttcatcatcattaggcacacaaacatacatatgcaacgtaaaccacaaaccatcaaacacaaaagtagacaaaaaagtagaagcacccgaactactaggaggaccatcagtatttctctttccacccaaaccaaaagacacactcatgatttcaagaaccccagaagtaacctgtgtagtagttgatgtttcccacgaagatccggaagttaaatttaactggtacgtagacggcgttgaagttcataatgcaaaaaccaaaccaagagaagaacaatataactcaacttatagagtagtatcagttcttacagtactacatcaagattggttaaatggaaaagaatataaatgcaaagtatcaaacaaagcattaccagcaccaatagaaaaaacaatatctaaagcaaaaggacaaccaagagaaccacaagtatacacattaccaccatcccgagacgaattaacaaaaaaccaagtatcattaacatgcctagtaaaaggattttatccatcagatatagcagtagaatgggaatctaacggtcaaccagaaaacaactataaaactactccaccagtcttagactcagacggatcttttttcctttattcaaaattaaccgtagacaaatcacgatggcaacaaggaaacgtattctcctgttctgtaatgcatgaagccttacataatcattacacacaaaaatcactatctttatcaccaggaaaa

SEQ ID NO: 45882 - RNA, 633 nt, synthetic construct
  misc_feature 1..633: note = derived and/or modified sequence opt6 from Alemtuzumab_LightChain
  source 1..633: mol_type = other RNA
gacatacaaatgacacaatcaccatcatcactatcagcatcagtaggagatagagtaacaatcacatgcaaagcatcacaaaacatagacaaatatctaaactggtaccaacaaaaaccaggaaaagcacccaaactcctcatatacaacacaaacaacctacaaaccggagtaccatcacgattctcaggatcaggatcaggaacagactttacattcacaatatcatcattacaacctgaagacatagcaacatattactgcctacaacatatatcaagaccaagaacattcggacaaggaacaaaagtagaaataaaaagaacagtagcagcaccatcagtattcatattcccaccctcagacgaacaactaaaatcaggaacagcatcagtagtatgcctactaaacaacttctacccaagagaagcaaaagtacaatggaaagtagacaacgcactacaatccggaaactcccaagaatcagtaacagaacaagactcaaaagactcaacatactccctaagctcaacactaacattatcaaaagcagactacgaaaaacacaaagtatacgcatgcgaagtaacccaccaaggactctcatcacccgtaacaaaatccttcaaccga

SEQ ID NO: 45883 - RNA, 642 nt, synthetic construct
  misc_feature 1..642: note = derived and/or modified sequence opt6 from Alemtuzumab_LightChain_variant_8005_L
  source 1..642: mol_type = other RNA
gacatacaaatgacacaatccccatcatcactatccgcatcagtaggagacagagtaacaataacatgcaaagcatcacaaaacatagacaaatacctaaactggtaccaacaaaaaccaggaaaagcaccaaaactactaatctacaacacaaacaacctacaaacaggagtaccctcaagattctcaggatcaggatcaggaacagactttacattcacaatatcatcactacaaccagaagacatagcaacatactactgcctacaacatatatcacgcccaagaacattcggacaaggaacaaaagtagaaataaaaagaacagtagcagcaccatcagtattcatattcccaccatcagacgaacaactaaaatcaggaacagcatcagtcgtatgcctactaaacaacttctacccaagagaagcaaaagtacaatggaaagtagataacgcactacaatccggaaactcacaagaatcagtaacagaacaagactccaaagactcaacatactcattatcatccacactaacactatcaaaagcagactacgaaaaacacaaagtatacgcatgcgaagtaacacaccaaggactatcatcaccagtaaccaaatcattcaacagaggcgaatgc

SEQ ID NO: 45884 - RNA, 1341 nt, synthetic construct
  misc_feature 1..1341: note = derived and/or modified sequence opt6 from Alirocumab_HeavyChain1
  source 1..1341: mol_type = other RNA
gaagtacaattagtagaatccggcggcggactagttcaaccaggaggatcactaagactatcatgtgcagcctcaggattcaccttcaacaattacgcaatgaattgggtaagacaagcaccaggaaaaggcctagactgggtcagtaccataagtggttctggaggaacaaccaactacgcagatagcgtaaaaggaagatttatcatctcaagggactcatcaaaacacacattatacttacaaatgaactcactaagagcagaagacacagcagtatattactgtgcaaaagactcaaattggggaaattttgatctatggggaagaggcaccttagtaacagtatcatcagcatctaccaaaggaccatccgtattcccactagcaccatcctcaaaatcaacctcaggaggaacagcagccctaggatgcttagtcaaagactatttccccgaaccagttacagtatcctggaattcaggcgcattaacatcaggtgtacacaccttcccagcagtattacaatcatcaggtttatactcactaagttccgtagtaacagtaccatcatcatcattaggcactcaaacatacatctgtaacgtaaaccataaaccatcaaacacaaaagtagacaaaaaagtagaaccaaaaagttgcgacaaaacacacacatgcccaccctgtccagctccagaactactaggaggaccatcagtttttctatttcccccaaaaccaaaagacacactaatgatatccagaacaccagaagtaacttgtgtcgtagtagacgtatcacacgaagatccagaagtcaaattcaattggtacgtcgacggtgtagaagtgcataacgcaaaaaccaaaccaagagaagagcaatacaattccacatatagagttgtatccgtcctaacagttctccaccaagattggcttaacggaaaagaatacaaatgtaaagtatcaaacaaagccttacccgcacccatagaaaaaaccatctccaaagcaaaaggacaaccaagagaaccacaagtatatacactcccaccctcaagagacgaactaactaaaaatcaagtatcacttacctgtctagtaaaaggtttctacccatctgatatagcagtagaatgggaatctaatggacaaccagaaaacaactacaaaacaacaccaccagtactagactccgacggcagcttcttcttatactcaaaactaacagtagacaaatcaagatggcaacaaggaaacgtattttcatgttcagtaatgcatgaagctctacacaatcactatacccaaaaatcattatctttaagcccaggc

SEQ ID NO: 45885 - RNA, 660 nt, synthetic construct
  misc_feature 1..660: note = derived and/or modified sequence opt6 from Alirocumab_LightChain1
  source 1..660: mol_type = other RNA
gatatagtaatgacacaatcaccagactcactagccgtaagcctaggcgaaagagcaacaataaactgcaaatcaagccaatcagtactatatcgatcaaataaccgaaacttcctaggatggtaccaacaaaaaccaggacaaccaccaaacctactaatatactgggcaagcacaagagaaagcggagtaccagacagattctcaggatcaggatcaggaacagacttcacactaacaatatcatcactacaagcagaagacgtagcagtctactactgccaacaatactacacaacaccatacacattcggacaaggaacaaaactagaaattaaaagaacagtcgcagcaccatccgtattcatattcccaccctcagacgaacaattaaaatcaggcacagcatcagtagtatgtttactaaacaacttttacccacgagaagcaaaagtacaatggaaagtagataacgcactacaatcaggaaactcacaagaaagcgtaacagaacaagactcaaaagactcaacctactcactatcatcaacactaactttatcaaaagcagactacgaaaaacacaaagtatacgcatgcgaagtcacacaccaaggcttatcctcaccagtaaccaaaagcttcaacagaggagaatgc

SEQ ID NO: 45886 - RNA, 735 nt, synthetic construct
  misc_feature 1..735: note = derived and/or modified sequence opt6 from ALX-0061_HeavyChain1
  source 1..735: mol_type = other RNA
gaagtacaactagttgaatcaggtggaggattagtacaaccaggaggaagtttaagattaagttgtgcagcaagtgggagtgtatttaaaataaacgttatggcatggtatagacaagcacctggaaaaggaagagaattagtagcaggaataataagtggaggatcaacaagttatgcagatagtgtaaaaggaagatttacaatatcaagggataatgcaaaaaatacattatatttacaaatgaatagtttaagaccagaagatacagcagtatattactgtgcatttattacaacagaatcagattatgatttaggaagaagatattggggacaaggaacactagtaacagtaagcagcggaggagggggatcaggaggaggaagtgaagtgcaattagtagaaagtggaggagggttagtacaaccaggaaatagtttaagattaagctgtgcagcaagtggatttacattcagtagctttggaatgtcatgggtacgacaagcaccaggaaaaggattagaatgggtaagcagtataagcggatcaggaagtgacacattatatgcagatagtgtgaaaggaagattcactataagtagggacaatgcaaaaacaacattatatctacaaatgaatagcttaagaccagaagatacagcggtatattattgtacaataggaggaagcttatcaagaagctcacaaggaacattagtaacagtaagtagt

SEQ ID NO: 45887 - RNA, 1347 nt, synthetic construct
  misc_feature 1..1347: note = derived and/or modified sequence opt6 from Amatuximab_HeavyChain1
  source 1..1347: mol_type = other RNA
caagtacaattacaacaatccggcccagaactagaaaaaccaggtgcctcagtaaaaatatcatgcaaagccagcggttacagcttcacaggatacacaatgaattgggtcaaacaatctcacggaaaaagcctagaatggataggcctaataaccccatacaacggcgcatcatcttataaccaaaaattcagaggaaaagctacattaaccgtagacaaatcatcatcaacagcatatatggacctcctatcactaacatcagaagattcagcagtatacttttgcgccagaggcggatacgacggacgaggattcgactattggggatcaggaaccccagttacagtatcatcagcatcaactaaaggaccctcagtattccctctagcaccctcatcaaaatccacctcaggaggtacagccgcactaggttgccttgtaaaagactacttcccagaaccagtcaccgtatcctggaattcaggagcattaaccagtggagtacacaccttccccgcagtcctacaatcgtcaggactctattctctatcctcagtagtaaccgtaccatcatcatcactaggcacacaaacttatatatgcaacgtaaatcacaaaccatccaataccaaagtagacaaaaaagtagaaccaaaatcatgtgacaaaacccacacatgtcctccatgtccagcaccagaattacttggaggaccatccgtatttctatttcccccaaaaccaaaagatacacttatgatttcaagaactccagaagtaacatgcgtagtcgtagacgtatcacatgaagaccccgaagttaaattcaactggtacgtagacggagtagaagtacacaatgcaaaaacaaaacctagagaagaacaatacaactcaacctaccgagtagtatcagtcttaacagtcctacaccaagactggttaaacggaaaagaatacaaatgcaaagtttcaaataaagcattaccagcaccaatcgaaaaaacaatatccaaagcaaaaggtcaaccacgagaaccacaagtatacacactaccaccatctagagacgaactaacaaaaaatcaagtatcattaacctgccttgtaaaaggattctatccatccgatatagcagttgaatgggaaagtaacggacaaccagaaaacaattataaaacaaccccaccagttctagactcagacggatcattcttcttatactcaaaactaacagtagataaatcaagatggcaacaaggaaacgtattctcatgctctgtcatgcacgaagccttacataaccactacacacaaaaatcattatcactatccccaggaaaa

SEQ ID NO: 45888 - RNA, 639 nt, synthetic construct
  misc_feature 1..639: note = derived and/or modified sequence opt6 from Amatuximab_LightChain1
  source 1..639: mol_type = other RNA
gacatagaactaacacaatcaccagcaataatgtcagcatcaccaggagaaaaagtaacaatgacatgctcagcatcatcatcagtatcatacatgcactggtaccaacaaaaatcaggaacatcaccaaaaagatggatatacgacacatcaaaactagcatcaggcgtaccaggaagattctcaggatcaggatcaggaaactcatactcactaacaataagttcagtagaagcagaagacgacgctacatactactgccaacaatggagcaaacatccactaacattcggatcaggaacaaaagtagaaataaaacgaacagtagcagcaccatcagtatttatattcccaccatcagacgaacaactaaaatcaggaacagcatcagtagtatgcctactaaacaacttctacccaagagaagcaaaagttcaatggaaagtagacaacgcactacaaagcggaaactcacaagaatcagtaacagaacaagactccaaagactcaacatactcactatcatccacactaacactatcaaaagcagactatgaaaaacacaaagtatacgcatgcgaagtaacacaccaaggactatcatcaccagtaacaaaaagcttcaacagaggagaatgc

SEQ ID NO: 45889 - RNA, 1350 nt, synthetic construct
  misc_feature 1..1350: note = derived and/or modified sequence opt6 from Anetumab_ravtansine_HeavyChain1
  source 1..1350: mol_type = other RNA
caagtagaattagtccaatccggagctgaagtaaaaaaaccaggagaatcacttaaaatatcatgtaaaggaagtggatactcatttacctcatactggataggatgggtaagacaggcaccaggaaaaggactagaatggatgggaataatagaccctggtgattcacgtactcgttattcaccatcattccaaggacaagttacaatctcagcagacaaatcaatatcaacagcatatctccaatggtcttctctcaaagccagcgatacagcaatgtattattgtgccagaggacaattatacggaggaacatatatggatggatggggacaaggaacactagtcacagtctcatcagctagcaccaaaggaccatcagtatttccactagcaccatcatcaaaatccacctcaggaggaacagcagcattaggatgcttagtcaaagactatttcccagaaccagtaacagtaagctggaattcaggagccttaacatcaggcgtccacacgtttccagcagtactacaatcatcaggattatattccttatcatcagttgtgactgtaccttcaagctcactaggcacacaaacatacatttgcaacgtaaaccacaaaccatcaaacacaaaagtagataaaaaagtcgaaccaaaaagctgtgacaaaactcatacatgccccccctgtcccgcaccagaattactaggtggaccatcagtattcctattcccaccaaaaccaaaagatacactaatgatatcaagaacacccgaagtaacatgcgtagtagttgacgtatcacacgaagatccagaagtaaaatttaattggtacgtagacggcgtagaagtccataatgcaaaaacaaaaccaagagaagaacaatacaactctacttatagagtagtatcagtactaactgtactacaccaagattggctaaatggaaaagaatacaaatgcaaagtatcaaataaagcacttcctgcaccaatagaaaaaacaatctcaaaagccaaaggacagccacgtgaaccacaagtatatactctaccaccctcacgcgacgaacttacaaaaaatcaagtctctttgacctgcttagtaaaaggattctacccatctgacatagctgtagaatgggaaagtaacggacaaccagagaataattacaaaactacaccaccagtcttagactcagacggctcattttttttatactctaaattaacagtagacaaatcaagatggcaacaaggaaacgtattttcttgctcagtaatgcatgaagctttacacaatcactacacccaaaaatccctatccctttcaccaggaaaa

SEQ ID NO: 45890 - RNA, 651 nt, synthetic construct
  misc_feature 1..651: note = derived and/or modified sequence opt6 from Anetumab_ravtansine_LightChain1
  source 1..651: mol_type = other RNA
gacatagccctaacacaaccagcatcagtatcaggatcaccaggccaatcaataacaatatcatgcacaggaacatcatctgacataggaggctacaactcagtcagctggtaccaacaacacccaggaaaagcaccaaaactaatgatatacggagtaaacaatagaccttcaggagtatcaaacagattctcaggatcaaaatcaggaaacaccgcatcactaacaatatcaggattacaagcagaagacgaagcagactactactgttcatcatacgacatagaatcagcaacaccagtattcggaggaggcacaaaactaacagtattaggccaaccaaaagcagcaccatcagtaacactattcccaccatcatcagaagaattacaagcaaacaaagcaaccttagtatgcctaatctcagacttttacccaggagcagtaacagtagcatggaaaggagactcatcaccagtaaaagcaggagtcgaaacaacaacaccatcaaaacaatcaaacaacaaatatgcagcatcatcttacctatcactaactccagaacaatggaaatcacacagatcatactcatgccaagtaacacacgaaggatcaacagtagaaaaaacagtagcaccaacagaatgctcc

SEQ ID NO: 45891 - RNA, 1341 nt, synthetic construct
  misc_feature 1..1341: note = derived and/or modified sequence opt6 from Anifrolumab_HeavyChain1
  source 1..1341: mol_type = other RNA
gaagtacaactagtacaatcaggagcagaagtaaaaaaacccggagaatcactaaaaatatcttgcaaaggatcaggatacatattcacaaactactggatagcctgggtaagacaaatgcccggcaaaggactagaatcaatgggaataatctatccaggagattcagacatcagatactcaccatcttttcaaggacaagtaacaatatcagcagataaatccataacaacagcatacctacaatggtccagcctaaaagcatcagacacagcaatgtactattgcgcaagacacgacatagaaggctttgactactggggaagaggcacattagtcaccgtatcatcagcatcaacaaaaggaccatcagtattcccactcgcaccatcatctaaatctacatcaggaggcacagcagcattaggatgcttagtaaaagattacttcccagaacctgtaacagtatcatggaactcaggagcactaacttcaggcgtacacacctttccagcagtactacaatcatccggactatactcattatcctcagtagtaaccgtaccatcatcatccctaggaactcaaacatacatctgcaacgtaaatcacaaaccatcaaacactaaagtcgacaaacgcgtagaaccaaaatcatgcgataaaacacacacatgccctccctgcccagcaccagaattcgaaggaggaccatcagtatttttattcccccctaaaccaaaagatacattgatgatatcaagaacaccagaagtaacatgcgtagtagtcgacgtatcccacgaagaccccgaagttaaattcaactggtacgtagacggagtagaagtacataacgcaaaaaccaaaccaagagaagaacaatacaactcaacttacagagtagtaagcgtcttaacagtactacaccaagactggttaaatggaaaagaatacaaatgcaaagtatcaaacaaagcacttccagcatccatagaaaaaacaatatcaaaagccaaaggacaaccaagagaacctcaagtatacaccctaccaccaagtcgcgaagaaatgacaaaaaatcaagtatcacttacctgtttagtaaaaggcttctacccatcagacatagccgttgaatgggaatcaaacggacaaccagaaaacaactacaaaacaacaccacctgttctagactccgacggatcgtttttcctatactctaaactgacagtagacaaatccaggtggcaacaaggaaacgtattctcctgttcggtaatgcacgaagcactacataaccactacacacaaaaatcactatcactatccccaggtaaa

SEQ ID NO: 45892 - RNA, 645 nt, synthetic construct
  misc_feature 1..645: note = derived and/or modified sequence opt6 from Anifrolumab_LightChain1
  source 1..645: mol_type = other RNA
gaaatagtactaacacaatcaccaggaacactatcactctcaccaggagaaagagctacactatcatgcagagcatcacaatcagtatcatcatcattcttcgcatggtaccaacaaaaaccaggacaagcacccagattactaatatacggagcatcatcacgagcaacaggaatacccgaccgattatcaggatcaggatcaggaacagacttcacactaacaataacaagactagaaccagaagacttcgcagtatactattgccaacaatacgactcatcagcaatcacattcggacaaggaacaagactagaaataaaaagaacagtagcagccccatcagtcttcatattcccaccatcagacgaacaattaaaatcaggaacagcatctgtagtatgcctattaaacaacttctacccaagagaagcaaaagtacaatggaaagtagacaacgcattacaatccggaaactcacaagaatcagtaacagaacaagactcaaaagattcaacatactcactatcatccacattaacactatccaaagccgactacgaaaaacacaaagtatacgcatgcgaagtcacccaccaaggattatcatcacccgtaacaaaatcattcaacagaggcgaatgc

SEQ ID NO: 45893 - RNA, 1344 nt, synthetic construct
  misc_feature 1..1344: note = derived and/or modified sequence opt6 from Anrukinzumab_HeavyChain1
  source 1..1344: mol_type = other RNA
gaagtacaactagtagaatctggaggcggcttagtacaaccaggcggatcattaagactatcatgcgccgcttcaggttttacttttatatcatacgccatgtcatgggtcagacaagcaccaggaaaaggactcgaatgggtcgcttcaatatcatcaggaggaaacacttattatcctgactcagtcaaaggcagattcaccatttctcgggacaacgccaaaaattcattatatctacaaatgaattcactaagagctgaagatactgcagtatattactgtgccagattagatggatactattttggatttgcatattggggacaaggcacactagtgacagtatcctctgcctcaacaaaaggtccttcagtattccctctagcaccttcatcaaaatcaacatctggaggaacagcagcactaggatgtctcgtaaaagactatttcccagaaccagttactgtttcatggaactcaggcgcactaacctcaggtgtacatacatttcccgcagtcttacaatcatcaggcctatattcattatcatcagtagtaacagttccttcatcatcactcggaacccaaacctatatttgtaatgtaaaccacaaaccttcaaatacaaaagtagataaaaaagttgaaccaaaatcatgtgacaaaacacatacatgtccaccttgcccagcacccgaagctttaggtgcaccatcagtatttttattcccacctaaaccaaaagacacactcatgatatcaagaacacccgaagtcacctgtgttgtagtagatgtatcacatgaagaccctgaagtaaaattcaactggtatgtagatggagtagaagtccacaatgcaaaaacaaaaccaagagaagaacaatataattctacttaccgagtagtatcagtactaacagtgctacatcaagattggctaaatggtaaagaatataaatgcaaagtatctaacaaagcattaccggcaccaattgaaaaaaccatcagcaaagcaaaaggacaaccgagagaaccccaagtttatacactaccaccatcacgagaagaaatgacaaaaaaccaagtatcactaacatgcttagtaaaaggattctacccatcagatatagcagtagaatgggaatccaatggacaaccagaaaacaactacaaaacaaccccacctgttttagattcagatggatcatttttcttatattcaaaattaacagtagacaaatcaagatggcaacaaggaaacgtattctcatgctctgtcatgcacgaagcccttcacaatcactatacacaaaaatcattatcactatctccaggaaaa

SEQ ID NO: 45894 - RNA, 654 nt, synthetic construct
  misc_feature 1..654: note = derived and/or modified sequence opt6 from Anrukinzumab_LightChain1
  source 1..654: mol_type = other RNA
gatatacaaatgacacaatcaccatcaagcttaagcgcaagcgtgggagatagagttacaataacatgtaaagcaagtgaaagcgtagacaattacggaaaatcactcatgcactggtaccaacaaaaaccaggaaaagcacccaaactattaatatatcgagcaagcaatctagaaagcggagtcccaagtagattctcaggatcaggatcaggaacagactttacattaacaataagctcattacaaccagaagattttgcaacatactattgccaacaatcaaatgaagacccatggacattcggaggaggaacaaaagtcgaaataaaaagaacagtcgcagcaccaagcgtattcattttcccaccatcagacgaacaactaaaatcaggtacagcatcagtagtatgcttactaaataacttttacccgagagaagccaaagtacagtggaaagtagataacgcgttacaaagcggaaactcacaagaaagtgtaacagaacaagatagcaaagactcaacatatagcttaagctcaacattaacattaagcaaagcagattacgaaaaacataaagtatacgcatgcgaagtaacacaccaaggattaagctcaccagtaactaaaagctttaacaggggcgaatgc

SEQ ID NO: 45895 - RNA, 1338 nt, synthetic construct
  misc_feature 1..1338: note = derived and/or modified sequence opt6 from Apolizumab_HeavyChain1
  source 1..1338: mol_type = other RNA
caagtacaattacaagaatcaggcccaggcctagtaaaaccatccgaaacactaagcttaacctgcacagtttcaggtttctcattaaccaactatggagtacactgggtcagacaatcaccaggaaaaggattagaatggatcggagtcaaatggtccggaggatcaacagaatataacgcagcctttatatcaagactaacaatatcaaaagatacatcaaaaaaccaagtaagccttaaactaaattcattaacagcagcagacacagccgtttactactgcgcacgcaacgacagatatgcaatggattattggggacaaggcacactagtaacagtgagttcagcatcaacaaaaggaccttcagtttttcctttagcaccctcatccaaatcaacatcaggaggcacagcagcacttggatgtctagtaaaagactactttcccgaaccagttacagtatcatggaactcaggcgcattaacatctggtgtacacacatttcccgcagtactccaatcttcaggactctactcattatcatcagtagtaacagtcccatcatcttcattaggaacccaaacatatatatgcaacgtaaaccataaaccatcaaacacaaaagttgacaaaaaagtagaaccaaaatcatgcgacaaaacccacacatgccctccatgcccagcccccgaattattaggaggaccatcagtattcttatttccacctaaaccaaaagacacactaatgataagtagaacaccagaagtaacatgcgtcgtagtcgacgtaagccatgaagacccagaagtaaaattcaactggtacgtagacggagtcgaagtacacaacgctaaaactaaaccacgagaagaacaatacaattcaacataccgagtagtatcagtattaactgtcctacaccaagactggttaaatggaaaagaatacaaatgcaaagtcagcaataaagcactacctgcaccaattgaaaaaacaataagtaaagcaaaaggacaaccacgagaaccacaagtatacacactacccccaagtagagatgaacttacaaaaaatcaagtttctctcacatgtttagtaaaaggattttacccatcagacatagcagtagaatgggaatccaacggacaaccggaaaataattataaaactacaccaccagtactagattcagacggatcatttttcctctattcaaaactaacagtagacaaaagcagatggcaacaaggaaatgttttctcatgttcagtaatgcacgaggcactacacaaccactatactcaaaaatcactatcactatcaccaggcaaa

SEQ ID NO: 45896 - RNA, 642 nt, synthetic construct
  misc_feature 1..642: note = derived and/or modified sequence opt6 from Apolizumab_LightChain1
  source 1..642: mol_type = other RNA
gacatacaaatgacacaatcaccatcaagcctaagcgcaagcgtaggagacagagtaaccataacatgcagagcaagcgaaaacatatactcatacctagcatggtaccaacaaaaaccaggaaaagcaccaaaactattagtatcaaacgcaaaaacattagcagaaggcgtaccaagcagattctcaggatcaggatcaggaaaacaattcacactaacaataagctcactacaaccagaagacttcgcaacatactactgccaacaccattacggaaactcatacccatttggacaaggaaccaaactagaaataaaaagaacagtagcagcaccaagcgtattcatatttccaccatcagacgaacaactaaaatcaggcacagcatcagtcgtatgtctactaaataacttctacccaagagaagccaaagtacaatggaaagtagacaacgcattacaaagcggaaactcacaagaaagcgtaacagaacaagatagtaaagactcaacatacagcctaagctcaacactaacattaagcaaagcagactacgaaaaacacaaagtatatgcatgcgaagtaacacaccaaggactaagctccccagtaacaaaaagcttcaacagaggagaatgc

SEQ ID NO: 45897 - RNA, 378 nt, synthetic construct
  misc_feature 1..378: note = derived and/or modified sequence opt6 from Apomab_HeavyChain
  source 1..378: mol_type = other RNA
gaagtacaattagtacaaagtggaggaggagtagaaaggccaggaggaagtttaagattatcatgtgcagcaagtggatttacatttgatgattatgcaatgtgggtaagacaagcaccaggaaaaggattagaatgggtaagtggaataaattggcaaggaggaagcacagggtatgcagatagtgtaaaaggaagagtaacaataagtagagataatgcaaaaaatagtttatatttacaaatgaatagtttaagagcagaagatacagcagtatattattgtgcaaaaatattaggagcaggaagaggatggtattttgattattggggaaaaggaacaacagtaacagtaagtagtgcaagtacaaaaggacca

SEQ ID NO: 45898 - RNA, 324 nt, synthetic construct
  misc_feature 1..324: note = derived and/or modified sequence opt6 from Apomab_LightChain
  source 1..324: mol_type = other RNA
tcagaactaacacaagacccagcagtatcagtagcactaggacaaacagtaagaataacatgctcaggagactcactaagatcatattacgcatcatggtaccaacaaaaaccaggacaagcaccagtactagtaatatacggagcaaacaatagaccatcaggaataccagacagattctcaggatcatcatcaggaaacacagcatcactaacaataacaggagcacaagcagaagacgaagcagactactactgcaactcagcagactcatcaggaaaccacgtagtattcggaggaggaacaaaactaacagtattagga

SEQ ID NO: 45899 - RNA, 645 nt, synthetic construct
  misc_feature 1..645: note = derived and/or modified sequence opt6 from Aquaporumab_LightChain
  source 1..645: mol_type = other RNA
gaaatagtactaacacaatcaccaggcacactatccttatcaccaggagaaagagcaacattatcatgcagagcatcacaaacagtaagaacaaactacttagcatggttccaacaaaaaccaggacaagcaccaagactattaatattcggagcatcatcaagagccacaggaataccagacagattctcaggctcaggctcaggaacagacttcacattaacaatatccagattagaaccagaagacttcgcagtatactactgccaacaatacggatcatcaccatggacattcggacaaggaacaaaagtagaaataaaaagaacagtcgcagcaccatcagtattcatattcccaccatcagacgaacaactaaaatcaggaacagcctcagtagtatgcctactaaacaacttctacccacgagaagcaaaagttcaatggaaagtagacaacgcactacaatcaggaaactcacaagaatcagtaacagaacaagactccaaagactcaacatactcactatcatcaacattaacactatcaaaagcagactacgaaaaacacaaagtctatgcatgcgaagtaacacaccaaggattatcctcaccagtaacaaaatcattcaacagaggtgaatgt

SEQ ID NO: 45900 - RNA, 1326 nt, synthetic construct
  misc_feature 1..1326: note = derived and/or modified sequence opt6 from Arcitumomab_99tc_HeavyChain
  source 1..1326: mol_type = other RNA
gaagtaaaactcgtagaatccggaggaggactagtacaaccaggaggatccttacgactatcatgtgcaacatcaggatttacattcacagactattatatgaattgggtaagacaaccacccggaaaagccctagaatggcttggatttataggcaacaaagcaaatggatacacaacagaatactcagcctcagtcaaaggaagattcacaatatcacgtgataaatcccaatcaatattatatttacaaatgaatacactaagagccgaagattcagcaacatattactgcaccagagatagaggactaagattctactttgattactggggtcaaggaacaacattaaccgtatcctccgctaaaacaacgcccccatcagtatacccattagcaccaggctcagcagcccaaacaaactcaatggtaaccttaggttgtctagttaaaggatacttccccgaaccagtaacagtcacatggaactccggaagcttatcctccggagtccacacctttccagcagttctacaaagcgatttatacacactatcaagttcagtaacagtaccttcttcaccaagaccctccgaaacagtaacatgcaatgtcgcacacccagcatcatccactaaagtagataaaaaaatcgttccaagagactgcccaccatgtaaatgcccagctccaaatctactaggaggcccatcagtattcatatttccaccaaaaataaaagatgtcctaatgatatcactatcaccaatagtaacatgcgtagtagtagacgtctcagaagacgacccagatgtccaaatatcatggtttgtcaataacgtagaagtacacaccgcccaaacacaaacacacagagaagattacaactcaacactaagagtagtttcagcactaccaatacaacatcaagactggatgagcggaaaagaattcaaatgtaaagttaacaacaaagacttaccagcaccaatcgaaagaacaatatcaaaaccaaaaggttcagtaagagcaccccaagtatatgtactaccaccaccagaagaagaaatgacaaaaaaacaagtaactctaacatgtatggtcactgacttcatgccggaagatatatacgtagaatggacaaataacggaaagacagaattaaattataaaaacacagaaccagtcttagattcagatggcagttacttcatgtattctaaactaagagtagaaaaaaaaaactgggtagaaagaaactcatactcatgctctgtagtacacgaaggactacacaaccaccacacaacaaaatcattctcaaga

SEQ ID NO: 45901 - RNA, 639 nt, synthetic construct
  misc_feature 1..639: note = derived and/or modified sequence opt6 from Arcitumomab_99tc_LightChain
  source 1..639: mol_type = other RNA
caaacagtactatcacaatcaccagcaatactatcagcctcaccaggcgaaaaagtaacaatgacatgcagagcatcatcctcagtcacatacatacactggtatcaacaaaaaccaggatcatcaccaaaatcatggatatacgcaacatcaaacctagcatcaggtgtaccagcacgattctctggatcaggatcaggaacatcatattcactaacaatctcaagagtagaagcagaagacgcagcaacatactactgccaacactggtcctcaaaaccaccaacattcggaggaggaacaaaactagaaataaaaagagcagacgcagccccaacagtatcaatattcccaccatcatcagaacaactcacatcaggaggagcatcagtagtatgcttcctaaacaacttttaccccaaagacataaacgtaaaatggaaaatagacggatccgaaagacaaaacggagtactaaactcatggacagatcaagactcaaaagactcaacatactcaatgtcatcaacactaacattaacaaaagacgaatacgaacgacacaactcctacacatgcgaagcaacacacaaaacatcaacaagcccaatagtaaaatccttcaatagaaacgaatgc

SEQ ID NO: 45902 - RNA, 1329 nt, synthetic construct
  misc_feature 1..1329: note = derived and/or modified sequence opt6 from Ascrinvacumab_HeavyChain1
  source 1..1329: mol_type = other RNA
caagtacaactacaagaatccggaccaggactagtcaaaccttcccaaactctaagtctaacatgcacagtatcaggaggatcaatttcctcaggcgaatactactggaattggattagacaacatccaggtaaaggtttagaatggataggatacatatactactcaggaagcacatattacaatccatcactaaaatcaagagtaaccataagtgtagatacttcaaaaaaccaattctcactaaaactatcatccgtaacagcagcagacacagcagtatattattgcgcaagagaatcagtcgcaggcttcgactactggggacaaggaaccctagtaacagtatcatccgcatcaacaaaaggaccctcagttttccccctagcaccatgttccagatcaacatcagaaagcacagcagcactaggctgtctcgtaaaagactacttcccagaaccagtcacagtatcatggaacagcggagcactcacatccggagtccacacatttccagcagtactacaatctagtggcctatactccttaagttcagtagtaacagtaccatcatcaaacttcggaacacaaacatacacatgcaatgtagaccacaaaccatcaaacacaaaagtagataaaacagtagaaagaaaatgctgcgtcgaatgcccaccatgcccagcacccccagtagctggaccatcagtatttctatttccaccaaaaccaaaagatacattaatgatatcaagaacccccgaagtaacatgcgtagttgtagacgtatcacacgaagatccagaagtccaattcaactggtacgtagacggagtagaagtacacaacgcaaaaacaaaaccaagagaagaacaattcaactctacattcagagtagtttccgtactaaccgtagtccaccaagattggctcaacggcaaagaatacaaatgtaaagtatcaaacaaaggattaccagcaccaatagaaaaaaccatatcaaaaacaaaaggacaacccagagaaccacaagtatacacattaccacccagcagagaagaaatgaccaagaaccaagtctcacttacatgcttagttaaaggattctacccatccgacatagcagtagaatgggaatccaatggtcaacccgaaaacaactacaaaacaacccctcctatgctagactcagatggttctttcttcctatactccaaattaacagtagacaaatctagatggcaacaaggaaatgtattttcatgctccgtaatgcatgaagcattacataaccactacacccaaaaatcactatcactatcacccgga

SEQ ID NO: 45903 - RNA, 645 nt, synthetic construct
  misc_feature 1..645: note = derived and/or modified sequence opt6 from Ascrinvacumab_LightChain1
  source 1..645: mol_type = other RNA
gaaatagtactaacccaatcaccaggaacactatctctatcaccaggagaaagagcaacactctcatgcagagcatcacaaagcgtatcatcatcatacctagcatggtaccaacaaaaaccaggacaagcaccaagactactaatatacggaacatcatcacgagcaaccggaatacctgacagattctcaggatcaggatcaggaacagactttacactaacaatatcaagactagaaccagaagacttcgcagtatactactgccaacaatacggttcaagcccaatcacattcggacaaggaacaagattagaaataaaaagaacagtagccgccccaagtgtattcatattcccaccatcagacgaacaactaaaatccggaacagcatcagtagtatgtctcctaaataacttctacccaagagaagcaaaagttcaatggaaagtagacaacgcactacaatcaggaaactcacaagaatcagtaacagaacaagacagcaaagactctacatacagcctatcatcaacactaacattatcaaaagcagactacgaaaaacacaaagtatacgcatgcgaagtaacacaccaaggactatcatcaccagtaacaaaatcattcaacagaggagaatgc

SEQ ID NO: 45904 - RNA, 1314 nt, synthetic construct
  misc_feature 1..1314: note = derived and/or modified sequence opt6 from Aselizuab_HeavyChain1
  source 1..1314: mol_type = other RNA
gaagtacaactcgtagaatccggtggaggactagtccaaccaggaggaagtctcagactatcatgcgccgcatctggattcacattcagtacatacgcttcttgggtaagacaagccccaggaaaaggattagaatgggttgcatcaatatcaacaggcggctctacctactatccagactcagtaaaaggcagattcacaataagcagagataacgcaaaaaatacactctacttacaaaattcacttagagcagaagacacagccgtttattactgcgcaagagactatgacggatattttgactactggggacaaggaacactagtaacagtatcatcagcatcaacaaaaggaccatctgtatttccattagctccatgctcaagatcaacttccgaatccaccgcagctctcggatgtctagtaaaagattattttccagaaccagtaactgtatcctggaattccggagcattaacatcaggagtccatacatttcccgcagtactacaatcatccggactatacagtctatcatccgtagtaacagtaccctcatcttcactaggaacaaaaacatacacatgcaacgtcgatcacaaaccctcaaatacaaaagtagataagagagtagaatcaaaatacggtccaccatgcccatcatgcccagcaccagaattccttggaggcccatccgtattcctattccctccaaaaccaaaagacactttaataagccgaacaccagaagtaacctgcgtagtagtagacgtatcgcaagaagacccagaagtacaattcaactggtacgtagacggagtagaagtacataacgcaaaaacaaaaccacgcgaagaacaattcaattcaacctacagagtagtatcagtactcacagtactacatcaagactggctaaacggaaaagaatacaaatgcaaagtaagcaataaaggcctcccatcctcaatagaaaaaacaatttcaaaagcaaaaggacaaccacgagaaccacaagtatacacactaccaccctcacaagaagaaacaaaaaatcaagtatccctaacatgccttgtaaaaggcttttacccatccgatattgccgtcgaatgggaatctaatggtcaaccagaaaataactataaaactacaccacctgtcttagactccgacggatcattttttttgtacagcagactaacagtagataaatccagatggcaagaaggaaatgtcttttcatgttctgtccacgaagcattacataaccattacacacaaaaatcactatctctatcacttggaaaa

SEQ ID NO: 45905 - RNA, 1311 nt, synthetic construct
  misc_feature 1..1311: note = derived and/or modified sequence opt6 from Aselizuab_HeavyChain2
  source 1..1311: mol_type = other RNA
gaagtacaactagttgaatctggaggtggtttagtccaacccggtggatctttaagattatcctgcgcagcatccggttttacattctcaacatatgcatcatgggttcgacaagccccagggaaaggattagaatgggtagcttctatatccactggaggttcaacatactacccagattcagtcaaaggacgcttcacaatatctcgagataacgcaaaaaacacattatacttacaaaattcccttcgagctgaagacacagcagtatattactgtgcacgagattacgacggatatttcgactattggggacaaggcacactagtaactgtatcatcagcaagcacaaaaggaccttcagtatttccattagcaccatgctcaagatccacgtctgaatcaacagcagcacttggatgtctagttaaagactatttcccagaaccagtaacagtctcatggaattccggagcacttacttctggagtacatacatttccagccgttttacaatcatcaggattatacagcttatcatcagtagtaaccgtaccatctagctccctaggaacaaaaacatacacatgtaacgtcgaccacaaaccatcaaatacaaaagtagataaaagagtagaatccaaatacggaccaccatgcccatcctgtccagcaccagaattcttaggaggacccagtgtttttttatttcctcctaaacccaaagatacaatcagtagaacaccagaagtaacatgtgtagtagtagacgtgtcacaagaagacccagaagttcaatttaactggtacgtcgacggtgtagaagtacataacgcaaaaacaaaacctagagaagaacaattcaactcaacatacagagtagtttcagtattaacagtacttcaccaagactggctaaatggaaaagaatataaatgcaaagtctcaaacaaaggactaccatcatcaatagaaaaaacaatatcaaaagcaaaaggacaaccaagagaaccacaagtctacactctaccaccatcccaagaagagacaaaaaatcaagtatcattaacatgcttagtaaaaggattctatccatccgacatagcagtcgaatgggaatcaaatggacaacctgaaaacaattacaaaacaactcctcccgtactagactcagatggctcattttttctatactcaagattaacagtagataaatcaagatggcaagaaggcaacgtattctcatgttcagtacatgaagcactacacaatcattacacacaaaaatcattatcattatcattaggaaaa

SEQ ID NO: 45906 - RNA, 648 nt, synthetic construct
  misc_feature 1..648: note = derived and/or modified sequence opt6 from Aselizuab_LightChain1
  source 1..648: mol_type = other RNA
gacatacaaacacaatcaccaagctcactatcagcatcagtaggagacagagtaaccataacatgcaaagcatcccaatcagtagactacgacggagactcatacaactggtaccaacaaaaaccaggaaaagcacccaaactattaatatacgccgcatcaaacctagaatcaggaataccatcaagattctcaggatcaggatccggaacagacttcacattaacaatatcatcattacaaccagaagacttcgcaacatactactgccaacaatcaaacgaagacccatggacattcggacaaggaacaaaagtagaaattaaaagaacagtagcagcaccatcagtattcatattcccaccctcagacgaacaattaaaatcaggaacagcatcagtagtatgcttattaaacaacttctacccaagagaagcaaaagtacaatggaaagtagacaacgcattacaatcaggaaactcacaagaaagcgtaacagaacaagactcaaaagactcaacatacagcttaagctcaaccctaacattatcaaaagcagactacgaaaaacacaaagtatacgcatgtgaagtaacacaccaaggactatcatcaccagtaaccaaatcattcaatagaggcgaatgc

SEQ ID NO: 45907 - RNA, 1344 nt, synthetic construct
  misc_feature 1..1344: note = derived and/or modified sequence opt6 from Atezolizumab_HeavyChain1
  source 1..1344: mol_type = other RNA
gaagtccaacttgtagaatcaggaggaggcctagtccaaccaggcggatcattaagactatcctgcgcagcatcaggattcacattttcagacagctggatacactgggtaagacaagcaccaggtaaaggactagaatgggtcgcatggatatccccatacggaggatccacttactatgccgattcagtaaaaggcagatttactatatcagcagatacgtccaaaaatacagcatatttacaaatgaattctttacgagccgaagatacagcagtatactactgtgctagaagacactggccaggaggctttgattattggggacaaggaacattagtcacagtttcatctgcatcaactaaaggaccctcggtattcccattagcaccgtcatccaaatcaaccagcggaggaaccgcagcacttggttgtctagttaaagactactttccagaacctgttacagtatcttggaattctggagccctaacttcaggagtacacacattccccgcagttctacaatcatcaggattatattcattatcatcagtagtgacagtaccttcatcatcactaggaacacaaacatatatatgcaacgtaaatcataaaccgtccaacacaaaagtagacaaaaaagtagaaccaaaatcttgcgacaaaactcatacatgtccaccatgcccagcaccagaactactaggaggaccatctgtatttctttttccaccaaaaccaaaagatacattaatgatatcaagaacaccagaagtaacttgcgtagtcgtagatgtatcacatgaagatccagaagtcaaattcaactggtatgttgacggagtcgaagtccacaatgcaaaaacaaaaccaagagaagaacaatacgcatctacatatagagtagtatcagtactaacagtattacaccaagactggttaaatggcaaagaatacaaatgcaaagtttcaaataaagcactccccgcaccaatagaaaaaacaatatcaaaagcaaaaggacaacccagagaaccacaagtatacacattaccaccatcaagagaagaaatgacgaaaaaccaagtatcattaacatgcctcgttaaaggattctacccatccgatatagcagtcgaatgggaatccaatggacaaccagagaataactataaaacaacaccaccagttctagactctgacggctcttttttcctctactcaaaactaacagttgacaaatcacgatggcaacaaggtaatgtattctcatgctcagtaatgcacgaagcattacataatcactacacccaaaaatctctttcactatcaccaggtaaa

SEQ ID NO: 45908 - RNA, 642 nt, synthetic construct
  misc_feature 1..642: note = derived and/or modified sequence opt6 from Atezolizumab_LightChain1
  source 1..642: mol_type = other RNA
gacatacaaatgacacaatcaccatcatcattatcagcatcagtaggagacagagtaacaataacatgcagagcatcccaagacgtatcaacagcagtagcctggtaccaacaaaaaccaggaaaagcaccaaaactactaatctactccgcatcattcttatattcaggagtaccatcaagattctcaggatcaggatcaggaacagacttcacactaacaatatcctcattacaaccagaagacttcgcaacatactactgccaacaatacctctatcaccccgcaaccttcggacaaggcacaaaagtagaaataaaaagaaccgtagcagcaccttccgtattcatattcccaccatcagacgaacaactaaaatcaggaacagcatcagtagtatgcctactaaacaacttctacccaagagaagcaaaagtacaatggaaagtagacaacgcattacaatccggaaactctcaagaatcagtaaccgaacaagactcaaaagactcaacatactccttatcatcaacactaacattatccaaagcagactacgaaaaacacaaagtatacgcatgcgaagtcacacaccaaggactatcatccccagtcacaaaatcattcaacagaggagaatgc

SEQ ID NO: 45909 - RNA, 1323 nt, synthetic construct
  misc_feature 1..1323: note = derived and/or modified sequence opt6 from Atinumab_HeavyChain1
  source 1..1323: mol_type = other RNA
gaagtacaattagtagaaagtggaggaggcttggtccaaccaggtggatccttacgattatcatgcgcagcatcgggatttacattttccaattattggatgtcatgggttagacaagcaccaggtaaaggattagaatgggtagcaactattaaacaagatggctcccaaaaaaattatgtcgactcagtaaaaggaaggttcacaatatcaagagataacgcaaaaaattccttatacttaagattaaactctctaagagctgaagacacggcagtttactattgcgcaacagaactatttgacctatggggtagaggttcactagtaactgtatcatcagcatcaacaaaaggaccatcagtattcccacttgccccatgcagtcgctccacttcagaatctactgcagcactaggatgtttagtaaaagattactttccagaaccagtaaccgtaagctggaactctggagcactaacatcaggagtacatacattcccagcagtattacaatcatcaggactatattcactaagctcagtcgtaacagttccatcatcatcattaggtacaaaaacatatacatgtaacgtagaccacaaaccatcaaataccaaagtagataaaagagtcgaatcaaaatacggaccaccatgtccatcatgtccagctccagaattcttaggaggtccctctgtctttttatttccaccaaaacctaaagatactttaatgatttcaagaacaccagaagtaacatgcgtagtagtagatgtatcccaagaagaccctgaagtacaatttaactggtacgttgacggagtagaagtccataacgcaaaaacaaaacccagagaagaacaattcaacagcacctatagagtagtatcagtactaactgtactacaccaagattggctaaatggaaaagaatataaatgtaaagtttcgaacaaaggcctcccttcatcaatcgaaaaaactatatctaaagctaaaggacaaccaagagaaccacaagtctacactttaccaccatcacaagaagaaatgacaaaaaatcaagtaagcttaacatgcctagtaaaaggcttttatccatcagacatagcagtcgaatgggaaagtaatggacaaccagaaaacaactataaaacaacaccacctgtattagattcagatggctcattctttttatactcaagactaactgtagataaaagcagatggcaagaaggaaatgtattttcctgctcagttatgcatgaagcattacacaaccattacactcaaaaatcactaagcttatccctaggtaaa

SEQ ID NO: 45910 - RNA, 642 nt, synthetic construct
  misc_feature 1..642: note = derived and/or modified sequence opt6 from Atinumab_LightChain1
  source 1..642: mol_type = other RNA
gaaatagtactaacacaatcaccagcaacactaagcctatcaccaggagaaagagcaaccttatcatgcagagcatcacaatcagtatcatcatacctagcatggtaccaacaaaaaccaggacaagcaccaagactattaatatacgacgcatcaaaccgagcaacaggaatcccagcaagattttcaggctcaggctccggaacagacttcaccctaacaatctcatcattagaacccgaagacttcgcagtttactattgccaacaaagatcaaactggccaataacattcggacaaggaaccaaactagaaatcaaacgaacagtagcagccccctcagtattcatattcccaccctcagacgaacaactaaaatcaggaacagcctcagtagtatgcttactaaacaacttctacccaagagaagcaaaagtacaatggaaagtagacaacgcattacaatcaggaaactcacaagaaagcgtcacagaacaagacagcaaagactcaacatacagcttatcatcaacactaacattatcaaaagcagactacgaaaaacacaaagtatacgcatgcgaagtaacacaccaaggattatcatcaccagtaacaaaatcatttaacagaggagaatgc

SEQ ID NO: 45911 - RNA, 1329 nt, synthetic construct
  misc_feature 1..1329: note = derived and/or modified sequence opt6 from Atlizuab_HeavyChain1
  source 1..1329: mol_type = other RNA
gtacaattacaagaatccggaccaggactagtccgaccatcacaaacattatcactaacttgtacagtatcaggctactcaataacatcagatcacgcctggtcttgggttagacaaccaccaggcagaggactagaatggataggatatataagctattccggaataacaacatataacccatcattaaaatctcgagttacattaagagacacatctaaaaatcaattttctcttagactatcatcagtaacagcagccgataccgcagtttactactgcgcaagatccctcgcacgaaccacagcagattattggggacaaggctccctagtcacagtatcatcagcatcaacaaaaggaccatcagtatttccactagcaccctcttcaaaatcaacatcaggtggaacagcagccctaggatgtttagtaaaagattacttcccagaaccagttaccgtatcttggaactcaggagcactaactagtggagtccatacctttccagcagttttacaaagttcagggctatattctctatcatccgtagtaacagtaccctcaagctcattaggaacacaaacctacatatgtaatgtaaatcataaaccatcaaacacaaaagtagacaaaaaagtagaacccaaatcatgtgacaaaacacatacatgcccaccatgtcccgcacctgaattactagggggaccctcagtattcctatttccaccaaaaccaaaagatacattaatatccagaacacctgaagtaacatgcgtcgttgtagatgtatcacacgaagaccctgaagtcaaatttaactggtatgttgacggcgttgaagttcacaacgcaaaaacaaaaccaagagaagaacaatacaattcaacataccgagtagtatcagtacttacagtattacaccaagactggctaaatggaaaagaatataaatgtaaagtatctaataaagcattacctgcccctatagaaaaaactatatcaaaagcaaaaggacaacctcgagaaccccaagtatatacactacccccctcacgagatgaactaacaaaaaatcaagtatctctaacatgtctagttaaaggattttacccatcagatatcgcagtagaatgggaatcaaatggtcaaccagaaaataactacaaaacaacaccaccagtattagattcagacggctcattctttctatattccaaattaacagtagataaatccagatggcaacaaggaaacgtcttttcatgtagcgttcacgaagcattacacaatcactacacccaaaaatcactatcactaagcccagga

SEQ ID NO: 45912 - RNA, 639 nt, synthetic construct
  misc_feature 1..639: note = derived and/or modified sequence opt6 from Atlizuab_LightChain1
  source 1..639: mol_type = other RNA
gacatacaaacacaatcaccatcatcactatcagcatcagtaggagacagagtaacaataacctgcagagcaagtcaagatatatcctcatacctaaactggtaccaacaaaaacccggaaaagcaccaaaattactaatatactacacatcaagactacactctggagtaccatcaagattctcaggatcaggatcaggtacagatttcacatttacaatatcatcactacaaccagaagacatagccacatactactgccaacaaggaaacacactaccatacacattcggacaaggaacaaaagtagaaataaaaagaacagtcgcagcaccatcagtattcatattcccaccatcagacgaacaattaaaatcaggaacagcatccgtagtatgcctactaaacaacttctacccaagagaagcaaaagtacaatggaaagtagacaacgcattacaatccggaaactcacaagaatcagtaacagaacaagactcaaaagactcaacatactcactatcatccacactaacactatcaaaagcagactacgaaaaacataaagtatacgcatgcgaagtaacacaccaaggactatcatcaccagtaacaaaatcattcaacagaggagaatgc

SEQ ID NO: 45913 - RNA, 792 nt, synthetic construct
  misc_feature 1..792: note = derived and/or modified sequence opt6 from Aurograb_SingleChain
  source 1..792: mol_type = other RNA
atggcaaaagtacaattattacaaagcgcaacagaagtaaaaaaaccaggtgcaagtgtaaaagtaagttgtaaagcatacggatacacttttacagattatggaataacatgggtaaggcaagcacctggacaaggtttagaatggatgggatggatatcagcatataatggatacacaaattatgcacaaaaatttcaagatagaataacaatgactacagatgcatcaacaagtacagcatatatggaattaagaagtttaagaccagatgacactgcagtattatactgtgccagagatagagaagatgcatcactactaagagatggacattggggtcaaggaacattagtaacagtatcaagtggaggaggaggctcaggaggaggaggaagtggaggaggaggatcaggaggaggaggaagcgaaacaacattaacacaatcaccaggaacattatcattaagtccaggagaaagagcaacattaagttgcagagcaagtcaaatagtaagttcatcatatctagcatggtatcaacaaaaaccaggacaagcaccaagactactaatatacggagcaagtagcagagcaacaggaataccagacagatttagcggaagtggatcaggcacagatttcacattaacaatctcaaaattagaaccagaagattttgcagtatattattgtcaacattacgggtcaagcagtccatggacaagtagaccaagagaccaatcagatataaaaagggcagcagcactagaacaccatcatcaccatcat

SEQ ID NO: 45914 - RNA, 1350 nt, synthetic construct
  misc_feature 1..1350: note = derived and/or modified sequence opt6 from Avelumab_HeavyChain1
  source 1..1350: mol_type = other RNA
gaagtccaactattagaatcaggtggaggcctcgtacaacctggaggatcattaagattaagttgtgccgcatcaggattcacattctcaagctacataatgatgtgggtaagacaagcccccggcaaaggactagaatgggtttcatcaatatacccaagcggaggtataacattctatgcagacacagttaaaggacgatttacaataagtagagacaatagcaaaaacactctatatttacaaatgaattcattaagagcagaagacacagctgtatactactgtgcaagaattaaattaggaacagtaaccaccgtagactactggggacaaggcactctagtaacagtaagtagtgcatcaacaaaaggaccttctgtattcccactagcaccctcatcaaaaagcacatccggaggaacagcagccttaggttgcttagtcaaagactatttcccagaaccagtaacagtatcctggaattcaggcgccctaacctcaggagtacacacattcccagcagtactacaaagctccggattatattcactctcttcagtagtaactgtaccatcatcgtcactaggaacacaaacttacatatgcaatgtaaaccacaaaccatcaaacacaaaagtagacaaaaaagtagaaccaaaaagctgcgataaaacccacacatgcccaccttgtccagccccagaactattaggaggaccatcagtttttttatttccccccaaaccaaaagatacattaatgattagccgaacaccagaagtaacatgtgtcgttgtcgatgtttcacacgaagatccagaagtaaaattcaattggtacgtagatggagtagaagtccataacgcaaaaacaaaaccacgcgaagaacaatataattcaacatatcgagtagtctcagttctcaccgtattacaccaagattggttaaatggaaaagaatacaaatgtaaagtatctaataaagcattaccagcaccaatagaaaaaaccatatcaaaagctaaaggacaaccaagagaaccacaagtatacacattacccccatcaagagacgaactaacaaaaaatcaagttagtttaacttgtttagtaaaaggattctatccatccgacatagccgtagaatgggaatctaatggacaacccgaaaataattacaaaacaacaccgccagtactagatagtgacggaagcttttttctatattcaaaactaacagtagataaatcgagatggcaacaaggaaatgtattctcatgtagcgttatgcacgaagcattacataaccattacacacaaaagtcactatccctaagtccaggtaaa

SEQ ID NO: 45915 - RNA, 648 nt, synthetic construct
  misc_feature 1..648: note = derived and/or modified sequence opt6 from Avelumab_LightChain1
  source 1..648: mol_type = other RNA
caatcagcactaacacaaccagcatcagtatcaggatcaccaggacaatcaataacaatatcctgcaccggaacatcatcagacgtaggaggatacaactacgtatcatggtatcaacaacacccaggaaaagcacccaaactaatgatatacgacgtaagcaacagaccaagcggagtctcaaacagattctcaggatcaaaatcaggaaacacagcatcattaacaataagtggattacaagcagaagacgaagcagactactactgctcatcatacacatcatcatcaaccagagtattcggaacaggaacaaaagtaacagtactaggacaaccaaaagcaaatccaacagtaacactattcccaccatcatcagaagaattacaagcaaacaaagcaacactagtatgcttaatttcagacttctacccaggagcagtaacagtcgcatggaaagcagacggatccccagtaaaagcaggagtagaaacaacaaaaccatcaaaacaatcaaacaacaaatacgcagcatcatcctacctatcactaacaccagaacaatggaaatcacacagatcatactcatgccaagtaacacacgaaggatcaacagtagaaaaaacagtagctccaacagaatgctca

SEQ ID NO: 45916 - RNA, 1344 nt, synthetic construct
  misc_feature 1..1344: note = derived and/or modified sequence opt6 from Bapineuzumab_HeavyChain1
  source 1..1344: mol_type = other RNA
gaagtacaattattagaatcaggaggaggattagtacaaccaggaggatcactaagattaagttgtgcagcatcaggatttaccttttcaaattacggaatgtcatgggtaagacaagcaccaggaaaaggattagaatgggtagcatccatacgatcaggtggaggaagaacatactattcagacaacgttaaaggacgattcactatatcacgagacaactcaaaaaacacactctatctacaaatgaattcactacgagcagaagacacagcagtatactactgtgtaagatatgaccactactcaggatcatctgactattggggccaaggaacactagtcactgtatcctcagcaagcacaaaaggcccatcagtatttccacttgcaccatcttcaaaatcaacatcaggaggaacagcagcccttggttgcttagtaaaagactacttcccagaaccagtaaccgtatcatggaattcaggagcactaacatcaggagtacacacctttccagcagtattacaatcatcaggactatactcattgtcctcagtagtaacagttccatcatcatcattaggtacacaaacctatatatgcaatgtcaaccacaaaccctcaaacacaaaagtagacaaaaaagtagaaccaaaaagttgtgacaaaacccacacatgcccaccatgcccagcaccagaattattaggaggaccatccgttttcttattcccaccaaaacccaaagacacactaatgatatcaagaacaccggaagtaacatgcgtagtcgtagacgtatcacacgaagatccagaagtcaaattcaactggtacgtagacggcgtcgaagtacataatgctaaaacaaaaccacgagaagaacaatacaactcaacttacagagtcgtctcagtactcacagtattacatcaagactggctaaatggaaaagaatacaaatgcaaagtatcaaataaagcattaccagcccccatcgaaaaaacaatatcaaaagcaaaaggtcaaccacgagaaccacaagtatatacccttccaccatcccgagaagaaatgacaaaaaaccaagtatcactaacctgtctagtaaaaggattctacccatcagatatagcagtagaatgggaatcaaacggccaaccagaaaacaattataaaacaacaccacctgtccttgactcagacggctcatttttcctttactcaaaactaactgttgacaaatcacgatggcaacaaggaaacgtcttctcatgctcagtcatgcacgaagcattacacaatcattacacacaaaaatccctatcattatcaccagga

SEQ ID NO: 45917 - RNA, 657 nt, synthetic construct
  misc_feature 1..657: note = derived and/or modified sequence opt6 from Bapineuzumab_LightChain1
  source 1..657: mol_type = other RNA
gatgtagtaatgacacaatcaccattatcactaccagtaacaccaggagaaccagcatcaatatcatgcaaaagctctcaatcactattagactcagacggaaaaacatacctaaactggcttctacaaaaacccggacaatcaccacaaagattaatttacctagtatcaaaactagactcaggagtaccagacagattctcaggatcaggatcaggaacagacttcacactaaaaatatcaagagtagaagcagaagacgtaggagtatactactgttggcaaggaacacacttcccaagaacattcggacaaggaacaaaagtagaaataaaaagaacagtagctgcaccatcagtattcatattcccaccctccgacgaacaactaaaatcaggaacagcatcagtagtatgcctactcaacaacttctacccaagagaagcaaaagtacaatggaaagtagacaatgcactacaatcaggaaactcacaagaatcagtaaccgaacaagactcaaaagattcaacatactcactatcatcaacactaacactatcaaaagcagattacgaaaaacacaaagtatacgcatgcgaagtaacacaccaaggactatcatcccccgtaacaaaatcatttaaccgaggcgaatgc

SEQ ID NO: 45918 - RNA, 1338 nt, synthetic construct
  misc_feature 1..1338: note = derived and/or modified sequence opt6 from Basiliximab_HeavyChain
  source 1..1338: mol_type = other RNA
caactacaacaatcaggaactgtactcgcacgaccaggcgcctcagtaaaaatgtcttgtaaagcatcaggttactcctttacccgatactggatgcattggatcaaacaacgacccggacaaggcctagaatggataggagcaatataccccggtaactcagatacttcatacaaccaaaaattcgaaggcaaagcaaaattaaccgcagtaacctccgcaagtacagcatatatggaactatcctcactaacacacgaagactctgctgtatactattgctcccgagactatggttactacttcgacttttggggacaaggaacaaccctaacagtatcatcagcatccacaaaaggaccatcagtcttcccactagccccctcatcaaaatctacatcaggtggaacagccgccctcggctgcttagttaaagactactttccagaacccgtaacagtatcatggaactctggcgccctaacatcaggagtacacacattcccagccgtactacaatcttcaggactatattcactatcatcagtcgtaacagtaccatcatcaagtctcggcacacaaacatatatatgcaacgtaaaccacaaaccatcaaatacaaaagtagataaaagagttgaaccccccaaatcatgcgacaaaactcacacatgcccaccttgccccgccccagaattattaggaggaccctcagtctttctttttccaccaaaaccaaaagatacattaatgatatcaagaacaccagaagtaacatgtgtcgtagtcgacgtatcacacgaagatccagaagttaaattcaactggtatgtagacggcgtagaagtccataatgcaaaaacaaaaccaagagaagaacaatacaactccacctacagagtagtaagcgtacttacagtactacaccaagactggctaaatggaaaagaatacaaatgcaaagtatcaaacaaagcattaccagccccaatagaaaaaacaataagcaaagcaaaaggacaacccagagaaccacaagtatacacactaccaccctctagagacgaactaacaaaaaatcaagtatctctaacctgtctagtaaaaggcttctatccatcagatatagcagtagaatgggaatctaacggacaaccagaaaacaactataaaacaacacccccagtattagactcagacggatcctttttcttatactcaaaactcacagtcgacaaatccagatggcaacaaggcaacgtattctcatgttccgtaatgcacgaagcactacacaaccactacacccaaaaatcattaagcttatcaccaggaaaa

SEQ ID NO: 45919 - RNA, 630 nt, synthetic construct
  misc_feature 1..630: note = derived and/or modified sequence opt6 from Basiliximab_LightChain
  source 1..630: mol_type = other RNA
caaatagtctcaacccaatcaccagcaataatgtcagcatcaccaggcgaaaaagtaacaatgacatgctcagcatcatcatcacgatcatacatgcaatggtatcaacaaaaaccaggaacatcaccaaaaagatggatctacgacacaagcaaactagcatcaggagtcccagcaagattctcaggatcaggatcaggaacatcctactcactaacaatatcatcaatggaagcagaagacgcagcaacatactactgccaccaaagatcatcatacacattcggcggaggaacaaaactagaaataaaaagaacagtagcagcaccatcagtctttatattcccaccatcagacgaacaactaaaatcaggaacagcatcagtagtatgtctattaaacaacttctacccaagagaagcaaaagtacaatggaaagtcgataacgcactacaatcaggaaattcacaagaatcagtaacagaacaagactcaaaagactcaacatactcactatcatcaacactaaccctatcaaaagcagactacgaaaaacacaaagtatacgcatgcgaagtaacacaccaaggactatcatcaccagtaacaaaatcattcaacagaggagaa

SEQ ID NO: 45920 - RNA, 1350 nt, synthetic construct
  misc_feature 1..1350: note = derived and/or modified sequence opt6 from Bavituximab_HeavyChain
  source 1..1350: mol_type = other RNA
gaagtacaattacaacaatcaggccccgaactagaaaaaccaggagcaagcgtcaaattatcatgtaaagcatccggatactctttcacaggatataacatgaactgggtcaaacaatcacatggaaaatcccttgaatggataggtcacatcgacccatactacggtgacacatcatacaatcaaaaattcagaggaaaagcaacactaacagttgataaaagctcatccaccgcatacatgcaactaaaaagtctaacatcagaagattcagcagtatattactgtgtaaaaggaggatactacggccattggtattttgatgtatggggtgcaggtacaacagtaacagtatcctccgcctccaccaaaggccccagcgtttttcctttagcaccatcatcaaaatccacatcaggaggaacagcagcactcggatgcttagtaaaagactactttcctgaaccagtaacagtctcatggaatagtggagcactaacttcaggagttcacaccttcccagcagttcttcaatcatctggattgtactcactctcatcagtagtaaccgtaccatcctcttcattaggcacacaaacatacatttgcaacgtaaatcacaaaccctccaacacaaaagtagacaaaaaagtagaaccaaaatcctgtgataaaacccatacatgcccaccctgcccagcacccgaattattaggaggaccatctgtcttcctatttccacccaaaccaaaagacaccctaatgatttcaagaacaccagaagttacatgcgtagtagtagacgtatcacacgaagatcccgaagtaaaattcaactggtacgtagacggagtagaagtacacaatgcaaaaacaaaacctcgagaagaacaatacaattctacatacagagtagtaagcgtactaactgtactacaccaagactggctaaatggaaaagaatataaatgtaaagtatccaacaaagccttacccgcaccaatagaaaaaacaatatcaaaagcaaaaggacaaccacgagaaccacaagtctatacactaccaccatcacgagacgaactaaccaaaaaccaagtatcattaacctgtttagtaaaaggattctatccatcagatatcgccgtagaatgggaatcaaacggacaacccgaaaacaactataaaacaacaccaccagtattagactccgatggatctttctttttatacagcaaacttaccgtagataaatcaagatggcaacaaggaaacgtcttctcatgttcagtaatgcacgaagcactccataaccattacacacaaaaatcattatcattatcaccaggaaaa

SEQ ID NO: 45921 - RNA, 642 nt, synthetic construct
  misc_feature 1..642: note = derived and/or modified sequence opt6 from Bavituximab_LightChain
  source 1..642: mol_type = other RNA
gacatacaaatgacacaatcaccctcatcactatccgcaagcttaggagaaagagtatcattaacatgtcgagcaagccaagacataggctcatcactaaactggctacaacaaggaccagacggaacaatcaaaagactaatatacgcaacatcctcactagattcaggtgtaccaaaaagattttctggatcaagatcaggatcagactactcactaacaatatcatcactagaatcagaagacttcgtagattactactgcctacaatacgtatcaagcccaccaacattcggagcaggaacaaaactagaattaaaaagagcagacgcagccccatccgtattcatattcccaccatcagacgaacaactaaaatcaggcacagcatcagtagtatgcctactaaacaacttctatccaagagaagccaaagtccaatggaaagtagacaacgcactacaatcaggaaactcacaagaatcagtaacagaacaagactcaaaagactcaacatactccctatcatcaacactaacactatcaaaagcagattacgaaaaacataaagtatacgcatgtgaagtaacacatcaaggattatcatcacccgtaacaaaatcatttaacagaggagaatgc

SEQ ID NO: 45922 - RNA, 624 nt, synthetic construct
  misc_feature 1..624: note = derived and/or modified sequence opt6 from Bavituximab_LightChain_variant_8734_L
  source 1..624: mol_type = other RNA
gacattcaaatgacacaatcaccatcatccttatcagcatcattaggagaacgagtatcactaacatgccgagcatcacaagacataggatcatccctaaactggctacaacaaggaccagacggaacaataaaaagattaatatatgcaacatcatccctagacagcggagtaccaaaaagattctcaggatcaagatcaggatcagactactcattaaccatatcatcactagaatcagaagacttcgtagactactactgcctacaatacgtatcaagcccaccaacatttggagccggaacaaaactagaactaaaaagagcagacgcagcaccatcagtattcatattcccaccctctgacgaacaattaaaatccggaacagcatcagtagtatgcctactaaacaacttctacccaagagaagcaaaagtacaatggaaagtagacaacgcactacaatcaggaaactcacaagaatcagtaacagaacaagactcaaaagactcaacatactcactatccaaagcagactacgaaaaacataaagtatacgcatgcgaagtaacacaccaaggattaagttcacccgtaacaaaaagcttcaacagaggagaatgc

SEQ ID NO: 45923 - RNA, 1368 nt, synthetic construct
  misc_feature 1..1368: note = derived and/or modified sequence opt6 from Begelomab_HeavyChain1
  source 1..1368: mol_type = other RNA
caagttcaattacaacaatcaggagcagaattagtcaaaccaggagcctccgtcaaattatcatgtaaagctagcggatataccttcagatcatatgacataaactgggtacgacaaagaccagaacaaggactagaatggataggctggatattccctggcgacggatccacaaaatataacgaaaaatttaaaggaaaagctacactaacaacagacaagtcatcaagcacagcatatatgcaactatctcgactaacctcagaagactcagctgtttatttctgtgcaagatggacagtagtcggaccagggtactttgacgtatggggagcaggaacaacagtaacagtctcatccgcaaaaacaactcccccctcagtatacccattagcaccaggctgtggagacacaacaggatcatctgtaacattaggatgcctagtaaaaggttatttcccagaatcagtcactgtaacatggaactcaggttcacttagcagctccgttcacacatttcccgccctattacaatctggcctgtatacaatgtcaagcagtgtaacagtaccatcatctacatggccttctcaaactgtaacatgctcagttgcccatccagcaagttcaacaacagtcgataaaaaactagaaccatctggccctatatcaacaataaatccctgccccccctgtaaagaatgccacaaatgtccagcaccaaacctcgaaggaggtccctcagtatttatatttcccccaaacataaaagatgttctaatgatatcactaacacctaaagtaacctgtgtagttgttgatgtatcagaagatgacccagatgtacaaatatcctggttcgtaaacaacgttgaagtccacacagcccaaacacaaactcatagagaagattataattcaacaataagagtagtctcaacactaccaatacaacaccaagattggatgtctggaaaagaatttaaatgtaaagtaaacaacaaagacctaccttctccaatagaacgaacaatttcaaaaataaaaggactagttagggctccacaagtatatatcctaccacccccagctgaacaactaagtagaaaagatgtcagtctaacatgtctagtagtaggattcaatcctggagacatctccgtagaatggacatctaatggacatacagaagaaaactataaagatacagcgccagtactagattctgatggaagttatttcatatattcaaaactaaatatgaaaacatccaaatgggaaaaaacagactcattttcatgtaacgtaagacatgaaggattaaaaaattactacctaaaaaaaactatatcaagatcacctggaaaa

SEQ ID NO: 45924 - RNA, 639 nt, synthetic construct
  misc_feature 1..639: note = derived and/or modified sequence opt6 from Begelomab_LightChain1
  source 1..639: mol_type = other RNA
caaatagtactaacacaatcaccagcaataatgtcagcctcaccaggagaaaaagtaacaataacatgctccgcatcatcatcagtatcatacatgaactggttccaacaaaaaccaggaacatcaccaaaattatggatatactcaacatcaaaccttgcatcaggagtaccagccagattctccggatcaggatcaggaacctcatactccctaacaatatcaagaatggaagcagaagacgcagcaacttactactgccaacaacgatcatcatacccaaacacattcggaggaggaacaaaactagaaataaaaagagcagacgcagcaccaacagtctcaatattcccaccatcatccgaacaactaacatcaggaggagcatcagtagtatgcttcctaaacaacttctacccaaaagacataaatgtaaaatggaaaatagacggatccgaaagacaaaacggagtcttaaactcatggacagaccaagactcaaaagactcaacatactcaatgtcatcaacactaacactaacaaaagacgaatatgaacgacacaactcatacacatgcgaagcaacacataaaacctcaacatcaccaatagtaaaatcattcaacagaaacgaatgt

SEQ ID NO: 45925 - RNA, 1353 nt, synthetic construct
  misc_feature 1..1353: note = derived and/or modified sequence opt6 from Benralizumab_HeavyChain1
  source 1..1353: mol_type = other RNA
gaagtacaactagttcaatctggcgcagaagtaaaaaaaccaggagcatcagtaaaagtctcatgcaaagcatccggatacactttcacatcatacgtaatacattgggtacgacaaagacccggacaaggattagcatggatgggctatataaacccttacaatgacggtacaaaatataatgaaagattcaaaggcaaagtaacaatcaccagtgatagatcaacaagcaccgtatacatggaactaagttccctaagaagcgaagacacagcagtatacttatgcggccgagaaggaatacgatattacggcctactaggagactactggggacaaggaacactcgtaacagtatcatctgcctcaacaaaaggaccatcagtattcccactagcaccctcatcaaaatcaacctctggaggaacagcagccctcggatgtctagttaaagactactttccagaacccgtaacagtatcatggaacagcggtgcattaacttcaggagtacacacattcccagcagtacttcaatcctcaggactatactcattatcaagtgtagtaacagtaccatcatcaagcctaggaacacaaacttatatatgcaatgtcaaccacaaaccctccaacacaaaagtagacaaaaaagtagaaccaaaatcatgcgataaaacacatacatgcccaccatgtccagcaccagaattattaggaggaccttctgtattcctatttccaccaaaaccaaaagatacactcatgataagccgaacacccgaagtaacctgtgtcgtagtagacgtttcacacgaagatccagaagtaaaattcaactggtacgtagacggtgtagaagttcataacgcaaaaacaaaacccagagaagaacaatacaacagcacatacagagtagtatcagtactaactgtacttcaccaagactggctaaacggaaaagaatacaaatgtaaagtcagtaataaagccttaccagcaccaattgaaaaaacaatatcaaaagcaaaaggacaaccaagagaacctcaagtatatacactaccccccagcagagatgaactaacaaaaaatcaagtaagtttaacttgcttagtaaaaggattctacccaagtgatatagcagttgaatgggaatctaacggtcaaccagaaaataattacaaaaccaccccacccgtactagattcagacggctcattcttcctctattcaaaactcacagttgacaaatcacgatggcaacaaggcaacgtattcagctgttcagtgatgcacgaagccttacataaccactatacacaaaaatcactatcactctcaccaggtaaa

SEQ ID NO: 45926 - RNA, 642 nt, synthetic construct
  misc_feature 1..642: note = derived and/or modified sequence opt6 from Benralizumab_LightChain1
  source 1..642: mol_type = other RNA
gacatacaaatgacacaatcaccatcaagcctatcagcatcagtaggagacagagtaacaataacatgcggaacatcagaagacataataaattacctaaactggtatcaacaaaaaccaggaaaagcaccaaaactactaatctaccatacatcaagacttcaatcaggagtaccatcaagattctcaggatcaggatcaggaacagacttcacactaacaatatcatcactacaacccgaagactttgccacatactattgccaacaaggatacacactaccatacacattcggacaaggaacaaaagtagaaataaaacgaacagtagcagcaccaagcgtattcatcttcccaccatcagacgaacaattaaaatcaggaacagcatcagtagtatgcctactaaacaacttctacccaagagaagcaaaagtacaatggaaagttgacaatgcactacaatcaggaaactcacaagaatccgtaacagaacaagactcaaaagactcaacatactcactatcatcaacattaacactatccaaagcagactacgaaaaacacaaagtatacgcatgcgaagtaacacaccaaggattatcctcacccgtaacaaaatcattcaacagaggagaatgc

SEQ ID NO: 45927 - RNA, 1329 nt, synthetic construct
  misc_feature 1..1329: note = derived and/or modified sequence opt6 from Betalutin_HeavyChain1
  source 1..1329: mol_type = other RNA
gaaatacaacttcaacaaagtggtcccgaactcgtaaaaccaggagcatcagtaaaagtaagctgcaaagcatcaggatactcattcacagactataacatgtattgggtaaaacaatcacacggaaaatccctcgaatggataggatacatagatccctacaatggagacacaacatacaatcaaaaattcaaaggaaaagcaacattaacagtagataaatcttcttcaacagccttcattcacttaaattcattaacatcagaagactcagcagtatactactgcgcacgatcgccatacggtcattacgcaatggattactgggggcaaggtacaagcgtcacagtatcatccgcaaaaactacccccccatccgtatatccattagcacctggatcagcagcacaaactaattctatggtaacactaggttgtctcgtaaaaggatacttcccagagccagtaacagttacatggaactcaggctcattatcatcaggagtacatacattccctgcagtattacaatctgacctatatacactatcatcatcagtaacagtaccaagttcaacatggccatctgaaaccgtaacatgcaatgtagcacatccagcttcctcaaccaaagtcgacaagaaaatagtaccaagagattgtggatgtaaaccctgtatatgcacagtacccgaagtatcctcagtattcattttcccacccaaaccaaaagacgtcctcacaataacactaacaccaaaagtaacatgcgtagtagtagacatatcaaaagacgacccagaagtacaattttcatggtttgtcgacgacgtagaagtacatacagcacaaacacaacccagagaagaacaattcaactcgacattcagatctgtatcagaactaccaataatgcatcaagactggctaaacggaaaagaattcaaatgtcgagtaaattccgccgcattcccagcacccatagaaaaaacaatttcaaaaacaaaaggtagacctaaagcaccacaagtatacactataccacccccaaaagaacaaatggccaaagataaagtcagcctcacatgcatgataacagacttcttccctgaagacataacagtagaatggcaatggaacggacaaccagctgaaaattacaaaaatacacaaccaattatggatacagatggatcatacttcgtatactcaaaactaaacgttcaaaaatcaaactgggaagctggaaatacattcacatgttctgtcctacacgaaggactacataatcatcacacagaaaaatcattatcccactccccaggcaaa

SEQ ID NO: 45928 - RNA, 642 nt, synthetic construct
  misc_feature 1..642: note = derived and/or modified sequence opt6 from Betalutin_LightChain1
  source 1..642: mol_type = other RNA
gacatagtaatgacacaatcacacaaactattatcaacatcagtaggagacagagtatccataacatgcaaagcatcacaagacgtatcaaccgcagtagactggtaccaacaaaaaccaggccaatcaccaaaactattaataaactgggcatcaacacgacacactggagtaccagacagatttacaggatcaggctcaggcacagactatacactaacaatatcatcaatgcaagcagaagacctagcactatactactgcagacaacactactcaacaccattcacatttggatcaggaacaaaactagaaataaaaagagcagacgcagccccaacagtatccatattcccaccatcatcagaacaactaacatcaggaggagcatcagtagtatgcttcctaaacaacttctacccaaaagacataaacgtcaaatggaaaatagacggctcagaaagacaaaacggagtactcaactcatggacagaccaagactccaaagattcaacatactcaatgtcatcaacactaacactaacaaaagacgaatacgaaagacataactcatacacatgcgaagcaacacacaaaacatcaacatcaccaatagtaaaatcattcaacagaaacgaatgc

SEQ ID NO: 45929 - RNA, 1344 nt, synthetic construct
  misc_feature 1..1344: note = derived and/or modified sequence opt6 from Bevacituzuab_HeavyChain1
  source 1..1344: mol_type = other RNA
gaagtacaattagtcgaatcaggaggaggcctagtacaaccaggcggatcattacgcctatcatgtgccgcatcaggctacacattcacaaactacggaaactgggttcgacaagctccaggaaaaggattagaatgggtaggctggattaacacatacacaggagaaccaacatatgccgcagactttaaaagaagattcacattttcacttgacacatccaaatcaacagcatacctacaaaattcactaagagccgaagacacagcggtttactactgcgccaaatacccacactattatggatcttcacactggtacttcgacgtatggggacaaggaacactagtaacagtatcaagcgcctctacaaaaggaccctcagttttcccactcgcaccatcttcaaaatcaacatcaggaggaaccgcagcattaggatgtttagttaaagactacttccccgaaccagttacagtatcatggaactcaggagctctcacatcaggagtacacacatttccagccgttctccaatcatccggattatactctctttcttccgtagtaacggtaccatcatcatcactaggaactcaaacctatatctgtaacgtaaatcataaaccatccaacacaaaagtagacaaaaaagtcgaaccaaaaagctgcgacaaaacacacacatgtccaccatgtccagccccagaattactaggaggcccatcagtattcctatttccacccaaaccaaaagatacactaatatcccgaacaccagaagtaacatgcgtagtcgtagacgtatcacacgaagatccagaagtaaaattcaactggtacgtagatggagtagaagtccataatgcaaaaacaaaaccacgtgaagaacaatataattcaacatacagagtcgtatcagtattaaccgtcctacatcaagactggctaaatggaaaagaatacaaatgcaaagtatcaaataaagcactaccagcaccaatagaaaaaacaataagcaaagctaaaggtcaaccaagagaaccacaagtatatacattaccaccatcaagagaagaaactaaaaatcaagtttcattaacatgtttagtaaaaggcttctacccatcagatatagcagtcgaatgggaatctaacggccaaccagaaaacaattataaaacaacaccacccgtactagactcagacggctcattcttcctatattcaaaactaacagtagataaatcacgttggcaacaaggaaatgtattctcatgttccgtacatgaagctctccataaccactacactcaaaaatctctctccttatccccaggaaaa

SEQ ID NO: 45930 - RNA, 639 nt, synthetic construct
  misc_feature 1..639: note = derived and/or modified sequence opt6 from Bevacituzuab_LightChain1
  source 1..639: mol_type = other RNA
gatatacaaacacaatcaccatcatcactatcagcatccgtaggagacagagtaacaataacatgctccgcatctcaagacatatccaactacctaaactggtaccaacaaaaaccaggaaaagcaccaaaagtcctaatatacttcacctcatcactacattccggagtaccatcacgattctcaggatcaggatcaggaacagacttcacactaacaatatcatcactacaaccagaagacttcgcaacatactactgccaacaatactcaacagtaccatggacattcggacaaggaacaaaagtagaaataaaaagaacagtagcagcaccatcagtattcatattcccaccatcagacgaacaactaaaatcaggaacagcatcagtagtatgcctactcaacaatttctacccaagagaagcaaaagtacaatggaaagtagacaatgcattacaatcaggaaactcacaagaatcagtaaccgaacaagactctaaagactcaacatactccctatcatcaacactaacattatcaaaagcagactacgaaaaacacaaagtatatgcctgcgaagtcacacaccaaggtctatcatcaccagtaacaaaatcattcaacagaggcgaatgc

SEQ ID NO: 45931 - RNA, 639 nt, synthetic construct
  misc_feature 1..639: note = derived and/or modified sequence opt6 from Bevacizumab_154-aspartic_acid_LightChain
  source 1..639: mol_type = other RNA
gacatacaaatgacacaatcaccctcctcactatcagcatcagtaggagacagagtaacaataacctgctcagcatcacaagacatatcaaactacttaaactggtaccaacaaaaacccggaaaagcacccaaagtcttaatatacttcacatcctcactacactctggagtaccatcaagattctcaggatcaggatcaggaacagacttcacactaacaatatcctcattacaaccagaagactttgcaacatactactgccaacaatactcaacagtaccatggacattcggacaaggcactaaagtagaaataaaaagaacagtagcagccccatcagtattcatatttccaccatcagacgaacaactaaaatcaggaacagcatcagtagtatgcctactaaacaacttctacccacgagaagcaaaagtacaatggaaagtagacaacgcagaccaatcaggaaactcacaagaatcagtaacagaacaagactctaaagactcaacatactcactatcatcaacactaacactatccaaagcagattacgaaaaacacaaagtatacgcatgcgaagtaacacaccaaggactatcttccccagtaacaaaatcattcaacagaggcgaa

SEQ ID NO: 45932 - RNA, 639 nt, synthetic construct
  misc_feature 1..639: note = derived and/or modified sequence opt6 from Bevacizumab_154-substitution_deriv_LightChain
  source 1..639: mol_type = other RNA
gacatacaaatgacacaatcaccatcatcactatcagcatcagtaggagacagagtaaccataacatgctcagcatcacaagacatatccaactacctaaactggtaccaacaaaaaccaggaaaagcaccaaaagtactaatatacttcacatcatctctacactcaggagtaccatcaagattctcaggatcaggatcaggaacagactttacactaacaatctcatcactacaacccgaagacttcgcaacatattactgccaacaatactcaacagtaccatggacattcggacaaggaaccaaagtagaaataaaaagaacagtagcagcaccatccgtatttatattcccaccatcagacgaacaactaaaatcaggaacagcatcagtagtatgcctactaaataatttctacccaagagaagcaaaagtacaatggaaagtagacaacgcagaccaatcaggaaactcacaagaatcagtaacagaacaagactcaaaagactcaacatactccctatcatcaaccctaactttatcaaaagctgactacgaaaaacacaaagtatacgcatgcgaagtaacacaccaaggactatcatccccagtaacaaaatcattcaacagaggagaa

SEQ ID NO: 45933 - RNA, 672 nt, synthetic construct
  misc_feature 1..672: note = derived and/or modified sequence opt6 from Bevacizumab_180-serine_HeavyChain
  source 1..672: mol_type = other RNA
gaagttcaattagtagaatcaggtggaggattagtacaaccaggaggatcactaagattaagctgtgcagcatcaggatacacattcacaaactatggaatgaactgggtaagacaagcaccaggaaaaggactagaatgggtaggatggataaatacatatacaggtgaaccaacatacgcagcagactttaaaagaagatttacattttcattagatacatcaaaatcaacagcatatttacaaatgaattcacttagagcagaagatacagcagtatattactgtgcaaaatacccacactactacggatcatcacattggtattttgatgtctggggacaaggaacattagtaacagtctcatcagcaagcacaaaaggaccatcagtatttccactagcaccaagcagcaaatcaacatcaggaggaacagcagcactaggatgtttagtaaaagattactttccagaaccagtaacagtatcatggaacagcggagcactaacttcaggagtacatacatttccagccgtaagccaatcaagtggcctatattcattatcatctgtagtaactgtaccaagttcatcactaggaacacaaacatatatatgtaacgtaaaccataaaccatcaaacacaaaagtagataaaaaagtagaaccaaaa

SEQ ID NO: 45934 - RNA, 672 nt, synthetic construct
  misc_feature 1..672: note = derived and/or modified sequence opt6 from Bevacizumab_180-substitution_deriv_HeavyCahin
  source 1..672: mol_type = other RNA
gaagtacaactagtagaatcaggaggcggactagtacaaccaggcggatcattaagattatcatgtgcagcatcaggatacacattcacaaactatggaatgaactgggtaagacaagctccaggaaaaggactagaatgggttggctggataaatacctatacaggagaaccaacatatgcagcagactttaaaagaagatttacattttcactagacacctctaaatcaacagcatatctacaaatgaatagcttaagagcagaagatacagcagtatattactgtgcaaaatacccacactattacggttccagccactggtattttgacgtatggggacaaggtacattagtaacagtatcatcagcatcaacaaaaggaccatctgtatttccattagcaccatcatcaaaatcaacatctggaggtacagcagcattaggatgtttagtaaaagattactttccagaaccagtaacagtatcatggaactcaggagctctaacatcaggagtacatacatttccagcagtatcacaatcatctggactatattccttatcatctgtagtaacagtaccatcatcatcccttggaacacaaacatatatatgtaatgtaaaccataaaccatcaaatacaaaagtagataaaaaagtagaaccaaaa

SEQ ID NO: 45935 - RNA, 1359 nt, synthetic construct
  misc_feature 1..1359: note = derived and/or modified sequence opt6 from Bevacizumab_beta_HeavyChain1
  source 1..1359: mol_type = other RNA
gaagttcaactagtagaatcaggtggaggattagtacaaccaggaggctcactaagattatcatgcgcagcctccggatacacattcacaaattacggaatgaattgggttcgacaagcaccaggaaaaggacttgaatgggttggttggataaacacatacacaggagaacctacttatgcagcagacttcaaacgtagatttacattctctttagacacatcaaaatcaacagcatacttacaaatgaattcattaagggcagaagatacagcagtatactactgcgctaaatatcctcattactacggatcatcacattggtactttgatgtatggggccaaggaacactagtcacggtttcatcagcatctacaaaaggacccagtgtttttccattagctccaagctcaaaaagcacatcaggcggaaccgcagctctaggatgcctagtcaaagattattttccagaacctgtaacagtatcatggaattcaggagccctaacttctggagtacacactttcccagcagtattacaatcatcaggtttgtactcactaagcagtgtagtaacagtaccttcatcatccttaggtacacaaacttatatttgtaacgtcaatcacaaaccaagtaacacaaaagtagataaaaaagttgaacccaaatcatgtgacaaaacccatacatgccccccctgcccagccccagaattattaggtggaccatcagtatttctatttccaccaaaacccaaagacactttaatgatctcacgtactccagaagtaacatgcgtagtagttgacgtatcccacgaagacccagaagtaaaatttaactggtacgtagacggagttgaagtacacaacgcaaaaactaaaccacgagaagaacaatacaatagcacctaccgtgtagtaagtgtactcacagtattacaccaagactggctaaatggaaaagaatataaatgtaaagtaagtaataaagcactaccagcaccaatcgaaaaaactatatcaaaagcaaaaggtcaaccaagagaaccacaggtatacacattaccaccatccagagaagaaatgacaaaaaatcaagtatccctaacctgtctagtaaaaggattttacccgtctgatatagcagtcgaatgggaatcaaacggacaacctgaaaacaactacaaaacaacacctccagtactcgacagtgacggctcattcttcttatattcaaaattaactgtagacaaatcaagatggcaacaaggtaacgtattttcatgttccgtaatgcacgaagcattacataaccactacacacaaaaatcactaagcttaagcccaggaaaa

SEQ ID NO: 45936 - RNA, 642 nt, synthetic construct
  misc_feature 1..642: note = derived and/or modified sequence opt6 from Bevacizumab_beta_LightChain1
  source 1..642: mol_type = other RNA
gatatccaaatgacacaatcaccatcatcactatcagcatctgtaggagacagagtaacaataacctgctcagcatcacaagacatatcaaactacttaaactggtaccaacaaaaacctggaaaagcaccaaaagtactaatatacttcacatcatcactacactcaggagttccatccagattctcaggctcaggatccggaacagacttcacactaaccatatcatcattacaaccagaagacttcgcaacatactactgccaacaatactccacagtaccatggacattcggacaaggaacaaaagtagaaataaaaagaacagtagccgcaccatcagtattcatattcccaccatcagacgaacaattaaaatcaggcacagcttcagtagtatgcttactaaacaacttctacccaagagaagccaaagtacaatggaaagtagacaacgcactacaatcaggaaactcacaagaatccgtaacagaacaagactccaaagactcaacatactcattatcatcaacattaacactatcaaaagccgactacgaaaaacataaagtatacgcatgcgaagtaacacatcaaggactatcctcaccagtaaccaaatcattcaatagaggagaatgc

SEQ ID NO: 45937 - RNA, 687 nt, synthetic construct
  misc_feature 1..687: note = derived and/or modified sequence opt6 from Bevacizumab_FcDomain
  source 1..687: mol_type = other RNA
tcatgcgataaaacacatacatgccccccatgcccagcaccagaactactaggaggaccatcagtattcctattcccaccaaaaccaaaagacacattaatgatatcaagaacacctgaagtaacatgcgtagtagtagatgtatcacacgaagacccagaagtaaaattcaactggtacgtagacggagtagaagtacacaatgcaaaaacaaaaccaagagaagaacaatacaactcaacatacagagtagtatcagtactaactgtactacaccaagactggctaaacggaaaagaatacaaatgcaaagtctcaaacaaagcactaccagccccaatagaaaaaacaatatcaaaagccaaaggacaaccaagagaaccacaagtctacacattaccaccatcaagagacgaactaacaaaaaaccaagtatcactaacatgcttagtaaaaggattctacccatccgacatagccgtagaatgggaatcaaacggacaaccagaaaataactacaaaacaacaccaccagtactagactcagacggatcattcttcttatactcaaaactaacagtagacaaatccagatggcaacaaggcaacgtattctcatgctcagtaatgcacgaggcacttcacaatcattacacacaaaaatcattatcactatcaccaggaaaa

SEQ ID NO: 45938 - RNA, 672 nt, synthetic construct
  misc_feature 1..672: note = derived and/or modified sequence opt6 from Bevacizumab_HeavyChain
  source 1..672: mol_type = other RNA
gaagtacaattagtagaatcaggaggaggactagtacaaccaggaggttcattaagattatcatgtgcagcatcaggatacacattcacaaactatggaatgaactgggtaagacaagcaccaggtaaaggtctagaatgggtaggatggataaatacatatacaggagaaccaacatatgcagcagactttaaaagaagatttacattttcattagacacatcaaaatcaacagcatatctacaaatgaattcattaagagcagaagacactgcagtatattactgcgcaaaatacccacactattatggatcatcacactggtactttgacgtatggggacaaggaacattagtaactgtatcaagcgcatcaacaaaaggaccatcagtattcccattagcaccaagctcaaaatctacatctggaggaacagctgcattaggatgtttagtaaaagattactttcctgaaccagtaaccgtatcatggaactctggagcactcacctcaggagtccatacattcccagctgtcctacaatcaagcggactatattcattatcatcagtagtaacagtaccatcatcatcactaggaacacaaacatatatatgtaacgtcaatcataaaccatcaaatacaaaagtagacaaaaaagtagaaccaaaa

SEQ ID NO: 45939 - RNA, 1428 nt, synthetic construct
  misc_feature 1..1428: note = derived and/or modified sequence opt6 from Bevacizumab_HeavyChain_variant1
  source 1..1428: mol_type = other RNA
gcttccgcaactatgggatggtcctgcataatattatttttagttgccactgcaacaggcgttcattcagaagtacaactagtcgaaagcggtggtggattagtacaaccaggtggatcactaagactatcatgcgccgcctcaggatatacatttaccaactatggaatgaattgggtccgacaagcaccaggaaaaggactagaatgggtcggctggataaacacatataccggagaaccaacctacgcagctgatttcaaaagaagatttacattttcactagacacatcaaaatctacagcataccttcaaatgaactcccttagagcagaagatacagcagtatactattgcgcaaaatatcctcactactacggatcatctcattggtatttcgacgtatggggacaaggaaccctagtaacagtatcatcagcatcaactaaaggtccatcagtatttccactagccccctcatcaaaatccacatcaggaggtacagcagcactcgggtgtttagtaaaagactatttcccagaaccagtaacagtatcctggaactcaggagcactcacatctggagtccatacatttccagctgtattacaatcatctggactttactcactatcatcagtagtaactgtaccatcttcatcattaggaacccaaacatatatctgcaatgtaaaccacaaaccttctaacacaaaagttgataaaaaagtagaaccaaaatcttgtgacaaaacacatacatgtccaccctgcccagcaccagaactattaggcggtccatctgtattcttattcccccctaaacccaaagacacactaatgatctctagaacccctgaagtaacatgcgtagtagtagacgtttcacacgaagacccagaagtaaaatttaattggtatgtagacggagtagaagttcacaacgcaaaaacaaaaccaagagaggaacaatacaacagtacatatagagtagtatcagtattaacagtattacatcaagattggttaaatggaaaagaatataaatgcaaagtttcaaataaagcactccctgcacctatagaaaaaacaatcagtaaagcaaaaggacaaccaagagaaccacaagtttacacactacctccctccagagaagaaatgacaaaaaatcaagtctccctcacatgtcttgttaaaggattttacccatctgacatcgcagttgaatgggaaagtaacggacaaccagaaaataactacaaaacaacaccaccagtcttagactcagatggatcatttttcttatactcaaaattaacagtagacaaatcaagatggcaacaaggaaacgtattttcatgctcagtaatgcacgaagccctgcataatcactacacacaaaaaagcttatcactttcaccaggaaaa

SEQ ID NO: 45940 - RNA, 369 nt, synthetic construct
  misc_feature 1..369: note = derived and/or modified sequence opt6 from Bevacizumab_HeavyChain_V-Region
  source 1..369: mol_type = other RNA
gaagtacaattagtagaaagtggaggaggattagtacaaccaggaggaagtttaagattaagttgtgcagcaagtggatatacatttacaaattatggaatgaattgggtaagacaagcaccaggaaaaggattagaatgggtaggatggataaatacatatacaggagaaccaacatatgcagcagattttaaaagaagatttacatttagtctagatacaagtaaaagtacagcatatttacaaatgaatagtctaagagcagaagatacagcagtatattattgtgcaaaatatccacattattatggaagtagtcattggtattttgatgtatggggacaaggaacattagtaacagtaagtagt

SEQ ID NO: 45941 - RNA, 717 nt, synthetic construct
  misc_feature 1..717: note = derived and/or modified sequence opt6 from Bevacizumab_LightChain1
  source 1..717: mol_type = other RNA
gcatccaaattagcaacaatgggatggtcttgcatcatattattcctagtagcaacagcaacaggagtacactcagacatacaaatgacacaatcaccatcatcactatcagcatcagtaggagacagagtaacaataacatgcagagcatcacaagacatatcatcatatttaaactggtaccaacaaaaaccaggaaaagcaccaaaactactaatatactacacatcaagactacacagcggagtaccatccagattctcaggatcaggctcaggcacagacttcaccttcaccatatcatcattacaaccagaagacatagctacatactactgccaacaaggaaacacattaccatacaccttcggacaaggaacaaaagtagaaataaaaagaacagtcgcagccccatccgtattcatattcccaccatcagatgaacaattaaaatcaggaacagcatcagtagtatgcctattaaacaacttctacccacgagaagcaaaagtacaatggaaagtagacaacgcactacaatcaggaaattctcaagaatcagtaacagaacaagactcaaaagactcaacatactccctatcatcaaccttaactctatccaaagcagactacgaaaaacacaaagtatacgcatgcgaagtaacacaccaaggactaagttcaccagtaaccaaatcattcaacagaggcgaatgc

SEQ ID NO: 45942 - RNA, 711 nt, synthetic construct
  misc_feature 1..711: note = derived and/or modified sequence opt6 from Bevacizumab_LightChain2
  source 1..711: mol_type = other RNA
gcatcagcaacaatgggctggagctgcataatattattcctagtagcaaccgcaaccggagtacactctgacatacaaatgacacaatcaccatcatcactatcagcatcagtaggcgacagagtaacaataacatgctcagcctcacaagacatatcaaactatctcaactggtaccaacaaaaaccaggaaaagcaccaaaagtcctaatatacttcacctcatcattacactcaggcgtaccatcaagattctcaggatcaggctcaggaacagactttacactaacaatatcatcactacaaccagaagacttcgcaacatactattgtcaacaatactcaacagtaccctggaccttcggacaaggaacaaaagtagaaataaaaagaacagtagcagcaccatcagtattcatattcccaccatcagacgaacaattaaaatcaggaacagcatcagtagtatgcctactaaacaacttctaccccagagaagcaaaagtccaatggaaagtagataacgcattacaatcaggaaattcacaagaatcagtcacagaacaagactcaaaagactcaacatattccctatcctcaacactaacactatccaaagcagactatgaaaaacacaaagtatacgcatgcgaagtcacacaccaaggactctcatcaccagtaactaaatcattcaatagaggagaatgt

SEQ ID NO: 45943 - RNA, 642 nt, synthetic construct
  misc_feature 1..642: note = derived and/or modified sequence opt6 from Bevacizumab_LightChain
  source 1..642: mol_type = other RNA
gacatacaaatgacccaatcaccatcatcattatccgcatcagtaggagacagagtaacaataacatgttcagcatcacaagacatatcaaactacttaaactggtaccaacaaaaaccaggaaaagcaccaaaagtactaatatacttcacatcatcattacactcaggagtaccatcaagattctcaggatcaggatcaggaacagacttcacactaacaatatcatcactacaaccagaagacttcgcaacatactactgccaacaatactcaacagtaccatggacattcggacaaggaacaaaagtagaaatcaaaagaacagtcgcagcaccatcagtattcatattcccaccatcagacgaacaactaaaatcaggaacagcatccgtagtatgcctactaaacaacttctacccaagagaagcaaaagtacaatggaaagtagacaacgctttacaatcaggaaactcacaagaatcagtaacagaacaagactccaaagactcaacatactcactatcatcaacactaacactatccaaagcagactacgaaaaacacaaagtatacgcatgcgaagtaacacaccaaggactatcctcaccagttacaaaatcattcaacagaggagaatgc

SEQ ID NO: 45944 - RNA, 324 nt, synthetic construct
  misc_feature 1..324: note = derived and/or modified sequence opt6 from Bevacizumab_LightChain_VJ-Region
  source 1..324: mol_type = other RNA
gacatacaaatgacacaatcaccatcatcactatcagcatcagtaggagacagagtaacaataacatgctcagcatcacaagacatatcaaactacctaaactggtaccaacaaaaaccaggaaaagcaccaaaagtactaatatacttcacatcatcactacactcaggagtaccctcaagattctcaggatcaggatcaggaacagacttcacactaacaatatcatcactacaaccagaagacttcgcaacatactactgccaacaatactcaacagtaccatggacattcggacaaggaacaaaagtagaaataaaaaga

SEQ ID NO: 45945 - RNA, 321 nt, synthetic construct
  misc_feature 1..321: note = derived and/or modified sequence opt6 from Bevacizumab_LightChain_V-Region
  source 1..321: mol_type = other RNA
gacatacaaatgacacaatcaccatcatcactatcagcatcagtaggagacagagtaacaataacatgctcagcatcacaagacatatcaaactacctaaactggtaccaacaaaaaccaggaaaagcaccaaaagtactaatatacttcacatcatcactacactcaggagtaccatcaagattctcaggatcaggatcaggaacagacttcacactaacaatatcatcactacaaccagaagacttcgcaacatactactgccaacaatactcaacagtaccatggacattcggacaaggaacaaaagtagaaataaaa

SEQ ID NO: 45946 - RNA, 369 nt, synthetic construct
  misc_feature 1..369: note = derived and/or modified sequence opt6 from Bevacizumab-rhuMAb-VEGF_HeavyChain_gamma1-Chain_VDJ-Region
  source 1..369: mol_type = other RNA
gaagtacaactagtagaatcaggaggaggattagtacaaccaggaggatcattaagactatcatgtgcagcatcaggatatacatttacaaattatggaatgaattgggtaagacaagcaccaggaaaaggattagaatgggtaggatggataaatacatatacaggagaaccaacatatgcagcagattttaaaagaagatttacattcagtctagatacatcaaaatcaacagcatatctacaaatgaattcattaagagcagaagacacagcagtatattattgcgcaaaatatccacattattatggatcaagtcattggtattttgatgtatggggacaaggaacattagtaacagtaagttca

SEQ ID NO: 45947 - RNA, 321 nt, synthetic construct
  misc_feature 1..321: note = derived and/or modified sequence opt6 from Bevacizumab-rhuMAb-VEGF_LightChain_VJ-Region
  source 1..321: mol_type = other RNA
gacatacaaatgacacaatcaccatcatcactatcagcatcagtaggagacagagtaacaataacatgctcagcatcacaagacatatcaaactacctaaactggtaccaacaaaaaccaggaaaagcaccaaaagtactaatatacttcacatcatcactacactcaggagtaccatcaagattctcaggatcaggatcaggaacagacttcacactaacaatatcatcattacaaccagaagacttcgcaacatactactgccaacaatactcaacagtaccatggacattcggacaaggaacaaaagtagaaataaaa

SEQ ID NO: 45948 - RNA, 1341 nt, synthetic construct
  misc_feature 1..1341: note = derived and/or modified sequence opt6 from Bevacizumab_gamma1-Chain
  source 1..1341: mol_type = other RNA
gaagttcaattagttgaatcaggcggaggactagtacaaccaggaggctccctaagattatcatgcgcagcatcaggatatacattcaccaattacggaatgaattgggtaagacaagcacctggcaaaggactagaatgggtaggatggataaacacatacacaggagaacccacatatgcagcagacttcaaaagaagattcactttttcattagacactagtaaatcaacagcatatctacaaatgaactcactaagagcagaagacacagccgtttattattgtgcaaaatatccacattactacggaagctcacattggtattttgatgtttggggacaaggaactttagtcactgtctcctcagcctctacaaaaggaccatcagtatttccactagccccctcttcaaaaagcacatccggaggaaccgcagcactaggttgtctagttaaagactatttcccagaaccagtaacagtctcctggaactcaggcgcactcacttccggagtacatactttccccgcagtcttacaatcatcaggatctctatcttcagtagtcacagtcccatcatcatcactcggaacccaaacatacatatgtaatgtaaatcacaaaccttcaaacacaaaagtcgacaaaaaagtagaacccaaatcttgcgacaaaacacacacatgtccaccatgcccagctcctgaattactaggaggtccatcagttttccttttccccccaaaaccaaaagacacacttatgatctcaagaaccccagaagtaacatgcgttgttgtagacgtctcacacgaagatcccgaagtaaaatttaactggtacgtagatggagtagaagtacataacgcaaaaacaaaacccagagaagaacaatacaactcctatgttgtttcagtattaacagtattacatcaagactggttaaacggcaaagaatacaaatgtaaagtatcaaacaaagctttacctgcaccaatagaaaaaacaatatcaaaagcaaaaggacaaccacgagaaccccaagtttatacattaccaccatctagagacgaacttacaaaaaaccaagtcagtttaacatgcttagtcaaaggcttctatccaagtgacatagcagtcgaatgggaatccaacggacaaccagaaaataattacaaaacaaccccaccagtattagattcagacggttcttttttcaaaaaactaactgtagacaaatcaagatggcaacaaggaaatgttttctcctgttcagtaatgcacgaagcattacacaaccattacacacaaaaatctttatcactatcaccaggaaaa

SEQ ID NO: 45949 - RNA, 1359 nt, synthetic construct
  misc_feature 1..1359: note = derived and/or modified sequence opt6 from Bevacizumab_gamma1-Chain_CH3-Region_mutein
  source 1..1359: mol_type = other RNA
gaagtacaactagtagaaagtggaggcggcttagtacaacccggaggatcactacgattatcttgcgccgcatcaggctacacttttacaaattacggaatgaactgggtaagacaagccccaggaaaaggcctagaatgggttggatggataaatacatacactggtgaaccaacatatgccgcagattttaaacgaagattcacatttagtctagacacttcaaaatcaacagcctatttacaaatgaattctttaagagcagaagatacagccgtctattactgtgcaaaatacccacactattacggatcatcacactggtactttgacgtctggggacaaggaactttagtcacagtatcatccgcaagtactaaagggccatccgtattcccacttgcaccaagctcaaaatcaacatcaggaggaaccgcagcattaggatgtctagtaaaagattactttcccgaaccagttaccgtatcctggaactccggagccttaacatcaggagtccatacctttcctgcagttctacaatcatctggcctttactcactatcatctgtagtaactgtaccctcttcatcattaggaacacaaacatatatatgtaacgtaaaccataaaccatcaaatacaaaagtagataaaaaagtagaaccaaaaagttgtgacaaaacacacacatgtcccccatgccctgcaccagaactcctaggaggaccatcagtattcttatttccaccaaaacccaaagatactttaatgatatcaagaacccccgaagtaacatgtgtcgttgtagatgtctcacatgaagaccctgaagtaaaattcaattggtatgtagacggagtagaagtacacaatgccaaaacaaaaccccgagaagaacaatataactcaacatacagagttgtatcagtattaactgtattacaccaagactggctaaatggaaaagaatacaaatgtaaagtatctaacaaagcacttccagcaccaatcgaaaaaacaatttccaaagccaaaggacaaccccgagaaccccaagtttgtactctaccaccatcaagagatgaacttacaaaaaaccaagtatcactatcatgcgcagtcaaaggattctatccatccgatatcgctgtagaatgggaaagcaacggacaaccagaaaacaattataaaacaacaccaccagtattagactctgacggttcattttttctagtttcaaaacttacagtagacaaatcaagatggcaacaaggaaacgtattctcttgctctgtcatgcacgaagcattacacaaccactacacacaaaaatcattatccctatcaccaggaaaa

SEQ ID NO: 45950 - RNA, 1347 nt, synthetic construct
  misc_feature 1..1347: note = derived and/or modified sequence opt6 from Bezlotoxumab_HeavyChain1
  source 1..1347: mol_type = other RNA
gaagtccaactagtacaatcaggagctgaagtaaaaaaatccggagaatccctaaagatatcatgcaaaggcagcggatacagctttacatcatactggataggatgggtacgacaaatgccaggaaaaggattagaatggatgggaatattttatccaggagattcatctactagatactccccatctttccaaggacaagttacaatatcagcagacaaatctgtaaataccgcttaccttcaatggagctctctaaaagcatcagacacagcaatgtactattgcgcaagaagaagaaattggggcaacgctttcgatatatggggccaaggaacaatggtaacagtatcaagcgcttcaacaaaaggacctagtgtattcccactagcaccctccagcaaaagtacatcaggaggaacagcagctctaggctgtctagtaaaagactacttcccagaaccagttacagtatcttggaattcaggagcactcacatcaggtgtacacacattccctgcagtactacaaagctcaggactctattctctatcatcagtagtaacagtaccaagctctagtctaggaacacaaacatacatttgcaatgtaaatcataaaccatcgaatacaaaagtagacaaaagagtagaaccaaaatcatgcgataaaacacacacttgcccaccctgccctgcacccgaactattaggcggtccatctgtatttctattcccacctaaacctaaagacacattaatgatatcaagaacacctgaagtaacatgcgtagttgtagacgtatcacatgaagacccagaagtaaaatttaactggtacgtagacggcgtagaagtacacaatgcaaaaaccaaaccaagagaagaacagtataacagtacatacagagtagtaagcgtattaacagtacttcatcaagattggctcaatggaaaagaatacaaatgtaaagtatcaaataaagcattaccagcaccaatagaaaaaacaatatcaaaagccaaaggacaacccagagaaccacaagtatacacattaccaccttcaagagaagaaatgacaaaaaatcaagtaagtttaacatgtttagtaaaaggattctacccaagcgacatagccgttgaatgggaatctaacggacaaccagaaaataactataaaacaacaccacccgtactagacagcgatggatcctttttcctttactccaaactaacagtagataaatcaagatggcaacaaggaaatgtattttcatgttcagtaatgcatgaagcactacacaaccattatacacaaaaatcattaagtttatcccccggaaaa

SEQ ID NO: 45951 - RNA, 645 nt, synthetic construct
  misc_feature 1..645: note = derived and/or modified sequence opt6 from Bezlotoxumab_LightChain1
  source 1..645: mol_type = other RNA
gaaatagtcctaacccaatcaccaggaacactatcactatcacccggagaacgagcaacattatcatgcagagcatcacaatcagtatcatcatcatacctagcctggtaccaacaaaaacccggacaagcaccaagattactaatctacggagcatcatcaagagcaacaggaataccagacagattctctggatcaggatcaggaacagatttcacactaactatatcaagactagaaccagaagacttcgcagtatactactgtcaacaatacggatcatcaacatggacattcggacaaggaacaaaagtcgaaatcaaaagaacagtagcagcaccatccgtatttatattcccaccatcagacgaacaattaaaatcaggaacagcatcagtcgtatgcttactaaacaacttctacccaagagaagcaaaagtacaatggaaagtagacaacgcactacaatcaggtaactcacaagaatcagtaacagaacaagactcaaaagactcaacatactcactatcatcaacattaaccctatccaaagccgactacgaaaaacacaaagtatacgcatgcgaagtaacacaccaaggactatcatcaccagtaaccaaatcattcaacagaggagaatgc

SEQ ID NO: 45952 - RNA, 1335 nt, synthetic construct
  misc_feature 1..1335: note = derived and/or modified sequence opt6 from Bimagrumab_HeavyChain1
  source 1..1335: mol_type = other RNA
caagtacaactagtacaatcaggagccgaagtaaaaaaaccaggagcaagcgtaaaagtctcatgcaaagcatcaggatatacattcacttcatcatatataaactgggttagacaagcaccaggtcaaggactagaatggatgggaactataaacccagtctcaggatcaacatcatatgcacaaaaatttcaaggaagagtcacaatgactagagacactagtatatccacagcatatatggaactatcaagactaagatctgatgacacagcagtatattactgcgccagaggaggatggttcgactattggggtcaaggaaccctagttacagtatcatcagcatccacaaagggaccatcagttttcccactagcaccctcatcaaaatcaacatcaggaggaacagcagcattaggatgcttagtgaaagactacttccctgaaccagtaaccgtttcatggaacagtggagcattaacatccggtgtccataccttccccgcagtcttacaatcaagcggactatactcactaagttcagtagttacagtcccctcaagttcactcggaacacaaacttacatatgcaacgtcaaccacaaaccaagcaacactaaagtagacaaaagagtagaaccaaaatcatgcgataaaacacatacatgtccaccatgcccagcaccagaagctgcaggaggaccttccgtatttttattcccaccaaaacccaaagacaccctaatgatatctagaacaccagaagttacatgcgtcgtagttgacgtttcacatgaagacccagaagtaaaattcaattggtatgtagatggagtagaagtacacaacgcaaaaacgaaacccagagaagaacaatacaactcaacatacagagtagtatcagtattaacagtattacaccaagattggttaaacggaaaagaatacaaatgcaaagtatcaaataaagcacttccagcaccaatagaaaaaacaatatcaaaagcaaaaggacaaccacgagaaccacaagtatacaccttaccaccctcaagagaagaaatgacaaaaaaccaagtctcgttaacatgtctagtaaaaggattctacccatcagacatcgcagtcgaatgggaatcaaacggccaaccagaaaataactacaaaacaacaccaccagtactagactctgacggatcattcttcctctacagtaaattaacagttgacaaatccagatggcaacaaggaaatgtattctcctgctcagtcatgcatgaagccctacacaaccactatacacaaaaatcattatcattaagcccaggaaaa

SEQ ID NO: 45953 - RNA, 1332 nt, synthetic construct
  misc_feature 1..1332: note = derived and/or modified sequence opt6 from Bimagrumab_HeavyChain
  source 1..1332: mol_type = other RNA
caagttcaactagtacaatcaggagccgaagttaaaaaaccaggagcctcagtaaaagtatcatgtaaagcatcaggatatacattcacatcttcctacataaattgggtaagacaagcccctggacaaggattagaatggatgggtacaataaaccccgtatctggatctacttcatacgcacaaaaattccaaggacgagtaactatgacaagagacacatctatatcaactgcttacatggaattatcaagactaagatccgacgacaccgcagtatactactgcgcaagaggaggctggttcgattactggggacaaggaactttagtaacagtatcatcagcatctacaaaaggaccatcagtctttccattagccccatcatctaaatccacatcaggaggaacagcagccttaggatgcttagtaaaagattattttccagaaccagtaacagtatcttggaattcaggagcactaacatcaggagtccacacttttcctgcagttttacaatcctcaggcctctactcattatcatcagtagtcacagtaccatcaagcagtttaggaacacaaacatacatatgtaacgtcaaccataaaccgtcaaatactaaagtagataaaagagttgaaccaaaatcctgcgataaaacacacacatgtcccccatgcccagctccagaagcagccggcggaccatccgtattcttattcccgccaaaaccaaaagacacactaatgatcagccgaacacccgaagtcacctgtgttgtagttgacgtatctcacgaagatcccgaagtaaaattcaactggtacgtagatggcgtcgaagtccataatgcaaaaacaaaacctcgtgaagaacaatataattctacataccgagtagtttcagtcctaacagtactacatcaagactggctaaatggaaaagaatacaaatgtaaagtatcaaacaaagcattaccagcacccatagaaaaaactatatcaaaagcaaaaggacaacccagggaacctcaagtatatacattacccccttcaagagaagaaatgacaaaaaatcaagtatcattaacctgcttagtaaaaggattttacccatcagacatagcagtagaatgggaatctaacggacaaccagaaaataactacaaaactacaccacctgtattagactcagatggatcattctttctatactccaaactaacagtagacaaatctcgatggcaacaaggcaatgtattctcctgttcagtgatgcacgaagcactacataaccattacacgcaaaaaagtctatctctttcaccagga

SEQ ID NO: 45954 - RNA, 651 nt, synthetic construct
  misc_feature 1..651: note = derived and/or modified sequence opt6 from Bimagrumab_LightChain1
  source 1..651: mol_type = other RNA
caatcagcattaacacaaccagcatcagtatcaggctcaccaggacaatcaataacaatatcttgcacaggaacatcatccgacgtaggatcctacaactacgtaaactggtatcaacaacatcccggaaaagccccaaaattaatgatatacggagtatcaaaaagaccatcaggagtatcaaacagattctcaggatcaaaatcaggaaacacagcatccctaacaatatcaggattacaagcagaagacgaagcagactactactgcggaacattcgcaggaggatcatactacggagtattcggaggcggaacaaaattaacagtactaggacaaccaaaagcagcaccatccgtaacactattcccaccatcatccgaagaactacaagctaacaaagcaacattagtatgcctaatatcagacttctacccaggagcagtaacagtagcatggaaagcagactcatccccagtaaaagcaggagtagaaacaacaacaccatcaaaacaatcaaacaacaaatacgcagcatcatcatacctatcactaacaccagaacaatggaaatcacacagatcatattcatgccaagtaacacatgaaggatcaacagtagaaaaaacagtagcacccaccgaatgctca

SEQ ID NO: 45955 - RNA, 1365 nt, synthetic construct
  misc_feature 1..1365: note = derived and/or modified sequence opt6 from Bimekizumab_HeavyChain1
  source 1..1365: mol_type = other RNA
gaagtacaactagtagaatctggtggaggactcgtacaaccaggaggatccctaagactctcatgcgccgcatcaggattcacattctcagactacaacatggcctgggtacgccaagcacccggcaaaggactagaatgggtagcaacaataacatacgaaggaagaaatacttattacagagactcagtcaaaggacgcttcacaatttcacgtgacaacgcaaaaaatagtctatacctacaaatgaactcactaagagcagaagacacagctgtctactactgtgcatcacctccccaatactacgaaggatcaatatacagactatggtttgcacactggggacaaggaacactcgtaacagtatcatccgcatcaactaaaggtccttcagtattcccactagctccatcatctaaatcaacatcaggaggtactgcagcattaggatgcctagtaaaagattacttcccagaaccagtaacagtatcatggaacagcggagcactcacatcaggagtacataccttcccagccgtcctacaatcatcaggactatacagtttatcatcagtagtaacagtaccaagttcctcactaggaactcaaacctatatctgcaacgtaaaccataaaccatcaaacacaaaagtggacaaaaaagtagaaccaaaatcttgcgataaaacacacacatgccctccctgcccagcaccagaactactaggaggaccttcagtatttctattcccacccaaaccaaaagatacacttatgatatcaagaaccccagaagtaacatgcgtagtagtcgacgtttcccatgaagatccagaagtaaaattcaactggtacgtagacggagttgaagtacacaatgcaaaaacaaaaccaagagaagaacaatataactcaacataccgtgtcgttagcgtacttacagtactacaccaagactggctcaacggaaaagaatacaaatgcaaagtatcaaacaaagcactaccagccccaatagaaaaaaccatatcaaaagcaaagggtcaaccccgagaaccccaagtttacacactaccaccaagccgagacgaactaaccaaaaaccaagtatcactaacatgcctcgtaaaaggcttctacccatcagacatcgcagtagaatgggaatcaaacggacaaccagaaaacaactacaaaacaacaccacccgtcttagacagcgacggttcatttttcctatattccaaattaacagtagacaaatctagatggcaacaaggaaacgtattctcatgctcggtaatgcacgaagcactacacaatcactatacacaaaaatcattatccctaagcccaggaaaa

SEQ ID NO: 45956 - RNA, 642 nt, synthetic construct
  misc_feature 1..642: note = derived and/or modified sequence opt6 from Bimekizumab_LightChain1
  source 1..642: mol_type = other RNA
gcaatacaactaacacaatcaccatcatcactaagcgcatcagtaggagacagagtaacaataacatgcagagcagacgaaagcgtaagaacactaatgcactggtaccaacaaaaaccaggaaaagcaccaaaactattaatctacctagtatcaaacagcgaaataggagtaccagacagattctcaggatcaggatcaggaacagatttcagactaacaataagctcactacaaccagaagactttgcaacatactattgccaacaaacatggtcagacccatggacattcggacaaggaacaaaagtagaaataaaaagaacagtagcagcaccaagcgtattcatattcccaccctcagacgaacaactaaaatcaggaacagcatcagttgtatgcctactaaataacttttacccaagagaagcaaaagtccaatggaaagtagacaacgcactacaatcaggaaactcacaagaaagcgtaacagaacaagactcaaaagactcaacatacagtttaagctcaacactaacactaagtaaagccgattacgaaaaacataaagtatacgcatgcgaagtcacacaccaaggattaagctcaccagtaacaaaaagcttcaacagaggagaatgc

SEQ ID NO: 45957 - RNA, 1344 nt, synthetic construct
  misc_feature 1..1344: note = derived and/or modified sequence opt6 from Bleselumab_HeavyChain1
  source 1..1344: mol_type = other RNA
caattacaacttcaagaatcaggaccaggactactaaaaccttccgaaacactcagtctaacatgtacagtatccggaggatccatatcatcccctggatattacggaggttggataagacaacccccaggaaaaggtttagaatggataggatcaatatacaaatcaggaagtacatatcataacccatcactaaaatcacgagtcacaatctcagtagatacatctaaaaaccaattctcactaaaactatcatctgtaactgcagctgacactgcagtctactactgtacaagaccagtagtccgctattttggatggttcgacccatggggacaaggaacattagtcacagtttcctccgcctcaacaaaaggtccatcagtattccctttagccccatgctcacgatcaacatctgaatcaacagctgcactaggatgtctagtaaaagactactttccagaacccgttaccgtctcttggaattccggagccttaacctcaggcgtacatacatttccagccgtcctacaatcttctggtctatattccttatcatccgtagtcacagtaccatcctcatctttaggcacaaaaacatatacatgtaacgtagatcataaaccttcaaatacaaaagtagataaaagagtagaatcaaaatatggacccccatgcccaccatgcccagcaccagaattcgaaggaggaccaagcgtctttttatttccaccaaaaccaaaagatacacttatgatttctagaaccccagaagtaacatgtgtagtagtcgatgtatctcaagaagatcctgaagttcaatttaactggtacgtagacggagtagaagtacacaatgcaaaaacaaaaccccgcgaagaacaatttaattcaacatacagagtagtatctgttctaacagtccttcaccaagactggctaaacggaaaagaatataaatgcaaagtatcaaataaaggactcccatcatccatcgaaaaaacaatatccaaagctaaaggacaacccagagaaccacaagtatataccctaccaccaagtcaagaagaaatgacaaaaaaccaagtttctttaacatgtctagtaaaaggattctatccatcagacattgccgtagaatgggaaagcaacggacaacctgaaaataattataaaacaacacctccagtattagacagcgatggatccttttttttatattcacgactaaccgtagataaatctcgttggcaagaaggcaatgtattctcatgttccgtaatgcatgaagccctacataatcattacacacaaaaatcactttcacttagcttaggtaaa

SEQ ID NO: 45958 - RNA, 639 nt, synthetic construct
  misc_feature 1..639: note = derived and/or modified sequence opt6 from Bleselumab_LightChain1
  source 1..639: mol_type = other RNA
gcaatacaactaacccaatcaccatcatcactatctgcatcagtaggagacagagtaacaataacatgcagagcatcacaaggaatatcatcagcactagcatggtaccaacaaaaaccaggaaaagcaccaaaattactaatatacgacgcatcaaacttagaatcaggagtaccatcacgattctcaggatcaggatcaggaacagatttcacactaacaatatcatccctacaaccagaagacttcgcaacatactattgccaacaattcaactcatacccaacattcggacaaggaacaaaagtcgaaataaaacgaacagtagcagctccatcagtattcatattcccaccatcagacgaacaattaaaatccggaacagcaagcgtagtatgcctattaaacaacttctacccacgagaagcaaaagtacaatggaaagtagacaatgcactacaatcaggaaactcacaagaatcagtaacagaacaagactcaaaagactcaacatactcactatcatcaacactaacactatccaaagcagactatgaaaaacacaaagtatacgcatgtgaagttacacaccaaggactatcttcacccgtaacaaaatccttcaacagaggcgaatgc

SEQ ID NO: 45959 - RNA, 1512 nt, synthetic construct
  misc_feature 1..1512: note = derived and/or modified sequence opt6 from Blinatumomab_HeavyChain1
  source 1..1512: mol_type = other RNA
gatattcaactaacacaatcaccagcaagtttagcagtatcgttaggacaaagagcaacaattagttgtaaagcaagccaaagcgttgattatgacggagatagctatttaaattggtaccaacaaattccaggccaaccaccaaaactattgatatatgacgcctcaaatttagtaagcggaatacctccaagatttagcggatcaggaagtggtactgattttacattaaacatacacccagtcgaaaaagtagatgccgctacatatcattgccaacaatcaacagaagacccatggacatttggaggtggaactaaactagaaattaaaggaggcggcggatctggaggagggggaagtggaggcggaggaagtcaagtacaattacaacaaagtggagcagaactcgttagacccggatcaagtgtaaaaattagttgcaaagccagcggatatgcattcagcagttattggatgaattgggttaaacaacgaccaggacaaggtttagaatggattggacaaatttggcctggagacggagatacaaattataatggaaaattcaaaggaaaagccacactaacagcagacgaaagtagctcaacagcatatatgcaattaagtagtttagcaagtgaagattcagcagtttatttttgtgcaagaagagaaaccacgacagtaggaagatactattatgcaatggattactggggacaagggacaaccgtaacagtatcatcaggaggcggaggatcagatataaaattacaacaatcaggtgcagaattagcaagaccaggagcaagcgtaaaaatgtcatgcaaaacaagcggatatactttcacaagatacaccatgcactgggtaaaacaaagacctggacaaggattagaatggataggttatataaatccaagtagaggatatacaaattataatcaaaaattcaaagacaaagcaacactaacaactgataaatccagtagcacagcatacatgcaacttagtagtttaacatcagaggatagcgcagtatattattgtgctagatattatgacgaccattattgtttagactattggggacagggaactactttaacagtatctagcgtagaaggaggatccggaggaagtggcggatcaggaggaagtggaggagtggacgatatacaactaacacagagtccggctataatgagcgcaagtcccggagaaaaagtaacaatgacatgtcgagcatcatcatcagtatcctatatgaattggtatcaacaaaaatcagggacaagtccaaaaagatggatatatgacacaagtaaagtagcaagcggagtaccatatagattttcaggtagcgggtcaggaacaagttatagcctaacaataagttcaatggaagcagaagatgccgcaacatattattgccaacaatggagtagcaatccattgacttttggagcaggaacaaaattagaactgaaacatcatcatcaccaccat

SEQ ID NO: 45960 - RNA, 1512 nt, synthetic construct
  misc_feature 1..1512: note = derived and/or modified sequence opt6 from Blinatumomab_SingleChain
  source 1..1512: mol_type = other RNA
gatattcagttaacacaatcgccagctagtctagcagtaagtttaggtcaacgagcaacaattagttgtaaagcatctcaaagcgttgattatgatggtgactcttatctaaattggtatcaacaaataccaggacaaccaccaaaattattgatttatgacgcgagtaatttagtaagtggaatacctccaaggttttcaggatcagggtcaggaacagactttacattaaatatacatcctgttgaaaaagttgatgcagcaacctaccattgccaacaatcaacagaagacccatggacttttggaggaggaacaaaacttgaaattaaaggaggaggaggaagtggaggtggaggttcaggaggaggaggatcacaagttcaattgcaacaatcaggagcagaattagtaagaccaggaagtagtgtcaaaatatcatgtaaagctagtggatatgccttctcctcatactggatgaactgggtaaagcaaagaccaggtcaaggattagaatggataggacaaatttggccaggagatggagatacaaattataatggaaaatttaaaggtaaagcaactctaactgcagatgaatcatcatcaactgcatatatgcaattatcttcactagcaagtgaggattcagcagtatatttttgtgcaagaagagaaactacaactgtaggaagatattattatgcgatggattattggggacaaggaacaacagtaactgtatcaagtggaggcggaggatcagatataaaattgcaacagagtggtgctgaattagcaagaccaggggcctctgtaaaaatgagttgcaaaacaagcggatatacattcacaagatatacaatgcattgggtcaaacaacgaccaggacaaggactagaatggattggatatataaatccttcaagaggatacacaaactataatcaaaaattcaaagataaagctacactgacaacagacaagtcatcaagtacagcttatatgcaattaagtagtttaacatcagaagatagtgcagtatattattgtgcaagatactatgacgatcattattgtttagactactggggacaaggaacgactttaacggttagcagtgtagaaggaggatcaggaggaagcggaggatcaggaggatctggaggtgtagacgatatacaattgacacaatcaccagctataatgagtgctagcccaggagaaaaagtcacaatgacatgtagagcaagttcatcagtttcatatatgaattggtatcaacaaaaaagcggaacaagtcctaagagatggatatacgatacctccaaagtagcatctggagtaccatacagattttcagggagtgggagtggtacatcatactcattaacaataagttcaatggaagcagaagatgccgcaacatattattgtcaacaatggtcatcaaaccctctaacatttggagccggaacaaaattagaattaaaacatcaccatcatcatcac

SEQ ID NO: 45961 - RNA, 1512 nt, synthetic construct
  misc_feature 1..1512: note = derived and/or modified sequence opt6 from Blinatumumab_SingleChain_variable_fragment_fusion_protein_( bite)
  source 1..1512: mol_type = other RNA
gatatacaattaacacaaagcccagcaagtttagcagtgagtttagggcaaagagcaacaataagttgtaaagcaagtcaaagtgtagattatgacggagactcatatttaaattggtatcaacaaataccaggacaaccaccaaaattattaatatatgatgcaagtaacttggtatcaggaataccaccaaggttcagcggatcaggatcaggaacagatttcacattaaatattcatcccgtcgaaaaagtagacgcagcaacatatcactgccaacaaagcaccgaagatccatggacatttggtgggggaaccaaactagaaataaaaggcggaggcggatcaggaggtggagggagtggaggaggaggatcacaggtacaattacaacaatcaggcgccgaattagtaagaccaggatcatcagtaaaaatatcatgtaaagcatcaggttatgcatttagttcatactggatgaattgggtgaaacaaagaccgggacaaggattagaatggattggacaaatatggccaggagacggagatacaaattataatggaaaatttaaaggaaaagcaacactaacagctgacgaatcaagctctactgcctatatgcaactaagttcattagcaagtgaagattcagctgtttatttctgtgcaaggagagaaactacaacagtaggtagatattactacgctatggactattggggacaaggaaccacagtaacagtatcaagtggaggaggaggatcagatataaaattacaacaaagtggagcagaattagcaagaccaggcgcaagtgtaaaaatgtcatgtaaaacaagtggatacacatttacaagatatacaatgcattgggtaaaacaaaggccaggtcaagggttagaatggataggatatataaacccaagtagaggatatacaaattataatcaaaaatttaaggacaaagcaactttaactacagataaatcaagtagcacggcctatatgcaattatcatcactaacttcagaggattcagcggtatactattgtgcaagatattacgatgatcattattgtcttgattattggggacaaggaacaacattaacagtatcaagcgttgaaggagggtcaggaggtagtggagggtcaggcggatcaggaggagtagatgatatacaactaactcaaagtccagctataatgagcgcaagtccaggagaaaaagtaaccatgacatgtagggcaagttctagcgtaagctacatgaattggtaccaacaaaaaagcggaacaagtccgaaaagatggatatatgataccagtaaggttgctagtggagtaccatatagatttagtggaagcggtagtggaacaagttatagtttaacaatttcaagtatggaagcagaagatgcagcaacatactactgtcaacaatggtcaagcaatccactaacttttggagcaggaacaaaactggaattaaaacatcatcatcatcatcat

SEQ ID NO: 45962 - RNA, 1344 nt, synthetic construct
  misc_feature 1..1344: note = derived and/or modified sequence opt6 from Blontuvetmab_HeavyChain
  source 1..1344: mol_type = other RNA
caagtacaacttcaacaaagtcgagcagaattagtcagacctggagcatcagtaacattatcatgcaaaccctcaggatacacattcacagactacgaagtacactgggtaaaacaaacccctgtacacggcctagaatggattggagcaatagacccagaaaccggcggcacagccgataaccaaaaatttaaaggaaaagcaatattaacagctgacaaatcatcctcaacagcatatatggaacttagatccttaacatccgaagacagcgcagtttattactgcacaaatttcgtagacgtatggggaaccggaaccacagtcacagttagctcagcttcaacaacagccccatcagtatttccattagcaccatcctgcggctctcaatcaggatcaacagtagcactcgcctgtctagtttccggatactttccagaaccagtcacagtatcctggaactccggatccctcacttcaggagtacacacatttccatcagtcctccaatcttccggactatattctttatcatcaatggttacagtaccatcatctcgctggccttcagaaacattcacatgtaatgttgcacatcccgcatcaaaaaccaaagtagataaaccagtaccaaaaagagaaaacggaagagtaccaagaccaccagactgtccaaaatgtccagctccagaaatgttaggcggaccatcagtattcatatttccaccaaaaccaaaagataccttattaatagcacgaacaccagaagtaacatgtgttgtagtagatctagatccagaagaccctgaagtacaaatcagttggtttgttgacggcaaacaaatgcaaacagcaaaaacacaacctagagaagaacaatttaatggcacatatcgagtagtatccgtcctccctatcggccaccaagactggctaaaaggaaaacaatttacatgcaaagtaaataacaaagccttaccatcacccatagaaagaactatatcaaaagctagaggacaagctcatcaaccatcagtatacgtattacctccctcacgtgaagaactatcaaaaaatacagtttcattaacatgcctaataaaagacttcttcccaccagacatagacgtagaatggcaatcaaacggacaacaagaaccagaatcaaaatatagaacaacaccaccacaattagatgaagacggttcatactttctatattcaaaactatcagtagacaaaagtagatggcaaagaggagatacttttatatgtgcagtaatgcatgaagcattacataaccattatactcaaaaatctctatcccatagcccaggaaaa

SEQ ID NO: 45963 - RNA, 657 nt, synthetic construct
  misc_feature 1..657: note = derived and/or modified sequence opt6 from Blontuvetmab_LightChain
  source 1..657: mol_type = other RNA
gacgtagtcatgtcacaatcaccatcatcactagccgtttcagtaggagaaaaagtaacaatgtcatgcaaatcatcacaatcactactatactcaggaaaccaaaaaaactatctagcatggtaccaacaaaaacccggacaatcaccaagactactaatatactgggcatcaacaagagaatcaggagtcccagacagattcacaggctcaggatccggaacagacttcacactaacaatatcatctgtaaaagcagaagacctagcagtattctactgtcaacaatactacaactacccattaacattcggaggaggaacacacctaaccgtactaggccaacccaaagcatcaccatccgtaacattatttccaccctcatccgaagaactaggagcaaacaaagccaccctagtatgtctaatctccgacttttatccatcaggagtaaccgtagcatggaaagccgacggatcaccaataacccaaggagtagaaacaacaaaaccatcaaaacaatcaaacaacaaatacgcagcatcatcatacctatcactaacaccagacaaatggaaatcacactcctcattctcctgcttagtaacacacgaaggctcaaccgtagaaaaaaaagtagcacccgcagaatgctca

SEQ ID NO: 45964 - RNA, 1332 nt, synthetic construct
  misc_feature 1..1332: note = derived and/or modified sequence opt6 from Blosozumab_HeavyChain1
  source 1..1332: mol_type = other RNA
caagtacagctagtacaatctggagcagaagttaaaaaaccaggagcctcagttaaagtatcttgcaaagtatcaggattcccaataaaagatacctttcaacactgggtccgacaagcaccaggaaaaggactagaatggatgggatggtcagatccagaaataggagatacagaatacgcatcaaaatttcaaggaagagtaacaatgaccgaagacacgtcaaccgatacagcatacatggaattatcttccctacgctcagaggataccgcagtctactattgcgcaacaggagacacaacatacaaattcgacttctggggacaaggcacaacagtaaccgtttcatcagcatcaacaaaaggtccatccgtatttccattagcaccatgctctcgatccacatccgaaagcacagcagcattaggatgtctagtaaaagattacttcccagaacctgttacagtatcatggaactccggagcattaacatcaggagttcacacatttccagcagtcctacaatcatctggcttatactctctatcatcagtagtaacagtcccatcctcaagtctaggaacaaaaacatacacatgcaacgtagaccataaaccatcaaacactaaagtagacaaaagagtagaatcaaaatacggtccaccttgtcccccatgcccagctccagaatttctcggaggaccatcagtattcttattcccaccaaaacctaaagataccctaatgatctcaagaacacccgaagtaacatgtgtagtagtagacgtatctcaagaagacccagaagtacaatttaattggtatgtagacggagttgaagtacacaacgccaaaacaaaaccaagggaagaacaatttaactcaacctatagagtcgtatcagtcttaactgtattacatcaagactggctaaacggtaaagaatacaaatgtaaagtatcaaataaaggcttaccatcctcaatcgaaaaaacaatatccaaagcaaaaggacaaccaagagaaccacaagtatatacattaccaccatcacaagaagaaatgaccaaaaatcaagtttcactaacatgcttagtcaaaggattctacccatccgatatagcagtagaatgggaatcaaatggacaacctgaaaacaactataagacaaccccaccagttttagattcagacggaagcttcttcctatattcaagactaacagtagacaaatcccgatggcaagaaggaaatgtattttcctgcagtgtaatgcatgaagcactacataaccactacacacaaaaatcactatctttatcattagga

SEQ ID NO: 45965 - RNA, 642 nt, synthetic construct
  misc_feature 1..642: note = derived and/or modified sequence opt6 from Blosozumab_LightChain1
  source 1..642: mol_type = other RNA
gacatacaaatgacacaatcaccatcaagcttaagcgcaagtgtaggagaccgagtaacaataacatgtaaagcatcacaagacgtacacacagcagtagcatggtaccaacaaaaaccaggaaaagcaccaaaactactaatatattgggcaagtacaagatggacaggagtaccaagcagattctcaggatcaggatcaggcacagactttacattaaccataagctcactacaaccagaagactttgcaacatactattgccaacaatattcagattacccatggacattcggaggaggaaccaaagtagaaataaaaagaacagtagcagcaccatcagtattcatattcccaccatcagacgaacaactaaaatcaggaacagcatctgtagtatgcctactaaataacttttacccaagagaagcaaaagtacaatggaaagtagataacgcactacaaagtggaaactcacaagaatcagtaaccgaacaagacagcaaagactcaacatacagcttatcatcaacattaacattaagcaaagccgattacgaaaaacataaagtatacgcatgtgaagtaacacatcaaggattaagctcaccagtaacaaaaagctttaacagaggagaatgc

SEQ ID NO: 45966 - RNA, 1332 nt, synthetic construct
  misc_feature 1..1332: note = derived and/or modified sequence opt6 from Bococizumab_HeavyChain1
  source 1..1332: mol_type = other RNA
caagtacaactcgtacagtctggcgcagaagtcaaaaaaccaggagcatccgtaaaagtttcctgcaaagcctcaggatacacctttacatcatattatatgcattgggtcagacaagccccaggacaaggactcgaatggatgggagaaatatcaccttttggaggcagaactaattacaatgaaaaattcaaatcaagagtaacaatgactcgtgacacatcaacctcaacagtatacatggaactatcaagtttaagatcagaagatacagcagtatactactgtgcaagagaaagaccactatacgcctcagacttatggggacaaggaacaaccgtcacagtatcttccgctagcacaaaaggaccctcagtatttccattagctccatgctcaagatcaacatccgaatccacagcagcactaggatgtttagtcaaagattacttccccgaaccagtaacagtatcatggaactcaggagcattaacatccggagtacacacattcccagcagtcctacaatcctcaggcttatattcactaagcagtgtagtaacagtaccttcctcaaacttcggaacacaaacatacacatgtaacgtagaccataaaccatcaaacaccaaagtagacaaaacagtagaaagaaaatgttgcgttgaatgtccaccatgcccagctccaccagtagcaggtccctcagtctttctttttccaccaaaaccaaaagatacactaatgatatcacgtactcctgaagtaacctgtgttgtagtagacgtctcccatgaagatcccgaagtacaattcaattggtacgtagatggagttgaagtacacaacgcaaaaacaaaaccaagagaagaacaattcaactccaccttcagagtagtttcagtactaacagttgtacaccaagactggctaaatggaaaagaatacaaatgcaaagtatccaataaaggactcccatcttcaatagaaaaaacaatctcaaaaactaaaggccaaccaagagaaccccaagtatacacattaccaccatccagagaagaaatgacaaaaaaccaagtatcattaacttgtttagttaaaggattctatccatccgacatagctgtagaatgggaatcaaacggacaaccagaaaataactacaaaactaccccccctatgctcgactcagatggaagttttttcctttacagcaaactaacagtagacaaatcaagatggcaacaaggcaacgtattttcatgttcagtaatgcacgaagcactacataatcactacacacaaaaatctttatcactatcacccggtaaa

SEQ ID NO: 45967 - RNA, 642 nt, synthetic construct
  misc_feature 1..642: note = derived and/or modified sequence opt6 from Bococizumab_LightChain1
  source 1..642: mol_type = other RNA
gacatccaaatgacacaatcaccatcaagcctatcagcatcagtaggagacagagtaacaataacatgcagagcatcacaaggaatatcatccgcactagcatggtaccaacaaaaacccggaaaagcaccaaaactactcatatactcagcatcataccgttatacaggagtaccatcacgattctcaggctcaggatcaggaacagacttcacattcacaatatcatcactacaaccagaagacatagcaacatactactgccaacaaagatactcactatggagaacattcggacaaggaacaaaactcgaaattaaaagaacagtcgcagcaccatccgtattcatattccccccctcagacgaacaattaaaatcaggaacagcatcagtagtatgcttactaaataacttctacccacgagaagcaaaagtacaatggaaagtagacaacgcactacaatccggaaactcacaagaatcagtaacagaacaagactcaaaagactcaacatactcactatcatcaaccctaaccctatcaaaagcagactacgaaaaacataaagtatacgcatgtgaagtaacacaccaaggactatcatctccagtaacaaaatccttcaacagaggagaatgc

SEQ ID NO: 45968 - RNA, 1338 nt, synthetic construct
  misc_feature 1..1338: note = derived and/or modified sequence opt6 from Brentuximab_vedotin_HeavyChain1
  source 1..1338: mol_type = other RNA
caaatacaattacaacaatcaggtccagaagtagtaaaaccaggagcttcagtaaaaatctcatgtaaagcttcaggatacacattcacagactactatataacatgggtaaaacaaaaacctggtcaaggattagaatggatcggatggatatacccaggatccggaaatacaaaatataatgaaaaatttaaaggcaaagcaacactaacagtagacacatcctcatcaactgcatttatgcaactatcttctcttacatctgaagacacagcagtatacttctgcgccaactacggaaattactggttcgcatattggggacaaggtacacaagtaaccgtatcagcagcatcaactaaaggaccctctgtattcccacttgcaccatcatcaaaatctacatcaggcggaactgcagcactaggctgcctagttaaagactattttcccgaaccagtcacagtatcatggaattccggagccctaacatcaggagtacacacctttccagccgtattacaatcttcaggactatactcattatcctcagtagtaaccgtaccatcatccagtttaggaacacaaacatatatatgtaacgttaaccacaaaccatcaaacactaaagttgacaaaaaagtagaacctaaatcatgcgataaaacacatacctgcccaccttgccctgcacctgaattactcggaggaccatccgtatttctatttcctcccaaaccaaaagacactctaatgatatcacgaactcctgaagtaacctgtgtagtagtagatgtctcacacgaagatcctgaagtcaaattcaattggtatgtagacggagtagaagtacacaacgcaaaaacaaaaccacgagaagaacaatacaattcaacatacagagtagtatcagtactcacagtactacaccaagattggctaaacggcaaagaatacaaatgcaaagtctcaaacaaagcactcccagcaccaattgaaaaaacaatctccaaagcaaaaggacaacctagagaaccacaagtttataccctaccaccatcaagagacgaattaacaaaaaatcaagtatcactaacatgcttagttaaaggattctaccccagcgacatagccgtagaatgggaatcaaacggccaaccagaaaacaactacaaaacaacacctccagtacttgactcagatggatcattcttcttatactctaaactaaccgtcgacaaatcacgatggcaacaaggcaacgtattttcttgttccgtaatgcacgaagcattacataaccactacacccaaaaatcactatcattatcaccagga

SEQ ID NO: 45969 - RNA, 654 nt, synthetic construct
  misc_feature 1..654: note = derived and/or modified sequence opt6 from Brentuximab_vedotin_LightChain1
  source 1..654: mol_type = other RNA
gacatagtactaacacaatcaccagcatcactagcagtatcactaggtcaacgagcaacaataagctgcaaagcatcacaaagcgtagacttcgacggagactcatacatgaactggtaccaacaaaaaccaggccaaccaccaaaagtcctaatatacgcagcatcaaacctagaaagtggaataccagcaagattctcaggctcaggatcaggaacagacttcaccctaaatatacacccagtagaagaagaagacgcagcaacatactactgccaacaatcaaacgaagacccatggacattcggaggaggaaccaaactagaaataaaaagaacagtagcagcaccatcagtattcatattcccaccatcagacgaacaactaaaatcaggaacagcatcagtagtatgcctactaaacaacttctacccaagagaagcaaaagtccaatggaaagttgacaacgcactacaatcaggaaactcacaagaaagtgtaaccgaacaagactcaaaagactcaacatacagtctatcatcaacactaacactaagtaaagcagactacgaaaaacacaaagtatacgcatgcgaagtaacacaccaaggattatcatcaccagtaacaaaatcattcaacagaggagaatgc

SEQ ID NO: 45970 - RNA, 1335 nt, synthetic construct
  misc_feature 1..1335: note = derived and/or modified sequence opt6 from Briakinumab_HeavyChain1
  source 1..1335: mol_type = other RNA
caagtacaactagtcgaatcaggaggcggagtagtacaaccaggcagatcattaagattatcatgcgcagcatccggatttacattctcatcctatggcatgcactgggtaagacaagctccaggaaaaggattagaatgggtagccttcataagatacgacggctcaaataaatattatgcagattcagtcaaaggaagatttacaatatcaagagataactccaaaaacacattatacttacaaatgaactccctaagagcagaagatacagccgtttattactgcaaaacacatggttcacacgataattggggacaaggaacaatggtaacagtatcatcagcatcaacaaaaggaccaagcgtatttccactagccccatcatcaaaatcaacttcaggaggaaccgcagccctaggatgcctagtaaaagattattttccagaacctgtaacagtaagctggaactctggagcactaacatccggagtacatacattcccagcagtcctccaatcatcaggattatactccttatcttccgttgtaacagtaccaagctcctccctaggcacccaaacatatatctgcaacgtaaaccataaaccatcaaacactaaagtcgacaaaaaagtagaacccaaatcctgtgacaaaacacatacttgcccaccatgtcctgcaccagaactcttaggaggaccatccgtattcctattcccaccaaaacctaaagacacattaatgatatcaagaacacccgaagtaacttgcgtagttgtcgacgtatctcatgaagatcccgaagtaaaattcaactggtatgtagacggagttgaagttcacaacgccaaaacaaaaccacgagaagaacaatacaactcaacatacagagtagtatcagtactaacagttttacatcaagactggttaaacggcaaagaatataaatgcaaagtctcaaacaaagccctaccagccccaatagaaaaaacaatatctaaagcaaaaggacaaccccgcgaaccacaagtatacacactacccccctctagagaagaaatgaccaaaaaccaagtatccctaacatgcctagtaaaaggattctacccttcagatatagcagtagaatgggaatcaaatggtcaaccagaaaataactacaaaaccacaccacctgtactcgactcagacggatcattctttttatattctaaactaacagtagataaatccagatggcaacaaggaaatgtattctcatgttcagtaatgcatgaagccctacacaaccactatacccaaaaatcattatcattaagtccaggaaaa

SEQ ID NO: 45971 - RNA, 651 nt, synthetic construct
  misc_feature 1..651: note = derived and/or modified sequence opt6 from Briakinumab_LightChain1
  source 1..651: mol_type = other RNA
caatcagtactaacccaaccaccatcagtatcaggagcaccaggacaaagagtaacaatatcctgctccggatcaagatccaacataggatcaaacacagtaaaatggtaccaacaactaccaggaacagcaccaaaactattaatttactacaatgaccaacgaccatcaggagtaccagacagattctcaggatcaaaatccggaacatcagcatctttagcaataacaggactacaagcagaagacgaagcagactactactgccaatcatacgatagatacacacacccagcacttctattcggaacaggaaccaaagtaacagtactcggacaaccaaaagcagcaccatccgtaacactattcccaccatcatcagaagaactacaagcaaacaaagcaacattagtatgcctaatatcagacttctacccaggagcagtaacagtagcatggaaagcagactcatcaccagtcaaagcaggagtagaaacaacaacaccatcaaaacaatcaaacaataaatacgcagcatcatcatacttatcattaaccccagaacaatggaaatcacacagatcttactcatgccaagtaacacacgaaggatcaacagtagaaaaaacagtagcacccacagaatgctca

SEQ ID NO: 45972 - RNA, 1326 nt, synthetic construct
  misc_feature 1..1326: note = derived and/or modified sequence opt6 from Brodalumab_HeavyChain1
  source 1..1326: mol_type = other RNA
caagttcaactagtacaatccggagcagaagttaaaaaaccaggagcctcagtcaaagtctcatgcaaagcatcaggctatacattcacccgatacggaatatcatgggtacgccaagcaccaggacaaggactcgaatggatgggttggatatcaacatactcaggtaacaccaattacgcacaaaaactacaaggtagagtcacaatgacaacagatacctccacatcaacagcatacatggaattaagatcactcagatcagatgatacagcagtatactactgcgcacgcagacaattatatttcgattattggggtcaaggaacactagtaactgtcagctccgcttctacaaaaggaccatcagtattcccactcgcaccatgctcacgctcaacctcagaatcaactgcagcactaggatgcttagtaaaagattatttcccagaaccagtaaccgtatcctggaactcaggcgcattaacatccggagtacacacattccccgcagtcttacaatcatcaggtttatattctctaagttcagtagtaaccgtaccatcatcaaactttgggacacaaacatacacatgcaacgtagatcacaaaccatccaatactaaagtagacaaaacggttgaaagaaaatgctgcgtagaatgtcctccatgccccgcacctccagtagcaggaccaagtgtcttcctattcccaccaaaaccaaaagatacactcatgatatcaagaacaccagaagtcacatgtgtagtagttgacgtatcacacgaagacccagaagttcaattcaattggtacgttgacggagtagaagtacacaacgcaaaaaccaaaccaagagaagaacaatttaacagcaccttcagagtagtatcagtactaacagtagtacaccaagactggcttaatggcaaagaatataaatgcaaagtatctaacaaaggattaccagcacccatagaaaaaaccataagtaagacaaaaggtcaaccacgagaaccacaagtctacacattacctccatctcgagaagaaatgacaaaaaaccaagtatcattaacatgtttagtaaaaggcttttacccatcagatatagcagtcgaatgggaaagcaatggacaaccagaaaacaattacaaaaccacaccaccaatgctagacagtgatggatcattctttctatactcaaaactaacagtagataaatccagatggcaacaaggaaacgtattctcatgctctgtaatgcacgaagcactacacaaccactatactcaaaaatcactatcactatcaccaggaaaa

SEQ ID NO: 45973 - RNA, 642 nt, synthetic construct
  misc_feature 1..642: note = derived and/or modified sequence opt6 from Brodalumab_LightChain1
  source 1..642: mol_type = other RNA
gaaatagtaatgacacaatcaccagcaacattatcagtaagcccaggagaaagagcaacactaagctgcagagcatcacaatcagtatcatcaaacttagcatggttccaacaaaaaccaggacaagcaccaagaccattaatatatgacgcatcaacacgagcaacaggagtaccagctcgattctcaggatcaggatcaggaacagattttacattaacaatatcctctttacaatcagaagacttcgccgtatactactgccaacaatacgacaactggccactaacattcggaggcggaacaaaagtagaaataaaaagaacagtagcagctcctagcgtattcatattcccaccatcagacgaacaattaaaatcaggaacagcatcagtagtatgcttactaaataatttctacccacgagaagcaaaagtacaatggaaagtagacaacgcactacaatcaggaaactcacaagaatcagtaacagaacaagactccaaagactcaacatattcattatcatcaacactaaccctatcaaaagccgactacgaaaaacacaaagtatacgcatgcgaagtaacacaccaaggattaagttcaccagtaacaaaatcatttaacagaggagaatgt

SEQ ID NO: 45974 - RNA, 756 nt, synthetic construct
  misc_feature 1..756: note = derived and/or modified sequence opt6 from Brolucizumab_HeavyChain1
  source 1..756: mol_type = other RNA
atggaaatagtaatgacacaaagtccatcaacattaagcgcaagtgtaggagatagagtaataataacatgccaagcaagtgaaataatacactcatggttggcatggtatcaacaaaaaccaggaaaagcgccaaaattattaatatatttagcaagtacactagcaagtggagttcctagtagatttagtggatcaggatcaggagcagaatttacattaacaataagtagtttacaaccagatgattttgctacatattattgtcaaaatgtatatctagcaagtacaaatggagcaaattttggtcaaggaacaaaattaacagtactaggaggaggaggaggaagtggaggaggaggaagtggaggaggaggaagtggaggaggaggaagtgaagtacaattagttgaaagtggaggaggattagtacaaccaggaggaagtttaagattaagttgtacagcaagtggatttagtctaacggattattattatatgacatgggtaagacaagcaccaggtaaaggattagaatgggtaggatttatagatccggatgatgacccatattacgcaacatgggcaaaaggacgatttacaataagcagagataatagcaaaaatacactatatttacaaatgaatagtttaagagcagaagacaccgcagtatattattgtgcaggaggagatcataatagtggatggggattagatatatggggtcaaggaacattagtaacagtaagtagt

SEQ ID NO: 45975 - RNA, 756 nt, synthetic construct
  misc_feature 1..756: note = derived and/or modified sequence opt6 from Brolucizumab_scFv_fragment
  source 1..756: mol_type = other RNA
atggaaatagtaatgacacaaagtccatcaactctaagtgcaagcgtaggagatagagtaataataacatgtcaagcaagcgaaataatacattcttggttagcatggtatcaacaaaaaccaggaaaagcaccaaaattattaatatatttagcaagtacattagcgagtggagtaccaagtagatttagtggtagtggaagtggagcggaatttacactaacaataagcagtttacaaccagatgattttgcaacatattattgtcaaaatgtatatctagcaagtacgaatggagcaaattttggacaaggaacaaaattaactgtattaggaggaggaggaggaagcggaggaggaggatcaggaggaggaggaagtggaggagggggatcagaagtacaattagttgaatcaggaggaggattagtacaaccgggaggaagtttaagattaagttgtactgcaagtggattttcattaacggattattattatatgacatgggtaagacaggcaccaggaaaaggattagaatgggtaggatttatagatccagatgatgatccatattatgcaacatgggcaaaaggaagatttacaataagtagagataatagtaaaaatacattatatctacaaatgaatagcctaagagcagaagatacagcagtatattattgtgcaggaggagatcataatagcggatggggattagatatatggggacaaggaacactagtaacagtaagtagt

SEQ ID NO: 45976 - RNA, 1341 nt, synthetic construct
  misc_feature 1..1341: note = derived and/or modified sequence opt6 from Brontictuzumab_HeavyChain1
  source 1..1341: mol_type = other RNA
caagtccaattagtacaaagtggagccgaagttaaaaaaccaggtgcgtcagttaaaataagttgcaaagtatcaggctacacactaagaggatactggatagaatgggtccgccaagcaccaggaaaaggactagaatggataggacaaatcctaccaggaactggaagaacaaactacaacgaaaaatttaaaggacgcgttacaatgacagcagatacatcaacagacacagcctatatggaactttcatcactaagaagcgaagacactgcagtatattactgcgctagattcgacggaaattacggatattatgcaatggactattggggccaaggaacaactgtaactgtatcaagcgcctccacaaaaggaccatcagtttttccattagcaccatgcagcagatcaacctccgaatcaacagcagcacttggttgcttagtaaaagattattttccagaaccagtaacagtatcctggaattcaggcgccttaacatcaggagtacatacatttcccgcagtactccaatcatcaggtctatattcactaagttcagttgtgacagtaccatccagtaacttcggaacacaaacatatacctgtaatgtggaccacaaaccaagcaataccaaagtagataaaacagtagaaagaaaatgttgtgtagaatgtccaccatgtccagcaccacccgtagcaggcccaagcgtattcttattcccacccaaacccaaagacacactaatgatctcaagaacaccagaagttacatgcgtagtagtagatgtaagtcatgaagatccagaagtacaatttaattggtatgtagatggtgtagaagtacacaacgcaaaaacaaaaccaagagaagaacaatttaactcaacatttcgtgtagtctcagtacttacagtagtacatcaagattggttaaacggaaaagaatacaaatgcaaggtaagtaacaaaggactaccagcaccaatagaaaaaacaatatcaaaaacaaaaggtcaaccaagagaaccacaagtttatacactaccaccatcaagagaagaaatgaccaaaaatcaagtatcacttacatgtctagtaaaaggattttaccctagcgatatcgccgtagaatgggaatcaaatggacaaccagaaaataattacaaaacaacaccaccaatgctagactcagacggaagttttttcttatactcaaaactaacagttgacaaatccagatggcaacaaggaaacgtattctcatgtagtgtaatgcacgaagccttacacaatcactacacacaaaaatcattatcactaagtccaggaaaa

SEQ ID NO: 45977 - RNA, 645 nt, synthetic construct
  misc_feature 1..645: note = derived and/or modified sequence opt6 from Brontictuzumab_LightChain1
  source 1..645: mol_type = other RNA
caagcagtagtaacacaagaaccatcactaacagtatcaccaggaggaaccgtaacactaacctgtagatcatcaacaggagcagtaacaacatcaaactacgcaaattggttccaacaaaaaccaggacaagcaccaagaacactaataggaggaacaaataacagagcaccaggagtaccagcaagattttcaggatcattactaggaggaaaagcagcattaacactatcaggagcacaaccagaagacgaagcagaatattactgcgcactatggtacagcaaccactgggtattcggaggaggaacaaaactaacagtactaggacaaccaaaagcagcaccaagcgtaacattattcccaccatcatcagaagaattacaagcaaacaaagcaacattagtatgcctcgtatcagacttctacccaggtgcagtaacagtcgcatggaaagcagacggctcaccagtaaaagtaggagtagaaacaacaaaaccatcaaaacaaagcaataacaaatacgcagcaagctcatacctatcactaacaccagaacaatggaaatcacacagatcatactcatgcagagtaacacacgaaggatcaacagtagaaaaaacagtagcacccgcagaatgcagt

SEQ ID NO: 45978 - RNA, 1332 nt, synthetic construct
  misc_feature 1..1332: note = derived and/or modified sequence opt6 from BTT-1023_HeavyChain1
  source 1..1332: mol_type = other RNA
caagtccaattagtagaatctggaggaggtgtagtacaaccaggacgttcactaagattatcatgtgcggcatccggattcacctttttttcatacgcaatgcattgggtacgacaaaccccgggtaaaggattagaatgggtagcagttatatggttcgatggcagtaacgaaaactatgtagatagcgtaaaaggccgattcacaatttcaagagataattcaaaaaatacactgtatttacaaatgaatacactaagagctgaagacacagcagtatactattgcgcaagagatgcatggtcatactttgattattggggacaaggaaccttagtaactgtatcttccgcatcgacaaaaggaccatcagtatttccactagcaccatgctcaagatcaacatcagaatcaacagctgctttaggatgtctcgtaaaagactactttccagaaccagtaacagtatcatggaactcaggagctctaacatccggagtacatacattcccagcagtacttcaatcatctggactatattcactatcatcagtagtaacagtaccatcttcctctttaggaacaaaaacatatacatgcaatgtagaccataaaccttctaatacaaaagtagataaaagagtagaatcaaaatacggtcctccttgcccaccctgcccagctcctgaattcgctggaggtccatcagtatttctattccccccaaaacccaaagacacactcatgatatcaagaacaccagaagtaacatgcgtagttgtcgacgtctcacaagaagacccagaagtacaattcaactggtacgtagacggtgtagaagtacataacgcaaaaacaaaaccacgagaagagcaatttaattctacttacagagtagtcagtgttctaacagtactacaccaagattggttaaacggaaaagaatataaatgtaaagtctcaaacaaaggtttaccatcatcaattgaaaaaacaatatcaaaagcaaaaggacaacctagggaaccacaagtatatacacttccaccatcacaagaagaaatgacaaaaaaccaagtatccctaacatgtctagttaaaggattttatccatcagacatcgctgtagaatgggaatcaaatggacaaccagaaaataactataaaaccacacctccagtattagattcagatggatccttcttcttgtattcacgactaacagttgacaaatctagatggcaagaaggaaatgtattttcatgttcggttatgcatgaagctttacataaccattatacacaaaaatcactatcactatccctaggaaaa

SEQ ID NO: 45979 - RNA, 642 nt, synthetic construct
  misc_feature 1..642: note = derived and/or modified sequence opt6 from BTT-1023_LightChain1
  source 1..642: mol_type = other RNA
gtaatacaactaacacaatcaccatcatcactatccgcatcagtaggagaccgtgtaacaatcacatgcagagcctcccaaggaatatcaagagcattagcatggtaccaacaaaaaccaggaaaaggaccaaaattactaatatacgacgcatcatcactagaatcaggagtaccatcaagattctcaggatcaggatcaggaacagactttacactaacaatatcatctctccaacccgaagacttcgcaacatactactgtcaacaattcaactcatacccactaacattcggaggaggaacaaaagtagaaataaaaagaacagtagcagcaccatcagtattcatattcccaccctcagacgaacaactaaaatcaggaaccgcatcagtcgtatgtctactaaacaacttttacccaagagaagcaaaagtacaatggaaagtagacaacgcactacaatctggaaattctcaagaatcagtaacagaacaagactcaaaagactcaacatactcactatcatcaacattaacactatcaaaagcagactacgaaaaacacaaagtatacgcatgcgaagtaacacaccaaggactatcctcaccagtaacaaaatcattcaacagaggagaatgc

SEQ ID NO: 45980 - RNA, 1341 nt, synthetic construct
  misc_feature 1..1341: note = derived and/or modified sequence opt6 from Burosumab_HeavyChain1
  source 1..1341: mol_type = other RNA
caagtgcaactcgtacaaagtggagcagaagtaaaaaaaccaggagcatcagtaaaagtctcatgcaaagcttctggatacacattcaccaatcactacatgcactgggtaagacaagcaccaggacaaggacttgaatggatggggatcatcaacccaataagtggatccacctctaatgcacaaaaattccaaggaagggtaacaatgactagagacacctccacctcaacagtatacatggaactatcatcactaagatcagaagatactgcagtatattactgcgcaagagacatagtagacgcattcgacttctggggccaaggaacaatggtaacagtttctagtgcaagcacaaaaggaccttctgttttcccacttgccccatccagcaaaagtacttcaggaggaactgcagcattaggatgtttagtcaaagactactttcctgaaccagtaacagtatcctggaactcaggagccctaacatccggagtacacactttccccgcagtactacaaagctccggtttatactccctctcctccgtagttacagttccatcttcatcattaggaacccaaacatatatatgtaacgtaaaccataaaccatctaacacaaaagtagataagaaagttgaaccaaaatcctgcgataaaactcacacatgccccccgtgccccgcaccagaattactaggcggaccatcagtatttttatttccaccaaaaccaaaagatacattaatgatatcaagaacaccagaagtaacctgtgtagtagtagatgtatcgcacgaagaccctgaagtaaaattcaactggtacgtcgacggagtagaagtacacaatgccaaaacaaaacccagagaagaacaatacaactcaacatacagagtagtcagcgtacttactgtacttcaccaagactggttaaatggtaaagaatataaatgtaaagtctcaaataaagcccttcctgcaccaatagaaaaaactatatctaaagcaaaaggacaaccaagagaaccacaagtatacaccctaccaccatcacgagatgaactaaccaaaaaccaagtatcattaacatgcttagtaaaaggattctacccctccgatatagcagttgaatgggaatctaacggacaacccgaaaacaactacaaaacaacaccaccagtactagactcagacggatcattcttcttatactccaaactaacagtagataaaagcagatggcaacaaggcaacgtatttagttgctcagtaatgcatgaagcactacataatcattacacacaaaaaagcttatccttatctccaggaaaa

SEQ ID NO: 45981 - RNA, 639 nt, synthetic construct
  misc_feature 1..639: note = derived and/or modified sequence opt6 from Burosumab_LightChain1
  source 1..639: mol_type = other RNA
gcaatacaactaacacaatctccctcatcactatcagcatcagtaggagacagagtaaccataacatgcagagcctcacaaggcatatcatcagcactagtatggtaccaacaaaaaccaggcaaagcacccaaactactaatatacgacgcatcatcactagaatcaggagttccatcaagattttcaggatccggatcaggaacagacttcacactaacaatctcatcattacaaccagaagactttgcaacatactactgccaacaattcaacgactacttcacattcggcccaggcacaaaagtagacataaaacgaacagtcgcagcaccatcagtattcatattcccaccatcagatgaacaactaaaatccggaacagcatccgtagtatgcctactaaacaacttctacccaagagaagcaaaagtacaatggaaagtagacaatgcactacaatcaggaaattcacaagaatcagttacagaacaagactcaaaagactcaacctattcattatcatccacactaacattatccaaagccgactacgaaaaacacaaagtatacgcctgcgaagtaacacaccaaggactatcctcaccagtaacaaaatcattcaaccgaggagaatgc

SEQ ID NO: 45982 - RNA, 1344 nt, synthetic construct
  misc_feature 1..1344: note = derived and/or modified sequence opt6 from Canakinumab_HeavyChain1
  source 1..1344: mol_type = other RNA
caagtacaattagtagaatccggaggaggcgtagtacaaccaggaagaagcttacgattatcatgtgcagcttcaggattcacattctccgtatacggaatgaactgggtaagacaagcaccaggtaaaggactcgaatgggtcgccataatatggtatgatggagataatcaatactatgccgattcagtaaaaggtagatttaccataagcagagacaacagcaaaaatacactatacctacaaatgaatggattacgagcagaagacacagcagtctattactgcgcaagagatctaagaacaggaccattcgactattggggacaaggaactttagttacagtaagctcagcatccacaaaaggtccctcagtcttcccactagcaccatcatccaaatctacaagcggaggcactgcagcactcggctgtctagtaaaagactattttcccgaaccagtaacagtatcatggaacagcggcgctttaacatcaggagtacacacattccctgccgtactacaatcctcaggactatattccttatcatcagtagttacagtaccaagctcatcactaggtacacaaacatacatatgcaacgtaaatcacaaaccatcaaacacaaaagttgataaacgcgtagaaccaaaatcatgtgacaaaacccacacatgcccaccatgcccagcaccagaattactaggcggtccctcagttttcttatttccaccaaaacccaaagacacattaatgatatcaagaacaccagaagtaacatgcgtcgttgtagatgtatcacacgaagaccccgaagtcaaattcaattggtacgttgatggagtagaagttcataacgcaaaaacaaaacctagagaagaacaatacaattcaacatatagagtagtaagcgtcctaacagtactacaccaagactggctaaacggcaaagaatacaaatgcaaagtaagtaataaagctttacctgcacccatagaaaaaacaatatcaaaagcaaaaggacaaccaagagaaccacaagtctataccctaccaccatcacgagaagaaatgactaaaaatcaagttagcttaacatgcttagtaaaaggattctatccatcagacatagccgtagaatgggaatcaaatggccaaccagaaaataactataaaacaactccaccagtattagacagcgacggatctttctttctatattcaaaattaacagtcgataaatcaagatggcaacaaggtaacgtattttcctgttcagtaatgcacgaagcactacacaaccattacacgcaaaaaagcctatcactttcaccaggcaaa

SEQ ID NO: 45983 - RNA, 1344 nt, synthetic construct
  misc_feature 1..1344: note = derived and/or modified sequence opt6 from Canakinumab_HeavyChain
  source 1..1344: mol_type = other RNA
caagtacaactagtagaatcaggaggaggagtcgttcaaccaggaagatcattacgtttatcctgtgcagcatctggatttacattctcagtatatggaatgaattgggtaagacaagcaccaggcaaaggattagaatgggtcgcaataatatggtatgatggtgataatcaatactatgcagactcagtaaaaggacgattcaccatctcaagagataacagcaaaaacacactctatttacaaatgaatggactaagagcagaagacacagcagtatactactgcgcacgagatctaagaacaggtccatttgactactggggccaaggaaccttagtaaccgtctcatccgcatcaactaaaggaccctcagtatttccattagcaccatcatctaaaagtacatcaggtggaacagcagcattaggatgcttagtcaaagactacttcccagaaccagtaactgtatcatggaattcaggagcccttacctcaggagtacatacattcccagcagtactccaatcatcaggattatactcactttctagtgtagtcacagtaccatcatcatcactaggaacacaaacttacatatgcaacgtaaaccacaaaccctctaacactaaagtagataaaagagtagaacctaaatcatgcgataaaacacacacttgtccaccctgcccagcaccagaactactcggaggtccatccgtatttttatttcctccaaaacctaaagacacacttatgatatctcgaacaccagaagttacttgcgtagtcgtagatgtaagtcatgaagacccagaagtaaaattcaactggtacgtagatggagtagaagtacacaacgcaaaaacaaaacctcgagaagaacaatacaactcaacatacagagtagtaagcgtactaacagtactccatcaagactggttgaatggaaaagaatacaaatgcaaagtaagtaataaagcactaccagcaccaatagaaaaaacaatatcaaaagcaaaaggacaaccaagagaaccacaagtatatacattaccaccttcaagagaagaaatgacaaaaaaccaagtaagtttaacatgtttagtaaaaggtttttatccatctgatatagcagtagaatgggaatcaaatggacaacccgaaaacaattacaaaacaacaccaccagtactagattcagacggatcattcttcttatactcaaaacttaccgttgacaaaagcagatggcaacaaggaaacgtattcagttgctcagtaatgcacgaagcactacataatcattacacacaaaaaagtctaagtctatcaccaggaaaa

SEQ ID NO: 45984 - RNA, 642 nt, synthetic construct
  misc_feature 1..642: note = derived and/or modified sequence opt6 from Canakinumab_LightChain1
  source 1..642: mol_type = other RNA
gaaatagtactaacacaatctccagacttccaatcagtaacaccaaaagaaaaagtaacaataacatgcagagcctcacaatccataggatcatcactacactggtaccaacaaaaacccgaccaatcaccaaaattactaataaaatacgcctctcaatcattctcaggagtaccatcaagattctcaggatcaggatcaggaacagattttaccctaacaataaactcactagaagcagaagacgcagcagcatactattgtcaccaatcatcatcactaccattcacattcggaccaggaaccaaagtagacataaaacgaacagtagcagcaccatccgtattcatattcccaccatcagacgaacaattaaaatcaggaacagcctcagtagtatgcctactaaacaacttctatccacgcgaagccaaagtacaatggaaagtcgacaacgcactacaatcaggaaattcacaagaatcagtaaccgaacaagactcaaaagactcaacatactcattatcatcaaccctaacactatcaaaagcagactacgaaaaacacaaagtatacgcatgcgaagtaacacaccaaggactatcatcaccagtaaccaaatcattcaacagaggcgaatgc

SEQ ID NO: 45985 - RNA, 642 nt, synthetic construct
  misc_feature 1..642: note = derived and/or modified sequence opt6 from Canakinumab_LightChain
  source 1..642: mol_type = other RNA
gaaatagtactaacccaatcaccagacttccaatcagtaaccccaaaagaaaaagtaacaataacatgcagagcatcacaatcaataggctcctccctacactggtaccaacaaaaaccagaccaatcacccaaactactaatcaaatacgcatctcaatcattctcaggagtaccatccagattctcaggatcaggatctggaacagacttcacactaacaataaattcactagaagcagaagacgcagcagcctactactgccaccaatcatcctcactaccattcacattcggaccaggaacaaaagtagacatcaaaagaacagtagcagcaccatcagtattcatattcccaccatccgacgaacaactaaaatcaggaacagcatcagtagtatgcttactaaacaacttctacccaagagaagcaaaagtacaatggaaagtagataacgcactacaatcaggaaactcacaagaaagcgtaacagaacaagactcaaaagactcaacctattcactaagctcaacactaaccctatcaaaagcagattacgaaaaacataaagtatacgcatgcgaagtaacacaccaaggactatcatcaccagtaacaaaatccttcaacagaggcgaatgc

SEQ ID NO: 45986 - RNA, 1182 nt, synthetic construct
  misc_feature 1..1182: note = derived and/or modified sequence opt6 from Canakinumab_LightChain_variant_8836_L
  source 1..1182: mol_type = other RNA
caagtacagttagtcgaatcaggcggcggagtagtacaaccaggtagaagtttacgactctcatgcgcagcatcaggcttcactttcagtgtatacggtatgaattgggtaagacaagcaccaggcaaaggattagaatgggttgctataatatggtatgacggcgacaatcaatattacgcagactcagtaaaaggaagattcacaatttctagagataattcaaaaaacaccctatacctacaaatgaacggattaagagcagaagatacagccgtatattattgcgcaagagatctcagaaccggaccatttgactattggggacaaggaacactagtcacagtatcatcagcaagcacaaaaggaccatcagtatttccactagcaccaagttcaaaatcaacatcaggaggaacagccgctttaggatgcctagtaaaagattactttccagaaccagtaaccgtttcatggaactctggagcacttacatcaggagttcatacatttcctgctgtattacaatcaagtggattagaaatcgttctaacacaatcaccagacttccaaagcgtaacaccaaaagaaaaagtaacaattacttgtagagcaagtcaaagcataggatcatccttacactggtatcaacaaaaaccagatcaatcacctaaattattaataaaatatgcaagtcaatcatttagcggagtcccaagcagattttccggatccggaagcggcacagactttacattaacaataaattcccttgaagcagaagatgcagcagcatactattgtcatcaatcaagctcattaccattcactttcggaccaggaacaaaagtcgatataaaaagaacagtagcagccccaagcgtatttatattcccaccatcagacgaacaactaaaatctggaacagcatcagtagtatgccttctaaataacttctacccacgagaagccaaagtacaatggaaagtagacaacgccctccaatcaggaaactcacaagaatcagtaacagaacaagatagcaaagactcaacatattcactatcatcaacattaacactaagcaaagcagattacgaaaaacataaagtatatgcatgcgaagtaacacatcaaggcctatcatcaccagtaacaaaatcatttaacagaggagaatgc

SEQ ID NO: 45987 - RNA, 1197 nt, synthetic construct
  misc_feature 1..1197: note = derived and/or modified sequence opt6 from Cantuzumab_HeavyChain1
  source 1..1197: mol_type = other RNA
atagatacaacaacaggagaaccaacttacgctcaaaaattccaaggaagaatcgcattctcactagaaacatcagcttcaacagcctacctacaaattaaatctttaaaatcagaagacacagcaacatacttctgcgcaagaagaggaccatacaactggtacttcgatgtatggggacaaggaacaactgtaacagtatcctcagcttcaaccaaaggaccatcagtattcccactagcaccatcatcaaaatcaacctcaggaggaacagcagcattaggatgtttagtcaaagactacttcccggaaccagtaaccgtatcatggaattcaggagcattaacatcaggagtccacacatttccagcagtacttcaatcatcaggactatactcactttcatcagtagtaacagtaccatcatcatcactaggcacccaaacatacatatgcaacgttaaccacaaaccatctaacactaaagtagacaaaaaagtagaacctaaatcatgcgacaaaacacatacctgccctccatgcccagcacccgaattactaggtggacccagtgtatttctattcccacctaaaccaaaagacacattaatgatatcaagaactccagaagtcacctgcgtagtagtcgatgtatcacacgaagaccctgaagtaaaattcaactggtatgtcgacggcgttgaagtacataatgcaaaaacaaaacctcgagaagaacaatacaacagcacatatcgagtagtatcagtcctaaccgtattacaccaagattggctaaacggcaaagaatacaaatgcaaagtatcaaacaaagcactaccagcaccaatcgaaaaaaccatatcaaaagcaaaaggacaaccaagagaaccacaagtatacactctaccaccatctagagatgaattaacaaaaaaccaagtatccctaacatgcttagtcaaaggattctacccatcagacatagcagtagaatgggaatcaaacggacaaccagaaaataactacaaaacaacaccaccagtattagattcagacggatcattcttcctatactccaaactaacagttgataaatcacgttggcaacaaggtaacgttttctcatgctcagtaatgcacgaagcattacataaccactacacacaaaaatccctatcactctcaccaggaaaa

SEQ ID NO: 45988 - RNA, 1347 nt, synthetic construct
  misc_feature 1..1347: note = derived and/or modified sequence opt6 from Cantuzumab_HeavyChain
  source 1..1347: mol_type = other RNA
caagttcaattagtacaatccggtgcagaagttaaaaaacctggagaaacagtaaaaatatcctgcaaagcatcagactacacattcacatactacggaatgaactgggtaaaacaagcacctggccaaggacttaaatggatgggttggatagacacaacaaccggtgaaccaacatatgcacaaaaattccaaggtagaatagcattctctttagaaacatcagcatcaaccgcatatctacaaataaaatcattaaaatcagaagacacagcaacatatttctgcgccagacgaggtccatacaactggtactttgacgtatggggacaaggtacaacagtaacagtctcctcagcctcaacaaaaggaccatctgtattcccattagcaccatcatcaaaatcaacatccggtggcacagcagccttaggctgcctagtcaaagactacttcccagaaccagtaacagtatcatggaattcaggagcactcacatcaggagtacacacattcccagctgtactacaatcatcaggattatactccctctccagtgtagtaacagtaccatcctcatccttaggaacacaaacttacatctgcaacgtaaaccacaaaccaagcaacaccaaagtagacaaaaaagtagaaccaaaatcatgtgacaaaacacatacatgcccaccatgccccgccccagaactactaggaggaccatctgtatttctattcccaccaaaaccaaaagacacattaatgatatctagaacacctgaagtaacctgcgtagtcgtagacgtttcacacgaagatccagaagtaaaattcaattggtacgtagacggagttgaagtccacaacgcaaaaactaaaccaagagaagaacaatacaactcaacatacagagtagtttcagtactaaccgttctacatcaagactggctaaacggaaaagaatataaatgcaaagtttctaataaagcattaccagcaccaattgaaaaaacaataagcaaagcaaaaggacaaccaagagaaccacaagtatacacattacctccatcaagagacgaactaacaaaaaaccaagtctcacttacttgcttggtaaaaggattttatccatcagacatcgccgtcgaatgggaatcgaacggacaacccgaaaacaactataaaaccacaccacccgttctagactccgatggatcatttttcctctattcaaaactaaccgtcgacaaatccagatggcaacaaggtaatgtattttcatgctcagtaatgcacgaagcattacataaccattacactcaaaaatcattatcactctcaccaggaaaa

SEQ ID NO: 45989 - RNA, 657 nt, synthetic construct
  misc_feature 1..657: note = derived and/or modified sequence opt6 from Cantuzumab_LightChain1
  source 1..657: mol_type = other RNA
gacatagtaatgacacaatctccactatcagtcccagtaacaccaggagaaccagtatcaatatcatgtagatcctcaaaatcactactacactcaaacggaaatacctacctatactggtttctacaaagacccggacaatcaccacaactactaatatacagaatgtctaacttagtatcaggagtaccagacagattctcaggatccggatcaggaaccgccttcacattaagaatatcaagagtcgaagcagaagacgtaggcgtatactactgcctacaacatttagaatacccattcacattcggaccaggaacaaaactagaactaaaacgaacagtagcagcaccctccgtattcatatttccaccatcagacgaacaactcaaatcaggcacagcatcagtagtatgcttactaaacaacttctacccaagagaagccaaagtacaatggaaagtagacaacgcattacaatcaggaaactcacaagaatccgtaacagaacaagactcaaaagattcaacatactcactatcctccacactaacattatcaaaagcagactatgaaaaacataaagtatacgcatgcgaagttacacaccaaggactatcatcaccagtaacaaaatcattcaacagaggagaatgc

SEQ ID NO: 45990 - RNA, 1344 nt, synthetic construct
  misc_feature 1..1344: note = derived and/or modified sequence opt6 from Cantuzumab_mertansine_HeavyChain1
  source 1..1344: mol_type = other RNA
gtccaattagtccaatcaggcgctgaagtaaaaaaaccaggtgaaacagtaaaaatatcatgtaaagcatcagattatacctttacatactatggcatgaattgggttaaacaagcacccggacaaggattaaaatggatgggatggatagataccaccacaggagaaccaacatacgcccaaaaattccaaggaagaatagcattctcactagaaacttcagcatctacagcatacttacaaatcaaatctttaaaatctgaagatacagcaacatacttctgcgcaagaagaggaccatacaactggtacttcgacgtctggggacaaggaacaacagtaacagtatcatcagcatccacaaaaggtccttcagttttccctctagcaccatcctcaaaatcaacaagtggaggcacagcagcattaggctgccttgttaaagactattttccagaaccagttaccgtatcatggaattcaggagccctaacatctggtgtacatacatttccagcagtactacaatcatcaggcttatacagcctatcctcagtagtaacagtacccagttcatcattaggtacacaaacatacatatgcaacgtaaaccacaaaccttcaaacacaaaagtcgataaaaaagtcgaacctaaatcatgcgacaaaacacatacatgccctccatgcccagcacctgaactactaggaggcccctcagtattcctatttcccccaaaaccaaaagacacattaatgatatcccgaacccccgaagttacatgcgtcgtagtagacgtatcacatgaagacccagaagtaaaatttaactggtacgtcgatggagttgaagtacataacgctaaaacaaaacccagagaagaacaatacaattcaacttaccgagtagtaagtgtcctaacagtactacaccaagactggttaaacggaaaagaatacaaatgcaaagtatctaacaaagcacttccagcccctatagaaaaaacaatatctaaagccaaaggacaaccacgagaaccacaagtatacaccctacccccttctagagatgaattaacaaaaaaccaagtctctctcacatgtctagtaaaaggattttacccaagtgatatagcagtagaatgggaatctaacggacaaccagaaaacaactataaaacaacaccaccagtactagattctgacggatcctttttcctctattcaaaattaactgtagataaatcaagatggcaacaaggaaacgtattttcttgctcagtaatgcacgaagctttacacaaccactacacacaaaaatcattatccttatcacccggaaaa

SEQ ID NO: 45991 - RNA, 657 nt, synthetic construct
  misc_feature 1..657: note = derived and/or modified sequence opt6 from Cantuzumab_mertansine_LightChain1
  source 1..657: mol_type = other RNA
gacatagtcatgacccaatcacctctatcagtaccagttacaccaggagaaccagtatcaatatcatgcagatcatcaaaatccttattacattcaaacggaaacacatacctatactggttcctacaaagaccaggacaatcaccacaactactaatatacagaatgtcaaacctagtatcaggagtaccagacagattctccggatcaggatcaggaacagcattcactctaagaatatcaagagtagaagcagaagacgtaggcgtatactactgcctacaacacctagaatacccatttacattcggaccaggaacaaaattagaactaaaacgaacagtagcagcaccatccgtattcatattcccaccatcagacgaacaattaaaatcaggaacagcatcagtagtatgcctactaaacaacttctacccaagagaagcaaaagtacaatggaaagtagacaacgcattacaatccggaaactcacaagaatcagtaacagaacaagactcaaaagactccacatactcattatcctcaacattaacactatcaaaagcagactacgaaaaacacaaagtatacgcatgcgaagtaacacaccaaggactatcctcacccgtaacaaaatcattcaacagaggcgaatgc

SEQ ID NO: 45992 - RNA, 1347 nt, synthetic construct
  misc_feature 1..1347: note = derived and/or modified sequence opt6 from Cantuzumab_ravtansine_HeavyChain1
  source 1..1347: mol_type = other RNA
caagtacaattagtccaaagcggagcagaggtaaaaaaaccaggcgaaactgtaaaaatctcatgtaaagcatcggactatacttttacatactatggaatgaactgggtaaaacaagcacctggacaaggattaaaatggatgggatggatcgatactaccacaggagaaccaacctacgcacaaaaatttcaaggaagaatcgcattctcactcgaaacttcagcatcaaccgcatatttacaaataaaatcattaaaatccgaagacacagccacatacttttgcgcacgaagaggaccatacaattggtacttcgacgtatggggacaaggaacaacagtaacagtatcatccgcatccacaaaaggaccctcagtattccctcttgcaccaagctccaaatcaacatcaggtggaacggccgccttaggatgcctagtaaaagattattttcctgaacccgtaacagtcagctggaactcaggagcactaacatcaggagtacacacattcccagcagtccttcaatcatcaggcctatattccctatcatcagtagtcaccgtaccctcatcttcattaggtacccaaacatatatatgtaatgtcaatcacaaaccatcaaacacaaaagtagacaaaaaagtagaaccaaaatcatgcgacaaaacacacacatgcccaccttgcccagcaccagaattattaggaggcccctcagtattcttattccccccaaaaccaaaagatacattaatgatctcaagaacacccgaagtaacatgcgtagtagtagacgtatcacatgaagaccctgaagtaaaattcaactggtacgtcgatggtgtagaagttcacaacgcaaaaacaaaaccaagagaagaacaatacaattcaacataccgagttgtatccgtactcaccgtacttcaccaagattggttaaacggaaaagaatacaaatgcaaagtatcaaacaaagcactaccagcgccaatagaaaaaacaatatcaaaagcaaaaggacaaccaagagaaccacaagtctacacactacccccatcaagagacgaactaacaaaaaatcaagtttcactcacttgcctagtaaaaggattctacccatcagacatcgcagtcgaatgggaatccaacggacagcctgaaaacaactacaaaacaacacccccagttctagacagtgatggatcattctttctatactcaaaactcacagtagataaatcaagatggcaacaaggcaatgtattctcatgctccgtcatgcatgaagccttacataaccactatacacaaaaatcactatcactatcaccaggaaaa

SEQ ID NO: 45993 - RNA, 657 nt, synthetic construct
  misc_feature 1..657: note = derived and/or modified sequence opt6 from Cantuzumab_ravtansine_LightChain1
  source 1..657: mol_type = other RNA
gacatagtaatgacacaatcaccactatcagtaccagtaacaccaggagaacccgtatcaatatcatgtagatcatcaaaatcactactacactcaaacggaaacacttacctctactggttcctacaaagaccaggacaatcaccccaactactaatatacagaatgtcaaacctagtatcaggagtaccagacagattttcaggatcaggatcaggaacagccttcacattaagaatatcacgagtagaagcagaagacgtaggagtatactactgcctacaacacctagaatacccattcacattcggaccaggaacaaaactagaactaaaacgaacagtcgcagcaccatcagtatttatattcccaccatcagacgaacaattaaaatcaggaacagcatccgtagtatgcctactcaacaacttctacccaagagaagcaaaagtacaatggaaagtagacaacgcactccaatcaggaaacagtcaagaatcagtaacagaacaagactcaaaagactcaacatactcactctcatcaacactaacactatcaaaagcagactacgaaaaacacaaagtatatgcatgcgaagtaacacaccaaggactatcatcacccgtaacaaaatcattcaacagaggagaatgc

SEQ ID NO: 45994 - RNA, 777 nt, synthetic construct
  misc_feature 1..777: note = derived and/or modified sequence opt6 from Caplacizumab
  source 1..777: mol_type = other RNA
gaagtgcaattagtagaaagtggaggaggattagtacaaccaggaggaagtctaagattatcatgtgcagcaagtggaagaacatttagttataatccgatgggatggtttagacaagcaccaggtaaagggagagaactggtagcagcaattagcagaacaggaggatcaacatattatccagatagtgtagaaggaagatttacaatatcaagagataatgccaaaagaatggtatatttacaaatgaatagcttaagagcggaagatacagcagtatattattgtgcagcagcaggagtaagagcagaggatggaagagtacgaacattaccgtcagaatatacattttggggtcaaggaacacaagtaacagtaagtagcgcagcagcagaagtgcaattagtagaaagtggcggaggattagtgcaaccaggaggaagcctaaggttaagttgtgcagcaagtggaagaacatttagttataatccaatggggtggtttagacaagcaccaggaaaaggaagagaattagtagcagcaataagtagaacaggagggagtacatactatccagatagtgtagaaggaagatttacaattagtagagataacgcaaaaagaatggtatatttacagatgaatagcctaagagcggaagatacagcagtatattattgtgcagcagcaggagtaagagcagaagatggaagagtaagaacattgccaagtgaatatacattctggggacaaggaacacaagtaacagtgtcaagt

SEQ ID NO: 45995 - RNA, 777 nt, synthetic construct
  misc_feature 1..777: note = derived and/or modified sequence opt6 from Caplacizumab_HeavyChain1
  source 1..777: mol_type = other RNA
gaagtacaattagtagaaagtggaggaggattagtacaaccaggaggaagcttaagattaagttgtgcagcaagtggtagaacatttagctataatccaatgggatggtttagacaagcaccaggaaagggaagagaattagtagcagcgataagtagaacaggagggagtacatattatccagatagcgtagaaggaagatttacaataagtagagataatgcaaaaaggatggtatatctacaaatgaatagtttaagagcagaagatacagcggtatattattgtgcagcagcaggtgtaagagcagaagatggaagagtaagaacattaccatcggaatatacattttggggacaaggaacacaagttacagtaagcagtgcagcagcagaagtacaactagtagaaagtggaggaggattagtacagccaggaggaagtttaagattaagctgtgcagcaagtggaagaacatttagttataatccaatgggatggtttcgacaagcaccaggaaaaggaagagaactagtagcagcaataagtagaacaggaggaagtacatattatcctgacagcgtagaaggaaggtttacaataagtagagataacgcaaaaagaatggtatatttacaaatgaatagcttaagagcagaggatacggcagtatattactgtgcagcagcgggagtgagagcagaagatggaagagtaagaacattacctagtgaatatacattttggggacagggaacacaagtaacagtaagcagt

SEQ ID NO: 45996 - RNA, 777 nt, synthetic construct
  misc_feature 1..777: note = derived and/or modified sequence opt6 from Caplacizumab_HeavyChain1
  source 1..777: mol_type = other RNA
gaagtacaattagtagaatcaggaggaggattagtacaacctggaggaagtctaagactaagttgcgcagcatcaggaagaacatttagttataatccaatgggatggtttagacaagcaccaggaaaagggagagaattagtagcagcaataagcagaactggaggaagtacgtattatccagatagtgtagaaggaaggtttactataagtagagataatgcgaaaagaatggtatatctgcaaatgaatagtttaagagcagaagatacagcagtgtattattgtgcggcagcaggagtaagagcagaagatggtagagtaagaacattaccaagtgaatatacattctggggacaaggaacgcaggtaacagtaagttcagcagctgcagaagtacaactagtagaaagcggaggtggattagtacaaccaggaggaagtttaagattatcatgtgcggcaagtggaaggacatttagttataacccaatgggatggtttagacaagcaccgggaaaaggaagagaactagttgcggcaataagtagaacaggaggaagtacatattatccagatagcgtagaaggaagatttacaataagtagggataatgcaaagagaatggtatatttacaaatgaatagtttaagagcagaagatacagcagtatattattgtgcagcagcaggagtaagagcagaagatggaagagtaagaacgttaccaagtgaatatacattctggggacaaggaacacaagtaacagtaagcagt

SEQ ID NO: 45997 - RNA, 1347 nt, synthetic construct
  misc_feature 1..1347: note = derived and/or modified sequence opt6 from Carlumab_HeavyChain1
  source 1..1347: mol_type = other RNA
caagtacaattagtacaatcaggagccgaagtaaaaaaacctggatcaagcgtaaaagtatcctgtaaagcctcaggaggaactttcagttcatatggaatatcatgggtaagacaagcaccaggtcaaggcctagaatggatgggaggaataataccaattttcggaacagctaactacgcacaaaaattccaaggaagagtaactatcacagcagacgagtcaaccagcacagcatacatggaattaagtagcctccgctccgaagatacagccgtttattactgtgcacgatatgacggcatatacggagaactagatttttggggacaaggaacattagtcactgtctcatcagcatcaactaaaggaccctctgtattcccattagcaccatcatccaaatcaacatcagggggaacagcagccctaggatgtctagtaaaagattacttcccagaaccagtaacagtttcatggaattccggcgcattaacatcaggagtccacacattccctgcagtattacaatcttcaggtttatactcattatcatcagtagtcactgtaccctcatcatcattaggtacccaaacctacatatgcaacgttaatcacaaaccatcaaatacaaaagtagataaaaaagtagaaccaaaatcatgtgacaaaacccacacatgcccaccatgcccagcacccgaactactaggtggaccatcagttttccttttcccacccaaaccaaaagacacattaatgatatccagaacaccagaagtcacctgcgtagtagttgatgtatcacatgaagatccagaagtaaaattcaactggtacgtagacggagtcgaagtccacaacgcaaaaacaaaaccacgcgaagaacaatacaattccacatatcgagtagtatcagtactaaccgtattacaccaagattggttaaatggaaaagaatacaaatgcaaagtatctaacaaagcactaccagcaccaattgaaaaaacaatatccaaagcaaaaggacaaccaagagaaccacaagtctacaccctaccaccttcacgcgatgaactaacaaaaaaccaagtatcactaacttgcttagtaaaaggattctacccatctgacatagcagtcgaatgggaatccaacggtcaacctgaaaacaactacaaaacaacaccacctgtcctagactcagatggctcattctttttatactcaaaactaacagtagataaatcaagatggcaacaaggcaatgtattctcatgctccgtaatgcacgaagctctacacaaccactacacacaaaaatcactatcactatcaccaggaaaa

SEQ ID NO: 45998 - RNA, 648 nt, synthetic construct
  misc_feature 1..648: note = derived and/or modified sequence opt6 from Carlumab_LightChain1
  source 1..648: mol_type = other RNA
gaaatcgttctaacacaatcaccagcaacattaagcctaagcccaggagaacgagcaacattaagctgtagagcatcccaatcagtatcagatgcatatctcgcatggtaccaacaaaaaccaggacaagcaccaagattactaatatacgatgcatcaagcagagccacaggagtaccagcaagatttagcggaagcggatcaggaacagatttcacactaacaatatcaagcttagaaccagaagatttcgcagtatattactgtcaccaatacatacaattacactcattcacattcggacaaggaacaaaagtagaaataaaacgaacagtagcagcacccagcgtattcatattccctccatcagacgaacaattaaaatcaggaacagcatcagtagtatgcttactcaataacttttacccaagagaagcaaaagtacaatggaaagtcgacaacgcattacaaagcggaaactcacaagaatcagttacagaacaagatagcaaagactcaacttatagtctaagctctacattaacactaagcaaagcagattacgaaaaacataaagtatacgcatgcgaagtaacacaccaaggcttatcatcacccgtaacaaaaagctttaatagaggagaatgc

SEQ ID NO: 45999 - RNA, 1353 nt, synthetic construct
  misc_feature 1..1353: note = derived and/or modified sequence opt6 from Cergutuzumab_amunaleukin_HeavyChain1
  source 1..1353: mol_type = other RNA
caagttcaattagtacaatcaggagcagaagtaaaaaaaccaggagcatcagtaaaagtatcatgtaaagcatccggttacacatttacagaattcggtatgaactgggtacgacaagcccccggacaaggattagaatggatgggatggataaatactaaaacaggagaagcaacctatgtagaagaattcaaaggtcgagtaacatttacaacagacacaagcacatcaactgcatatatggaactaagatctttaagatcagacgatacagctgtatattactgtgcccgttgggatttcgcatactatgtagaagcaatggattattggggacaaggtacaacagtaacagtatcatcagcaagtacaaaaggaccttcagtatttccattagcaccatcatctaaatcaacatcaggtggtacagccgcattaggatgtctagtcaaagattatttcccagaacccgttacagtcagctggaactcaggagcactaacctccggcgtacatacattcccagctgtactacaatcatctggactatatagcttatcatctgttgtcacagtcccatcatcttctttaggtacacaaacatacatctgtaacgtaaatcataaaccaagtaatacaaaagtagacaaaaaagtagaaccaaaaagttgtgataaaacacatacctgcccaccatgccctgcacctgaagctgccggtggaccaagcgttttcctattccctccaaaaccaaaagatactctaatgatatcaagaactccagaagtaacatgcgtcgttgtagatgtatcacatgaagatccagaagtcaaatttaattggtatgttgatggagtagaagtacacaatgcaaaaactaaaccaagagaagaacaatataactccacataccgtgtagtctcagtattaacagtattacaccaagattggctaaacggaaaagaatacaaatgcaaagtatccaacaaagcactaggagcacccatagaaaaaactattagtaaagcaaaaggacaacccagagaaccccaagtctgtactctcccaccatcacgagatgaactaaccaaaaaccaagtctctctatcatgcgcagtaaaaggattttacccatccgatatagccgttgaatgggaatcaaatggccaaccagaaaacaattataaaacaactccccccgtattagattctgacggatcattctttttagtatccaaattaactgttgacaaatcaagatggcaacaaggtaatgtattctcttgctcagttatgcatgaagctctacataatcactatacacaaaaatccttatcactatctccaggaaaa

SEQ ID NO: 46000 - RNA, 1794 nt, synthetic construct
  misc_feature 1..1794: note = derived and/or modified sequence opt6 from Cergutuzumab_amunaleukin_HeavyChain2
  source 1..1794: mol_type = other RNA
caagtacaactagtacaatcaggagccgaagtcaaaaaacctggagcatcagtaaaagtctcatgcaaagcaagcggatacacattcactgaattcggaatgaactgggtaaggcaagcaccaggacaaggtttagaatggatgggatggataaatacgaaaactggcgaagcaacatatgtagaagaatttaaaggcagagtaacatttacaactgatacgtcaacaagtaccgcatatatggaattaagaagtctacgttcagatgacaccgccgtttactattgtgcaagatgggatttcgcatactatgttgaagccatggattattggggacagggaacaacggtaacggtaagctcagcatcaacaaaaggaccaagtgtattcccattagccccatcatcaaaatcaacctcaggaggaacagctgctttaggatgtttagttaaagactacttcccagaaccagtaacagtatcatggaacagtggtgcattaacaagtggagtacatactttcccagccgtgttacaatcaagcggactatattcactaagttcggtcgtaacagtaccaagttcaagtttgggtacacaaacatatatatgtaatgttaaccataaaccctcaaacactaaagttgataaaaaagtagaaccgaaatcatgtgacaaaacacatacatgtccaccatgtcccgcacccgaagcagctggaggcccaagcgttttcctatttccacccaaacccaaagatacactaatgatcagtagaacaccggaagtaacatgcgtagtagtagatgtaagccacgaagatccagaagtaaaatttaattggtacgttgatggcgtcgaagtccataacgcaaaaacaaaaccaagagaagaacagtataatagtacatatagagtagtatctgtattaacagtcctacatcaagattggctaaacggaaaagaatacaaatgtaaagtctcaaataaagcattaggagcaccaatagaaaaaactatttcaaaagccaaaggacaacccagggaaccacaagtatataccctaccaccctgtcgtgatgaattaaccaaaaaccaagtaagcctatggtgcctagtcaaagggttttatccatctgatatagctgtggaatgggaaagcaatggacaaccagaaaacaattataaaacaacaccacctgtattagattcagacggtagtttcttcctttactcaaaacttacagtagataaatcaaggtggcaacaaggaaacgttttctcatgttcagtaatgcatgaagcacttcataaccattatacacaaaaatcactaagcctatcaccagggggaggtggtggttcaggtggcggcggatcaggaggtggaggatcagcaccagctagttcaagtacaaaaaaaacacaattacaattagaacacctactactagatctccaaatgatactaaacggaataaataattataaaaacccaaaattaacaagaatgctaactgctaaattcgcaatgccaaaaaaagcaaccgaattaaaacatctccaatgcctggaagaagaactaaaacctttagaagaagtcctaaatggcgcacaatccaaaaacttccatctaagaccacgagatctcattagtaacataaacgtaatagtgctagaactaaaaggtagtgaaaccacattcatgtgcgaatatgccgatgaaaccgcaacaattgtagaatttctcaaccgttggataacattcgctcaatcaataatatccacgttaaca

SEQ ID NO: 46001 - RNA, 645 nt, synthetic construct
  misc_feature 1..645: note = derived and/or modified sequence opt6 from Cergutuzumab_amunaleukin_LightChain1
  source 1..645: mol_type = other RNA
gacatacaaatgacacaatccccatcatcactatcagcatcagtcggagacagagtaacaataacatgcaaagcatcagccgcagtaggaacatacgtagcatggtatcaacaaaaaccaggaaaagccccaaaactacttatatattcagcatcatacagaaaaagaggagtaccatccagattctcaggatccggatcaggaacagactttacactaacaatatcatccctacaaccagaagattttgcaacctactactgccaccaatattacacatacccattattcacattcggacaaggaacaaaactagaaataaaaagaacagtagccgccccatcagtattcatattcccaccatcagacgaacaattaaaatcaggaacagcatcagtcgtatgcctactaaacaacttttacccaagagaagcaaaagtccaatggaaagtagacaacgcactacaatccggaaactcacaagaatcagtaacagaacaagactcaaaagactcaacatactcattatcatcaacactaacactatcaaaagctgactatgaaaaacacaaagtatacgcatgcgaagtaacacaccaaggcttatcatcaccagtaaccaaatccttcaacagaggcgaatgc

SEQ ID NO: 46002 - RNA, 687 nt, synthetic construct
  misc_feature 1..687: note = derived and/or modified sequence opt6 from Certolizumab_pegol_HeavyChain1
  source 1..687: mol_type = other RNA
gaagtacaattagtagaatcaggaggaggattagtacaaccaggaggatctttaagattaagctgtgcagcatcaggatacgtttttacagattacggcatgaattgggtaagacaagcaccaggaaaaggactcgaatggatgggatggataaacacatatataggagaacctatatatgcagattcagtaaaaggaagattcacatttagtctagacacatcaaaaagtacagcttatctacaaatgaactcattacgagcagaagatacagcagtatattactgcgcaagaggatatagatcatatgcaatggattattggggacaaggaacattagttacagtatcaagtgcatctacaaaaggaccaagtgtatttccactagcaccatcatcaaaatcaacatcaggaggaacagcagcattaggatgtctagtaaaagactattttccagaaccagtaacagtatcatggaattcaggagcattaacatcaggagtacatacatttccagcagtattacaaagttcaggattatattcattaagttcagtagtaacagtaccttcatcatcactaggaacacaaacatatatatgtaatgtaaaccataaaccatcaaatacaaaagtagataaaaaagttgaaccaaaatcatgtgataaaacacatacatgtgcagca

SEQ ID NO: 46003 - RNA, 687 nt, synthetic construct
  misc_feature 1..687: note = derived and/or modified sequence opt6 from Certolizumab_pegol_HeavyChain
  source 1..687: mol_type = other RNA
gaagtacaattagtagaaagcggaggaggactagtacaaccaggaggaagcttaagattaagttgtgcagcaagcggatatgtatttacagattatggaatgaattgggtaagacaagctcccggaaaaggactagaatggatgggatggataaatacatatataggagaaccaatatatgctgatagtgtaaaaggacgatttacatttagtttagatacatcaaaaagcacagcatatttacaaatgaatagtttaagagcagaagatacagcagtatattactgtgcaagaggatatagatcatatgcaatggattattggggtcaaggtacattagtaacagtaagttcagcatcaacaaaaggaccaagtgtatttccattagctccatcatcaaaaagtacaagtggaggaacagcagcattaggatgtttagtaaaagattattttccagaaccagttacagtatcatggaacagtggagcattaacttcaggagtacatacatttccagcagtattacaaagctcaggattatatagtttaagtagtgtagtaacagtaccaagttcatcattaggaacacaaacatatatatgtaatgtaaatcataaaccaagtaatacaaaagtagataaaaaagtagaaccaaaatcatgtgataaaacacatacatgtgcagca

SEQ ID NO: 46004 - RNA, 642 nt, synthetic construct
  misc_feature 1..642: note = derived and/or modified sequence opt6 from Certolizumab_pegol_LightChain1
  source 1..642: mol_type = other RNA
gacatacaaatgacacaatcaccatcaagcctaagcgcaagcgtaggagacagagtaacaataacatgcaaagcaagccaaaatgtaggaacaaacgtagcatggtaccaacaaaaaccaggaaaagcaccaaaagcactaatatacagcgcaagcttcctatacagcggagtaccatacagattctcaggctcaggatcaggaacagacttcaccctaacaatatcatcattacaaccagaagactttgcaacatactattgccaacaatacaacatatacccattaacattcggacaaggaacaaaagttgaaataaaaagaacagtagcagcaccatcagttttcatattcccaccctcagacgaacaactaaaatcaggaacagcctcagtagtatgcttactaaacaacttctacccaagagaagcaaaagtacaatggaaagtagataacgcactacaaagcggaaactcacaagaaagcgtaacagaacaagactcaaaagactcaacctacagcttaagctctacactaacactaagcaaagcagactacgaaaaacacaaagtatacgcatgcgaagtaacacaccaaggattaagctcaccagtaacaaaaagcttcaacagaggtgaatgc

SEQ ID NO: 46005 - RNA, 642 nt, synthetic construct
  misc_feature 1..642: note = derived and/or modified sequence opt6 from Certolizumab_pegol_LightChain
  source 1..642: mol_type = other RNA
gacatacaaatgacacaatcaccatcatcactatcagcatcagtaggagatcgagtaacaataacatgcaaagcatcacaaaacgtaggaacaaacgtagcatggtaccaacaaaaaccaggaaaagcaccaaaagcactaatatactcagcatccttcctatactcaggagtcccatacagattctcaggatcaggatcaggaacagacttcacactcacaatctcctcactacaaccagaagactttgcaacatactattgccaacaatacaatatatacccactaacattcggacaaggaacaaaagtagaaataaaaagaaccgtagcagcaccatcagtattcatattcccaccttctgacgaacaactaaaatcaggaacagcatcagtagtatgcctactaaacaacttctacccaagagaagcaaaagtccaatggaaagtagacaacgcactacaatcaggaaactcacaagaaagcgtaacagaacaagacagcaaagactcaacatacagcttatcatcaaccctaacactatcaaaagcagactacgaaaaacacaaagtatacgcatgcgaagtaacacaccaaggcctatcctcaccagtaacaaaatctttcaacagaggagaatgt

SEQ ID NO: 46006 - RNA, 1356 nt, synthetic construct
  misc_feature 1..1356: note = derived and/or modified sequence opt6 from Cetuximab_HeavyChain
  source 1..1356: mol_type = other RNA
caagtacaactaaaacaatcaggccccggacttgtacaaccatcccaatcattatcaataacttgtacagtttcaggcttttcattaacaaactacggagtacactgggtccgacaatcaccaggtaaaggactcgaatggttaggagtaatatggtctggcggaaatacagactataatacaccattcacatcccgattatccataaataaagacaactccaaatcccaagtattctttaaaatgaactcattacaatcaaacgacacagcaatatactattgtgcaagagccctaacatactatgactacgagtttgcatattggggacaaggtacattagtaacagtatcagcagcatcaacaaaaggaccatccgtctttccattagcaccatcatcaaaaagcacatccggaggaacagcagccttaggatgtttagtaaaagactatttcccagaaccagtaacagtctcatggaattccggagcactaacatcaggagtccatacctttccagcagtactacaatcatcaggattatactcactatcatcagtagtcacggtaccatcatcatctctaggaacacaaacatatatatgcaatgtaaatcacaaaccctcaaatacaaaagtagataaaagagtagaacctaaatcacctaaatcatgcgataaaacacatacctgccccccctgtccagcacccgaactactcggcggaccatccgttttcttattcccacctaaaccaaaagacaccctcatgatatcaagaacaccagaagtcacatgcgtcgtagtcgacgtttcacatgaagaccccgaagtcaaattcaactggtacgtagacggagtagaagtacacaatgccaaaaccaaaccaagagaagaacaatacaactcaacatacagagtagtttctgttctaacagttctccatcaagactggctaaacggcaaagaatacaaatgtaaagtctcaaataaagctctaccagctccaatagaaaaaacaatatctaaagcaaaaggccaacccagagaacctcaagtatataccttaccaccctcaagagatgaactaacaaaaaatcaagtatcactaacatgcttagtaaaaggattctacccatcagacatagcagtagaatgggaatcaaacggacaaccagaaaataactacaaaacaacaccacccgtcttagattcagacggctcattcttcctatatagcaaactaacagtcgataaatcccgctggcaacaaggtaatgtattttcctgctctgtaatgcacgaagccctacacaaccactatacacaaaaatcactatcactatcacctggaaaa

SEQ ID NO: 46007 - RNA, 1347 nt, synthetic construct
  misc_feature 1..1347: note = derived and/or modified sequence opt6 from Cetuximab_HeavyChain_variant
  source 1..1347: mol_type = other RNA
caagtacaactaaaacaatccggcccaggactagttcaaccttcacaatcattatcaataacatgcacagtctctggattctcactaacaaactacggagtacactgggtaagacagtcaccaggtaaaggactagaatggctaggcgtaatttggtctggaggaaacacagattacaacacaccattcacatcaagactatcaataaacaaagataactccaaaagtcaagtttttttcaaaatgaactcactccaatccaacgacactgccatctactactgcgcaagagcactaacatactacgactatgaatttgcatactggggacaaggaacactagtaaccgtatcagccgcatctacaaaaggtccatcagtattcccactagcaccatcatctaaatctacctcaggaggaacagcagccctaggttgcttagtaaaagactactttccagaaccagtaacagtctcatggaactcaggcgccctaacctcaggagtccacacattcccagcagtattacaatcatcaggcctatactcattatcttctgtagtaacagtaccatcctcttcattaggaacccaaacatacatatgcaacgtaaaccacaaaccttcaaacactaaagtagacaaaaaagtagaaccaaaatcttgcgataaaacacacacatgccctccatgtcccgcaccagaactactaggaggaccatcagtattccttttcccacccaaacccaaagacacactcatgatatcaagaactccagaagtaacatgcgtagtcgtagatgtatcccatgaagatcccgaagtaaaattcaattggtacgtagatggcgtagaagttcacaacgccaaaaccaaaccaagagaagaacaatataactctacatatcgagtagtatccgtactaacagttctacaccaagactggttaaacggaaaagaatacaaatgtaaagtatccaataaagcactaccagcaccaatagaaaaaacaatttcaaaagcaaaaggtcaaccccgcgaaccacaagtatacacacttcctccctctagagacgaattaaccaaaaatcaagtctcactaacatgcttagtaaaaggattttacccatcagatatagcagtcgaatgggaatcaaatggacaacctgaaaacaactacaaaaccacaccaccagttcttgactctgacggatcattttttctatactcaaaattaacagttgacaaatcaagatggcaacaaggaaacgtattttcttgttctgtcatgcacgaagcactccacaaccactatacacaaaaatccctctcactatcccccggaaaa

SEQ ID NO: 46008 - RNA, 639 nt, synthetic construct
  misc_feature 1..639: note = derived and/or modified sequence opt6 from Cetuximab_LightChain
  source 1..639: mol_type = other RNA
gacatactattaacacaatcaccagtaatattatccgtatcaccaggagaaagagtatcattttcctgccgagctagccaatccataggaacaaacatacactggtaccaacaaagaacaaacggctcaccaagactccttataaaatacgcatccgaatcaatatcaggaataccatcaagattctcaggctcaggatcaggaacagacttcacactatcaatcaattcagtagaatcagaagacatagccgactactactgccaacaaaacaacaactggccaacaacattcggagcaggaacaaaactagaactaaaacgaacagtagccgccccatccgtattcatattcccaccatcagatgaacaactaaaatcaggaacagcctcagtagtatgcctactaaacaacttctacccaagagaagcaaaagtacaatggaaagtcgacaacgcactacaatcaggaaactcacaagaatcagtaaccgaacaagactccaaagactcaacatactcactatcatcaacactaacactatcaaaagcagactacgaaaaacacaaagtatacgcatgcgaagtaacacaccaaggcctatcctcaccagtaaccaaatcattcaacagaggagca

SEQ ID NO: 46009 - RNA, 642 nt, synthetic construct
  misc_feature 1..642: note = derived and/or modified sequence opt6 from Cetuximab_LightChain_variant
  source 1..642: mol_type = other RNA
gacatattactcacacaatcaccagtaatactatcagtaagcccaggagaacgagtatcattctcatgcagagcatcccaatcaataggaacaaacatacactggtaccaacaaagaacaaacggctcacccagactactaataaaatacgcatcagaatcaatatctggaataccatcaagattctcaggatcaggatcaggcacagacttcacactatccataaactcagtagaatcagaagacatagcagactactactgccaacaaaacaacaactggccaacaaccttcggagcaggaacaaaactagaattaaaacgaacagtagcagcaccatcagtattcatattccccccatcagacgaacaactaaaatcaggaacagcatcagtagtatgcctactaaacaacttctacccaagagaagcaaaagtacaatggaaagtagacaacgcattacaatcaggaaactcacaagaatccgtaacagaacaagactccaaagactcaacatactccctatcatccacattaacattatcaaaagccgactacgaaaaacacaaagtatacgcatgcgaagtaacacaccaaggcttatcatcaccagtaacaaaatcattcaaccgaggagaatgc

SEQ ID NO: 46010 - RNA, 675 nt, synthetic construct
  misc_feature 1..675: note = derived and/or modified sequence opt6 from Citatuzumab_bogatox_HeavyChain1
  source 1..675: mol_type = other RNA
catcaccaccatcatcacgaagtacaattagtacaatcaggaccaggactagtacaaccaggaggatcagtaagaatatcatgcgcagcaagcggatacaccttcacaaactacggaatgaactgggtaaaacaagcaccaggaaaaggactagaatggatgggatggataaacacatatacaggagaatcaacatacgcagactcatttaaaggacgattcaccttctcactagacacatcagcatcagcagcatacctacaaattaacagtctcagagcagaagacacagcagtatactactgcgcaagattcgcaataaaaggagactactggggccaaggaacattattaacagtatcatcagcatcaacaaaaggaccaagcgtattcccattagcaccatcatcaaaaagcacaagcggaggaacagcagcactaggatgcttagtaaaagactacttcccagaaccagtaacagtatcatggaactcaggagcattaacatcaggcgtacacacattcccagcagtactacaatcatcaggcctatactcattatcaagtgtagtaacagtaccatcatcatcactaggcacacaaacatacatatgtaacgtaaaccacaaaccatcaaacacaaaagtagacaaaaaagtagaaccaaaatcatgc

SEQ ID NO: 46011 - RNA, 1443 nt, synthetic construct
  misc_feature 1..1443: note = derived and/or modified sequence opt6 from Citatuzumab_bogatox_LightChain1
  source 1..1443: mol_type = other RNA
gacattcaaatgacccaatcaccatcatccttaagcgcatcagtaggagaccgcgtaacaataacatgcagatccacaaaatcactactacattccaatggaataacctacctatactggtaccaacaaaaaccaggaaaagcaccaaaattactaatttaccaaatgagcaatctagcctcaggagtaccatcccgattcagctcatccggctcaggaacagacttcacactaacaataagttcattacagcccgaagactttgcaacttactattgtgcccaaaaccttgaaatacccagaacattcggtcaaggaacaaaagtcgaactaaaacgaacagtagcagcaccttccgtattcatatttcccccatctgacgaacaactcaaatcaggaaccgcatcagtcgtatgtctcttaaacaacttctacccacgagaagcaaaagtacaatggaaagtagacaacgcattacaatcaggaaattctcaagaatcagtaactgaacaagactcaaaagattcaacatattcattatcttcaacattaacactctcaaaagctgactacgaaaaacacaaagtatatgcatgcgaagtcacccaccaaggactatcatccccagtaaccaaatcattcaaccgaggagagtgcacacgacatcgccaacccagaggatgggaacaactatataacacagtttctttcaacttaggagaagcatacgaatatccaacattcatccaagatctaagaaacgaactcgcaaaaggaacacccgtttgccaactacctgtaactctacaaacaatagcagatgacaaaagattcgtcctagtagacataacaacaacttctaaaaaaacagtaaaagtagcaatagatgtaacagacgtatacgtagtcggataccaagacaaatgggacggaaaagatagagccgtcttcttagacaaagtacccacagtagcaacatcaaaactatttccaggagtaacaaacagagttacacttacattcgacggatcataccaaaaactagtaaacgcagcaaaagctgatcgaaaagcactagaactaggagtaaacaaactcgaatttagcatagaagcaatacacggaaaaaccatcaatggacaagaagcagcaaaattctttctaatcgtaatacaaatggttagcgaagcagctagatttaaatacatcgaaacagaagtagtagatagaggattatacggatcattcaaaccaaacttcaaagtattaaacctagaaaataactggggagacatcagtgacgcaatccataaaagcagtccacaatgtacaacaattaacccagcattacaattaatatcaccctccaacgacccctgggtagtaaacaaagtatcacaaatctcaccagacatgggaatactaaaattcaaatcatccaaa

SEQ ID NO: 46012 - RNA, 1380 nt, synthetic construct
  misc_feature 1..1380: note = derived and/or modified sequence opt6 from Cixutumumab_HeavyChain1
  source 1..1380: mol_type = other RNA
gaggtccaactagtacaatcaggagccgaagtcaaaaaaccaggttcttcagtaaaagttagctgcaaagccagcggaggaactttctcatcttacgccatctcatgggtaagacaagcacctggtcaaggactagaatggatgggaggcataatacccatattcggaacagctaactatgctcaaaaattccaaggaagagtcacaataacagccgacaaatctacatccacagcatacatggaactatcatcactaagatctgaagacacagctgtatattactgtgcaagggcaccattaagatttctagaatggtctacacaagatcactactactactactacatggacgtatggggcaaaggaactacagtcacagtatcatctgcaagcacaaaaggaccatcagtgtttcccttagccccatcatccaaaagcacttcaggcggaacagcagcactaggctgcttagtaaaagattactttccagaaccagtaacagtaagctggaattcaggagcactaacatcaggagtacacacatttccagcagtactacaaagttcaggactatactcattatcatcagtcgtaacagtaccatcatcctcactcggcactcaaacatatatatgcaacgtaaaccataaaccatcaaacacaaaagtagataaaaaagtagaaccaaaatcatgcgacaaaacccacacttgccctccctgcccagcaccagaattattaggaggcccatctgtattcctattcccaccaaaaccaaaagacactctaatgatatccagaacacctgaagtaacatgcgtagttgttgacgtatctcacgaagaccctgaagttaaatttaattggtatgtagacggagtagaagttcacaatgcaaaaacaaaacctagagaagaacaatacaattccacatatagagtggtttccgtcttaacagttctacaccaagactggctaaacggtaaagaatacaaatgtaaagtctctaataaagcactaccagctccaatagaaaaaacaatatccaaagccaaaggacaacccagagaaccacaagtatacacactaccaccatcccgagaagaaatgaccaaaaaccaagtatcactcacatgccttgtaaaaggattctacccatcagacatagcagtcgaatgggaatcaaacggacaacctgaaaataactacaaaacaacaccaccagtattagactcagacgggtcctttttcctatactccaaattaacagttgacaaatcccgatggcaacaaggaaacgtattctcctgttcagtaatgcatgaagcattacataaccactatacacaaaaatcactttcactatcacccggaaaa

SEQ ID NO: 46013 - RNA, 642 nt, synthetic construct
  misc_feature 1..642: note = derived and/or modified sequence opt6 from Cixutumumab_LightChain1
  source 1..642: mol_type = other RNA
tcatcagaactaacacaagaccccgcagtatcagtagcactaggtcaaacagtcagaataacatgccaaggagactcactaagatcatactacgcaacatggtatcaacaaaaaccaggacaagcaccaatactagtaatatatggagaaaacaaaagaccatcaggaatacccgacagattctcaggaagctcatcaggaaacacagcatctttaacaataacaggagcacaagcagaagacgaagcagactactactgcaaatcacgcgacggatcaggacaacacctagtattcggaggaggcacaaaattaacagtactaggacaaccaaaagcagccccaagtgtaacactattcccaccatcatcagaagaattacaagcaaacaaagcaacactagtatgcttaatatcagacttttacccaggagcagtaacagtcgcatggaaagcagacagttcaccagtaaaagcaggagtagaaacaacaacaccatcaaaacaatcaaacaacaaatacgcagcttcctcatacctatcactaactccagaacaatggaaatcacacagatcctactcatgccaagtaacacacgaaggatcaacagtagaaaaaacagtagcaccagcagaatgctca

SEQ ID NO: 46014 - RNA, 1350 nt, synthetic construct
  misc_feature 1..1350: note = derived and/or modified sequence opt6 from Clazakizumab_HeavyChain1
  source 1..1350: mol_type = other RNA
gaagtacaattagtagaatcaggaggaggcttagtacaacctggtggctcattaagactatcatgcgcagcatcaggcttctccctatcaaactactacgttacatgggtaagacaagcaccaggaaaaggactagaatgggtaggaataatatacggatctgacgaaacagcatacgcaacttcagccataggccgatttacaatatcacgagataattcaaaaaatacactatatctacaaatgaactctctaagagcagaagacacagcagtatactactgcgcaagagatgactcatcagactgggacgcaaaattcaacttatggggacaaggtacattagtcaccgtttcatcagcatcaacaaagggaccatcagtattccctttagcaccatcttcaaaaagcacatcaggaggaacagcagcactaggatgcctagtaaaagattatttccccgaacctgtaactgtctcctggaactcaggcgcactaacttccggagtacacacattccctgcagtactacaatcctctggactatactccttatcatcagtagttaccgtaccctcatcaagcttaggaacccaaacatacatatgcaatgtaaatcacaaaccatcaaatacaaaagtagacaaaagagtagaaccaaaatcctgcgacaaaactcacacatgcccaccatgccccgcaccagaactactaggtggcccctcagtatttttatttccacctaaacctaaagacacactaatgatatcaagaacacccgaagtaacatgcgtagtagtagacgtatcacacgaagatcctgaagttaaattcaattggtacgttgacggagtagaagtccataacgcaaaaacaaaaccaagagaagaacaatatgcatcaacatacagagttgtatcagtattaaccgtattacaccaagattggctaaacggcaaagaatacaaatgcaaagtttccaacaaagcactcccagcccccatagaaaaaacaatatcaaaagcaaaaggtcaaccaagagaaccacaagtctatacattaccaccaagcagagaagaaatgacaaaaaaccaagtatccctaacctgcttagtaaaaggtttctacccatcagacatagcagtagaatgggaatccaacggacaacctgaaaataactataaaacaacaccacccgttctagattcagatggttctttttttttatactcaaaattgacagttgacaaatcacgatggcaacaaggaaatgtcttttcttgctcagtaatgcacgaagcattacacaaccattatacacaaaaaagcttatcactaagtcctggaaaa

SEQ ID NO: 46015 - RNA, 651 nt, synthetic construct
  misc_feature 1..651: note = derived and/or modified sequence opt6 from Clazakizumab_LightChain1
  source 1..651: mol_type = other RNA
gcaatacaaatgacacaatcaccatcctcattatcagcatcagtaggagacagagtaaccataacatgtcaagcatcacaatcaataaataacgaactatcatggtaccaacaaaaaccaggaaaagcaccaaaattactaatatacagagcatcaacattagcatcaggagtaccatcaagattctcaggatcaggatcaggaacagactttacattaaccatatcatcactacaaccagacgacttcgcaacatactactgccaacaaggatactcattaagaaacatagacaacgcattcggaggaggaacaaaagtagaaataaaaagaacagtagcagcaccaagcgtattcatattcccaccatcagacgaacaactaaaatccggaacagcatcagtagtatgtctactaaacaacttctacccaagagaagcaaaagtacaatggaaagtagacaacgcactacaatccggaaactcacaagaatcagtaacagaacaagattccaaagactcaacatactcactatcatcaacattaacactaagcaaagcagactacgaaaaacataaagtatacgcatgcgaagtaacacaccaaggattaagctccccagtaacaaaatcattcaacagaggagaatgc

SEQ ID NO: 46016 - RNA, 1347 nt, synthetic construct
  misc_feature 1..1347: note = derived and/or modified sequence opt6 from Clivatuzumab_tetraxetan_HeavyChain1
  source 1..1347: mol_type = other RNA
caagtccaattacaacaatcaggagcagaagtaaaaaaacccggcgcatcagtaaaagtatcatgcgaagcctcaggatacactttccctagctacgttctacactgggtaaaacaagcaccaggacaaggtttagaatggataggatacataaacccatacaacgacggaacacaatacaatgaaaaatttaaaggaaaagcaacactaacccgtgatacatccatcaatacagcttatatggaactatcaagactacgaagcgacgacacagctgtatattactgcgcaagaggtttcggaggctcctacggattcgcttactggggccaaggcacattagtaacagtaagttccgcatcaacaaaaggtccctccgtattcccattagcaccatcttccaagtcaacatcaggaggaacagctgctctaggatgtttagtcaaagactacttccccgaaccagttacagtctcatggaactcaggagcactcacatcaggagtacatacatttccagccgttctacaatcttcaggattatactcactttcatcagtagttaccgtaccatcatcatcattaggaacacaaacatatatatgcaacgttaaccataaaccatcaaatacaaaagtcgataaaagagtagaaccaaaatcatgtgacaaaacacatacctgcccaccctgcccagcacctgaacttctaggcggaccttcagtattcttattccctccaaaacccaaagacaccctaatgatctcccgaacaccagaagtaacatgcgtagtagtcgacgtatcacacgaagatcctgaagtaaaattcaattggtatgtcgacggagtcgaagtacacaatgctaaaacaaaaccaagagaagaacaatacaactcaacataccgtgtagtctcagtactaacagtcctacaccaagactggctaaatggaaaagaatataaatgcaaagtatcaaacaaagcattaccagctcccatcgaaaaaacaatatcaaaagcaaaaggacaaccaagagaaccccaagtatacacattaccaccatcaagagaagaaatgacaaaaaatcaagtctctctaacttgcttagtaaaaggattctacccatcagacatcgcagtcgaatgggaatcaaacggacaaccagaaaacaactacaaaacaacaccacctgtattagactcagacggctcattcttcttatactcaaaactaacagtagataaatctcgatggcaacaaggaaacgtattttcatgcagcgttatgcatgaagccctacataatcactacacccaaaaatcactatccctatctccaggcaaa

SEQ ID NO: 46017 - RNA, 645 nt, synthetic construct
  misc_feature 1..645: note = derived and/or modified sequence opt6 from Clivatuzumab_tetraxetan_LightChain1
  source 1..645: mol_type = other RNA
gacatacaactcacacaatcaccatcatcattatcagcatcagtaggagaccgagtcacaatgacatgctcagcttcatcaagcgtatcatcatcatatctatactggtaccaacaaaaaccaggaaaagcacccaaactatggatatactcaacatccaacttagcatcaggagtaccagcaagattctcaggatcaggatcaggaacagactttacattaaccatatcatccctacaaccagaagactcagcctcatacttctgccaccaatggaaccgatacccatacacattcggaggaggaacaagactagaaatcaaaagaacagtagcagcaccatcagtattcatattcccaccatcagacgaacaactaaaatcaggaacagcaagcgttgtatgtctactaaacaacttctacccaagagaagcaaaagtccaatggaaagtagataacgcattacaatcaggaaattcacaagaatcagtaacagaacaagactcaaaagactcaacatactcactatcatccacactaacactatcaaaagcagactacgaaaaacacaaagtatacgcatgcgaagtaacacaccaaggactctcctcacccgtaacaaaatctttcaaccgcggagaatgc

SEQ ID NO: 46018 - RNA, 1335 nt, synthetic construct
  misc_feature 1..1335: note = derived and/or modified sequence opt6 from Codrituzumab_HeavyChain1
  source 1..1335: mol_type = other RNA
caagtacaactagtccaatcaggagccgaagtaaaaaaaccaggagcctcagtaaaagtatcatgcaaagcaagcggatacacatttacagactatgaaatgcactgggtacgacaagcaccaggacaaggactagaatggatgggagcattagaccccaaaactggtgacacagcatacagccaaaaattcaagggacgagtaacactaacagccgacaaatcaacaagcacagcatatatggaattatcctctttaacttcagaagatacagctgtctactactgtacaagattctactcatatacatactggggacaaggaacattagtaacagtttcatcagcaagtaccaaaggaccatcagtattcccattagcaccatcatccaaatcaacatcaggagggactgcagcactaggctgcttagtaaaagattactttccagaacctgttacagtatcatggaactcaggagcactaacatcaggagtacacacattcccagcagtactacaatcatcaggactttattcattatcatcagtcgtaactgtaccatcttcatcactaggaacacaaacatacatatgtaacgtaaaccacaaaccctcaaatacaaaagttgataaaaaagttgaacccaaaagttgtgacaaaacacacacatgtcccccatgtccagcaccagaactcttaggaggcccatcagtattcttattcccccccaaaccaaaagatacacttatgatatcaagaacaccagaagtcacctgcgtagtagtagacgtctcacatgaagaccccgaagtaaaattcaactggtacgtcgatggtgtagaagttcacaatgcaaaaacaaaaccaagagaagaacaatacaactccacatatagagtcgtatcagtcctaacagttttacaccaagactggctaaacggcaaagaatataaatgcaaagtttcaaacaaagcactaccagcaccaatagaaaaaacaatttcaaaagcaaagggacaaccaagagaaccgcaagtatacacattaccaccatcaagagacgaattgacaaaaaaccaagtaagtttaacatgcttagtaaaaggattttacccctcagatatagcagtcgaatgggaatcaaacggacaacctgaaaacaactacaaaacaactccaccagtccttgactcagacggctcattctttctatactcaaaactaacagtagacaaatcaagatggcaacaaggaaacgtattctcttgttccgtaatgcacgaagcactacacaatcattacactcaaaaatccctatccctttccccaggaaaa

SEQ ID NO: 46019 - RNA, 657 nt, synthetic construct
  misc_feature 1..657: note = derived and/or modified sequence opt6 from Codrituzumab_LightChain1
  source 1..657: mol_type = other RNA
gacgtagtaatgacacaatcaccactatccctaccagtaacaccaggagaaccagcatcaatctcatgcagatcatcacaatcactagtacactcaaacagaaacacatacttacactggtacctacaaaaaccaggccaatcaccacaactattaatatacaaagtatcaaacagattctccggagtaccagacagattctcaggatcaggatcaggaacagacttcacactaaaaatatccagagtagaagcagaagacgtaggagtatattactgctctcaaaacacacacgtaccaccaacattcggacaaggcacaaaattagaaataaaaagaacagtagcagcaccatcagtattcatattcccaccatcagacgaacaactaaaatcaggtacagcatcagtagtatgcctactaaacaacttttacccaagagaagcaaaagtacaatggaaagtagacaacgcactacaatccggaaactcacaagaatccgtcacagaacaagactcaaaagactctacatactcactatcatctaccctaaccctatcaaaagccgactacgaaaaacataaagtatacgcatgcgaagtaacacaccaaggactatcatcaccagtaacaaaatcattcaacagaggagaatgc

SEQ ID NO: 46020 - RNA, 1350 nt, synthetic construct
  misc_feature 1..1350: note = derived and/or modified sequence opt6 from Coltuximab_ravtansine_HeavyChain1
  source 1..1350: mol_type = other RNA
caagtacaactagtccaaccaggagccgaagttgttaaacctggagcatccgttaaactatcttgcaaaacatccggatacacctttacatctaattggatgcactgggtaaaacaagcacctggacaaggcttagaatggataggagaaatagatccatctgattcatacaccaattacaaccaaaacttccaaggtaaagcaaaactaacagtagacaaatctacaagtaccgcctacatggaagttagttcactcagaagcgacgacacagcagtatactactgcgcaaggggctcaaacccatactactatgctatggactattggggtcaaggaacctccgtaacagtatcaagtgcatcaacaaaaggcccatccgtatttccactcgcaccatcatcaaaatcaacatccggaggaaccgcagcacttggctgcctcgtaaaagactatttcccagaaccagtcacagtttcttggaactcaggagcactaacatcaggtgtacacacattcccagcagtattacaatcctcaggcctatattcattatcaagcgtagttacggtcccgtcatcatcattaggtacccaaacatacatctgcaatgtaaaccacaaaccatcaaacacaaaagtagacaaaaaagtagaaccaaaatcctgcgacaaaacacacacatgcccaccatgccccgcacctgaattgctaggcggaccatcagtattcttattcccaccaaaaccaaaagatacactaatgatatcaagaacaccagaagtcacttgcgtagttgtagacgtttcccacgaagatccagaagtaaaattcaattggtatgtagacggagtagaagtacataatgcaaaaaccaaaccacgagaagaacaatacaactcaacatacagagtcgtttcagtacttaccgtcttacatcaagactggctaaacggaaaagaatacaaatgtaaagtatcaaacaaagctctacccgcacctatagaaaaaacaatcagcaaagcaaaaggacaaccacgagaaccacaagtatacacactacctccttccagagatgaactaacaaaaaaccaagtatccttaacatgtctagtaaaaggattctacccatcagacatagccgtagaatgggaatcaaacggtcaaccagaaaacaactacaaaacaactccaccagtactagattctgacggttccttcttcctatactcaaaactaacagtagacaaatctagatggcaacaaggaaacgtattctcatgctcagtaatgcacgaagcactccataaccactacacacaaaaaagcttatctctatccccaggaaaa

SEQ ID NO: 46021 - RNA, 633 nt, synthetic construct
  misc_feature 1..633: note = derived and/or modified sequence opt6 from Coltuximab_ravtansine_LightChain1
  source 1..633: mol_type = other RNA
gaaatagtactaacacaatcaccagcaataatgagtgcatcaccaggagaacgagtaacaatgacatgctcagcatcatcaggagtaaactacatgcactggtatcaacaaaaacccggaacatcaccaagaagatggatatacgacacatcaaaactagcatcaggagtaccagcaagattctcaggatcaggaagcggcacagactactcattaacaatatcaagcatggaaccagaagacgcagcaacctattactgccaccaacgaggatcatacacatttggaggaggaacaaaactagaaataaaaagaacagtagcagcaccatcagtattcatattccccccatcagacgaacaattaaaaagcggaacagcatcagtagtatgcctattaaacaacttctacccaagagaagcaaaagtacaatggaaagtagacaacgcactccaatcaggaaactcacaagaaagtgtaacagaacaagactcaaaagactcaacatactcattatcaagcacattaacactatcaaaagcagactacgaaaaacacaaagtctacgcatgcgaagtaacacaccaaggattatcaagtccagtaacaaaatcatttaatagaggagaatgt

SEQ ID NO: 46022 - RNA, 1356 nt, synthetic construct
  misc_feature 1..1356: note = derived and/or modified sequence opt6 from Conatumumab_CV_HeavyChain
  source 1..1356: mol_type = other RNA
caagtacaattacaagaatcaggccccggtctagtaaaaccatcacaaacattatcactaacatgcacagtatccggaggatcaatatcctcaggagactacttctggtcatggataagacaactaccaggaaaaggattagaatggataggacatattcacaattccggaaccacctactataatccaagccttaaatcacgagtaacaatatcagtcgatacatctaaaaaacaattctcactaagactatcatcagtaacagcagcagatacagcagtctattactgcgctagagatagaggaggagattactactacggcatggatgtatggggacaaggaactacagtcacagtctcatcagcaagcacaaaaggaccctctgttttcccactagccccctcttctaaatccacatcaggaggtacagctgccttaggctgtctagtaaaagactacttccccgaaccggtaaccgtctcatggaactcaggagcactaacatctggagtacacacatttcccgcagtattacaatcctctggattatactccctttcctccgtagtcactgtaccttcctcatccctaggaacacaaacatacatatgcaatgtaaaccacaaaccatcaaacaccaaagtagacaaaagagtagaaccaaaatcttgcgacaaaacacacacatgtccaccatgcccagctccagaattactaggtggaccatcagtcttcttattccccccaaaaccaaaggatacactcatgatatcccgcactccagaagtcacatgcgtcgtagtagatgtctcacacgaagaccccgaagtaaaatttaattggtacgtagatggagtagaagtacacaacgcaaaaacaaaaccaagagaagaacaatacaacagtacatatagagtagtatccgtactcacagtattacatcaagattggctaaacggaaaagaatacaaatgtaaagtatcaaacaaagcattacccgcacccattgaaaaaacaatatcaaaagcaaaaggacaaccaagagaaccacaagtctacacattaccaccatcaagagaagaaatgacaaaaaaccaagtatcattaacctgtttagtaaaaggattctatccatctgatatcgcagtagaatgggaatctaacggtcaacccgaaaataactacaaaaccaccccaccagtactagactcagacggatccttttttttatactcaaaactaactgtagataaaagtagatggcaacaaggcaacgtattctcctgttctgtaatgcacgaagctctacataaccattacacacaaaaatcactatccctctcacccggaaaa

SEQ ID NO: 46023 - RNA, 645 nt, synthetic construct
  misc_feature 1..645: note = derived and/or modified sequence opt6 from Conatumumab_CV_LightChain
  source 1..645: mol_type = other RNA
gaaatagtcctaacacaatcaccaggaacactatcactatcaccaggagaaagagcaacactatcatgcagagcatcccaaggaatatcaagatcatacttagcatggtaccaacaaaaaccaggacaagcaccatcactattaatctacggagcatcatcacgagcaacaggaataccagacagattctcaggatccggctcaggcacagacttcacactaacaattagcagactagaaccagaagactttgcagtatactactgccaacaattcggatcatcaccatggacattcggacaaggcacaaaagtagaaataaaacgaacagtagcagcaccttcagtattcatattcccaccatcagacgaacaattaaaatccggaacagcatcagtagtatgcttactaaacaacttctacccccgagaagcaaaagtacaatggaaagtagacaacgcactacaatcaggaaactcacaagaatcagtaaccgaacaagattcaaaagactcaacatactcactatcatcaacattaacactaagcaaagcagactatgaaaaacacaaagtatacgcatgcgaagtaacacaccaaggattatcctcaccagtaacaaaatcattcaacagaggagaatgc

SEQ ID NO: 46024 - RNA, 1356 nt, synthetic construct
  misc_feature 1..1356: note = derived and/or modified sequence opt6 from Conatumumab_HeavyChain1
  source 1..1356: mol_type = other RNA
caagtacaacttcaagaatctgggccaggattagtaaaaccatctcaaacactatcactaacctgcaccgtatctggagggagcatatcatcaggagattacttctggtcatggatacgacaattacctgggaaaggcctagaatggataggtcacatacacaactcaggcacaacttattacaacccatccctcaaatcaagagtgaccatatcagtagatacatccaaaaaacaattttctctaagattatcatcagtcacagcagcagacacagcagtatattactgcgcaagagacagaggaggtgactattactacggaatggacgtatggggtcaaggcactactgtaacagtatcatccgcctcaaccaaaggaccatccgtattcccattagcaccatcttcaaaatccacaagtggaggaaccgcagcactaggatgcctcgtaaaagattacttccccgaacctgtaacagtatcatggaactcaggggcactaacatcaggagtacacacattccccgcagtcttacaatcttccggactgtactcattgtcatcagtcgtaaccgtaccatcctctagtttaggaacccaaacttatatttgcaacgtaaaccacaaaccctcaaacacaaaagtagacaaacgtgttgaaccaaaatcttgcgacaaaacacatacatgcccaccctgtccagcacccgaacttctaggaggaccaagtgtattcttattcccaccaaaaccaaaagatacactaatgatatcccgaacaccagaagtaacatgtgtagtagtagacgtttctcatgaagaccccgaagtaaaatttaattggtacgttgacggagtagaagtacacaatgcaaaaaccaaacctagagaagaacaatacaactctacatacagagtagtctccgtacttacagtattacaccaagattggttaaatggaaaagaatacaaatgcaaagtaagcaataaagctttacccgcaccaattgaaaaaacaatatccaaagcaaaaggacaaccaagagaacctcaagtatacacacttccaccatcacgagaagaaatgacaaaaaatcaagtctcattaacatgtttagtaaaaggattctacccctcagatatagcagtagaatgggaatcaaacggccaaccagaaaataactacaaaaccacacctccagtactagactccgacggatctttcttcttatactcaaaactaacagtcgacaaatcaagatggcaacaaggaaacgtattttcctgttcagtaatgcacgaagcactccataatcactatacacaaaaatcactttccctatcaccaggtaaa

SEQ ID NO: 46025 - RNA, 1356 nt, synthetic construct
  misc_feature 1..1356: note = derived and/or modified sequence opt6 from Conatumumab_HeavyChain
  source 1..1356: mol_type = other RNA
caagtacaactacaagaatcaggaccaggacttgtaaaaccatctcaaacactctctttaacctgtacagtatccggcggatcaatatcctcaggcgactacttctggtcatggataagacaattaccaggaaaaggcctagaatggataggacacatccacaactctggtaccacctattataacccctcattaaaatcaagagttacaatatcagtagacacatccaaaaaacaattctcactaagattatcctcagtcacagctgccgacaccgcagtatattactgcgcaagagacagaggtggagattactactacggaatggacgtatggggacaaggaactacagtaacagtaagttcagcatctacaaaaggcccatccgtatttccactagctccatcttcaaaatcaacatcaggaggtacagcagcactcggatgtctagtcaaagattatttcccagaaccagtaactgtctcctggaattcaggagccctaacttcaggagtacacacattcccagcagtcctacaatcttctggcctctactctctatcatcagtagtaaccgtaccatcatctagcttaggaacacaaacatatatttgcaatgtcaatcataaaccatccaacaccaaagtagacaaaagagtagaaccaaaatcctgtgataaaacacatacctgtccaccttgtcccgcaccagaactattaggtggaccatcagtctttcttttccctcctaaaccaaaagatacactaatgatatcacgaacacctgaagtcacatgcgtcgtagtagatgtatctcacgaagacccagaagtaaaattcaactggtacgttgacggagttgaagtacacaatgcgaaaacaaaaccaagagaagagcaatacaattcaacctaccgcgtagtaagcgtccttacagttctacaccaagactggctcaacggaaaagaatataaatgtaaagtatcaaacaaagcattacctgcgcccattgaaaaaacaatatccaaggctaaaggacaacctagagaaccccaagtatacacattaccaccatcaagagaagaaatgactaaaaatcaagtatcattaacatgtctagttaaaggcttctatccatcagacatagcagtcgaatgggaatctaatggacaaccagaaaataactacaaaacaacacctcccgtattagactcagacggctcattctttttatactcaaaactaacagtcgacaaatcacgttggcaacaaggaaatgtattttcatgctcagtaatgcacgaagcactacacaaccattacacacaaaaatcactttcactaagccccggaaaa

SEQ ID NO: 46026 - RNA, 645 nt, synthetic construct
  misc_feature 1..645: note = derived and/or modified sequence opt6 from Conatumumab_LightChain1
  source 1..645: mol_type = other RNA
gaaatagtcctaacacaatcaccaggaacattatcactctcaccaggagaaagagcaacactatcatgccgcgcctcacaaggaatatcaagatcctacctagcatggtatcaacaaaaaccaggacaagcaccatcactactaatatacggagcatcctcacgcgcaacaggaataccagacagattctcaggctctggatcaggaacagacttcacactaaccatatccagattagaaccagaagatttcgcagtatactactgccaacaattcggatcatccccatggacattcggacaaggaacaaaagtagaaataaaaagaacagtagcagcaccatcagtattcatattcccaccatcagatgaacaattaaaatcaggaacagcatcagtagtatgtctactaaacaacttctacccacgagaagcaaaagtacaatggaaagtagacaacgcactacaatcaggaaattcacaagaatcagtaactgaacaagactcaaaagactcaacatactcactatcatcaaccctaacactctcaaaagcagactacgaaaaacacaaagtatacgcatgtgaagtaacacaccaaggactatcatcaccagtaacaaaatcattcaacagaggagaatgc

SEQ ID NO: 46027 - RNA, 645 nt, synthetic construct
  misc_feature 1..645: note = derived and/or modified sequence opt6 from Conatumumab_LightChain
  source 1..645: mol_type = other RNA
gaaatagtactaacacaatcaccaggaacactatcactatcaccaggagaaagagcaacactatcatgtagagcatcacaaggaatatcaagatcctacctagcatggtaccaacaaaaaccaggacaagcaccatcattactaatatacggagcatcatcaagagcaacaggaataccagacagattctcaggctcaggatcaggaacagacttcacattaacaataagcagattagaacccgaagacttcgcagtatactactgccaacaattcggatcaagcccatggacattcggacaaggaacaaaagtagaaataaaaagaacagtagcagcaccatcagtattcatattcccaccatctgacgaacaactaaaatcaggaacagcatcagtagtatgcctactaaataacttctacccaagagaagcaaaagtacaatggaaagtagacaacgcactacaatcaggaaactcacaagaatcagtaacagaacaagactcaaaagactcaacatattccctatcatccacattaacactttcaaaagcagactacgaaaaacacaaagtatacgcatgcgaagtaacacaccaaggactatcatcaccagtaacaaaatcctttaatagaggagaatgc

SEQ ID NO: 46028 - RNA, 1344 nt, synthetic construct
  misc_feature 1..1344: note = derived and/or modified sequence opt6 from Concizumab_HeavyChain1
  source 1..1344: mol_type = other RNA
gaagtacaattagtagaaagtggaggaggattagtaaaaccaggaggctccctcagactatcctgtgcagcatctggatttactttctcaaactatgcaatgtcatgggtaagacaaacaccagaaaaaagactagaatgggtagcaactatctctagaagcggctcctactcatactttcccgattcagtacaaggaagatttacaatatcaagagacaatgcaaaaaatagcctttatcttcaaatgaattccctaagagccgaagacacagctgtatactattgtgcaagactaggaggatatgacgaaggagatgcaatggatagctggggccaaggaacaaccgtaacagtatcatcagcttcaacaaaaggaccctcagtatttccattagcaccctgctcaagatcaacatcagaatctacagcagctctaggatgcctagttaaagattattttccagaaccagtaacagtttcatggaatagcggtgcactaacttcaggcgtacacacattcccagcagtactacaatcatccggtctctattcactctcctcagtagttacagtaccctcctcaagtctaggtacaaaaacatacacatgtaacgtagatcataaaccatcaaatactaaagttgacaaacgagtcgaatccaaatacggaccaccatgcccaccatgtccagccccagaattcctaggcggaccatcagtatttttattcccccctaaaccaaaagacacactaatgatttcaagaacaccagaagttacctgtgtagtagtagatgtctctcaagaagacccagaagtacaatttaactggtacgtagacggagtcgaagtacataatgccaaaacaaaaccaagagaagaacaatttaattcaacttacagagtagtctccgtactaaccgtactacaccaagactggttaaatggcaaagaatataaatgtaaagtctcaaacaaaggactaccttcatcaatagaaaaaacaatatcaaaagccaaaggacaaccaagagaaccacaagtgtatacattacccccatcacaagaagaaatgacaaaaaaccaagtatcactcacatgtttagtcaaaggattctatccatcagacatagcagtcgaatgggaatctaacggacaacccgaaaacaactataaaactacaccacccgtactcgactcagatggaagtttctttctctactcaagacttacagtcgacaaatcaagatggcaagaaggtaatgtatttagctgttcagtaatgcatgaagcattacataaccactacacacaaaaatcattatcactatcactgggaaaa

SEQ ID NO: 46029 - RNA, 657 nt, synthetic construct
  misc_feature 1..657: note = derived and/or modified sequence opt6 from Concizumab_LightChain1
  source 1..657: mol_type = other RNA
gacatagtaatgacacaaacaccactatccctatcagtaacaccaggacaaccagcatcaatatcatgcaaaagctcacaatcactactagaatcagacggaaaaacatatctaaactggtacctacaaaaaccaggacaatcaccacaactactaatctacctagtatcaatattagactcaggagtaccagacagattctcaggatccggatcaggaacagacttcacattaaaaatatccagagtagaagcagaagacgtaggagtctattactgcctacaagcaacacacttcccacaaacattcggaggcggaacaaaagtagaaataaaacgtacagtagcagcaccatcagtattcatatttccaccctcagatgaacaactaaaatcaggaacagcttcagtagtatgcctattaaataacttctacccaagagaagcaaaagttcaatggaaagtagacaacgcactacaatcaggaaactcacaagaatcagtaacagaacaagactcaaaagactcaacatactcactatcatcaacactaaccttatcaaaagcagactacgaaaaacacaaagtatacgcatgcgaagtcacacaccaaggactatcatcaccagtcacaaaaagcttcaatagaggagaatgt

SEQ ID NO: 46030 - RNA, 1314 nt, synthetic construct
  misc_feature 1..1314: note = derived and/or modified sequence opt6 from Crenezumab_HeavyChain1
  source 1..1314: mol_type = other RNA
gaagtacaactagttgaaagcggaggaggattagtccaaccaggaggaagcctaagactatcatgcgccgcatcgggattcacttttagctcttacggaatgtcatgggtcagacaagcacctggaaaaggcctagaattagtcgcatcaataaactcgaacggaggatcaacatattatccagattcagtaaaaggaagattcacaataagtagagataacgcaaaaaactcactatacctacaaatgaactcactaagagcagaagacacagcagtttattactgcgccagtggagattattggggacaaggaacaaccgtaactgtatcttcagcatcaactaaaggcccttccgtatttccattagcaccatgctcacgaagtaccagcgaatcaacagccgccttaggatgtttagtaaaagattactttccagaaccagtaacagtctcatggaacagtggagctctaacgtcaggagttcatacatttccagctgtactacaatcatcagggctctattcattatcttcagtagttacagtaccctctagctcattaggaactaaaacctacacatgtaacgtagaccataaaccatccaatacaaaagtagataaaagagtagaatcaaaatacggtcctccatgcccaccatgtccagcaccagaatttcttggaggaccatcagtctttctatttccacctaaaccaaaagacacattaatgatctcaagaacaccagaagtaacatgtgttgttgtagacgtaagccaagaagacccagaagtacaatttaactggtatgtagacggagtagaagttcacaatgcaaaaacaaaaccaagagaagaacaattcaattccacatatagagtagtatcagtactaactgtccttcaccaagactggctaaatggaaaagaatataaatgtaaagtttcaaataaaggattaccttcaagtatagaaaaaactatctctaaagctaaaggccaaccaagagaaccacaagtatacacattaccaccatctcaagaagaaatgactaaaaatcaagtatcactaacgtgtttagtaaaaggattttacccatcagacatagcagtcgaatgggaatctaatggtcaaccagaaaacaactataaaacaacaccaccagtactagattcagatggatccttttttttatactcaagactaacagtcgataaatccagatggcaagaaggaaatgtattttcatgttccgttatgcacgaagcactacataaccactacacacaaaaatctctaagtctatcactaggc

SEQ ID NO: 46031 - RNA, 657 nt, synthetic construct
  misc_feature 1..657: note = derived and/or modified sequence opt6 from Crenezumab_LightChain1
  source 1..657: mol_type = other RNA
gacatagtaatgacacaatcaccattatcactaccagtaacaccaggagaaccagcatcaatatcatgcagatcctcacaatcactagtatactcaaacggagacacatacctacactggtacctacaaaaaccaggacaatcaccacaactactaatatacaaagtatcaaaccgtttctctggagtaccagacagattctcaggatccggctcaggaacagacttcacactaaaaataagcagagtagaagccgaagacgtaggagtatactactgctcacaatcaacacacgtaccatggacattcggacaaggaacaaaagtagaaatcaaaagaacagtagcagcaccatcagtattcatattcccaccatcagacgaacaattaaaatcaggaacagcatcagtagtatgtttactaaacaacttctacccaagagaagccaaagtccaatggaaagttgacaacgcattacaatcaggaaactcacaagaatcagtaacagaacaagattcaaaagactcaacatactccttatcctcaacattaacactatcaaaagcagactacgaaaaacacaaagtatacgcatgcgaagtaacacaccaaggattatcatcaccagtaacaaaatcattcaacagaggagaatgc

SEQ ID NO: 46032 - RNA, 1365 nt, synthetic construct
  misc_feature 1..1365: note = derived and/or modified sequence opt6 from Crotedumab_HeavyChain1
  source 1..1365: mol_type = other RNA
gaagtccaattagtagaatctggcggtggtttagtacaaccaggaggatcattacgattatcctgcgcagcctcaggatttacattttcaaattatcttatgaactgggtaagacaagcaccaggaaaaggattagaatggttagcaaacattcaagaagacggcatcgaaaaatactacgtagattctgtaaaaggtagatttacaatctcgagagataacgcaaaaaactcattatatctacaaatgaactcattacgcgcagaagacacagcagtatactattgcgcaagagaaccatcacactacgacatattaactggatacgactattactatggaatggacgtatggggacaaggaaccacagtaacagtatcaagcgcctccacaaaaggaccatcagtatttccattagcaccatgctcaagatcaacatcagaatcaacagcagcactaggatgtctagtaaaagactatttccccgaaccagtaacagtttcaaataactccggagctttaactagcggagtccacacatttccagcagtactacaatcgtcaggattatactcactatcatctgtagtaacagttccctcaagctcactaggcacaaaaacatatacatgtaacgtagaccacaaaccatccaatacaaaagtagataaaagagtagaaagcaaatacggaccaccatgcccaccatgtcccgcaccagaatttctaggaggaccttccgtatttttatttccacccaaaccaaaagatacattgatgatttcaagaacacccgaagttacatgtgtcgtcgtagatgtaagccaagaagacccagaagtacaattcaactggtatgtagacggagtcgaggtacataacgcaaaaacaaaacctagagaagaacaatttaatagcacctatagagtagtatcagtactaacagtactacatcaagattggttaaatggaaaagaatataaatgtaaagtatcaaataaaggactaccaagcagtatagaaaaaacaatatcaaaagcaaaaggccaaccaagagaaccacaagtatatacattaccaccaagccaagaagaaatgacaaaaaatcaagtaagcttaacatgtctagttaaaggattttatccatccgacatagccgttgaatgggaatctaacggacaaccagaaaacaactacaaaaccacaccaccagtattagatagcgatggatcattctttttatattccagactcacagtcgataaatccagatggcaagaaggaaacgtattctcatgctcagtaatgcacgaagccttacataaccactacacacaaaaatcactctcacttagcctcggaaaa

SEQ ID NO: 46033 - RNA, 1365 nt, synthetic construct
  misc_feature 1..1365: note = derived and/or modified sequence opt6 from Crotedumab_HeavyChain2
  source 1..1365: mol_type = other RNA
gaagtacaattagttgagtcaggaggaggactagtacaaccaggtggctcactacatttaagctgtgccgcaagcggatttacattttccaattatttaatgaattgggtaagacaagcacctggaaaaggactagaatggctagctaacatccaagaagacggaatagaaaaatactacgtagactcagtaaaaggaagattcacaatatctagagataacgcaaaaaattccttataccttcaaatgaactctctaagagcagaagacacagcggtttattactgcgccagagaaccatcacattacgacatattaacaggatatgactattactatggaatggacgtttggggacaaggtacaacagtaacagtatcctcagcatcaacaaaaggtccatccgtatttccactagcaccctgctcaagatcaacatcagaaagtacagcagcactaggctgtctcgttaaagattatttcccagaaccagtaacagtctcaaataactcaggagctctaacttccggggtacacacattcccagcagtattacaatcttcgggattatattcattatcatccgtagtaacagtaccatcttcatcactaggaacaaaaacctatacatgcaacgtagaccacaaaccatcaaacaccgaagtagatgaaagagtagaatcaaaatatggtccaccatgcccaccctgtccagcaccagaatttctaggaggtccatcagtatttttatttccaccaaaaccaaaagatacactaatgattagcagaacacctgaagtaacctgtgtagttgtagatgtatcacaagaagacccagaagtccagtttaactggtacgtagacggagtagaagtacataatgcaaaaaccaaaccaagagaagaacaattctggtcaacctaccgtgtagtttcagtactaaccgtactccaccaagattggctaaatggaaaagaatacaaatgcaaagtttcaaataaaggactaccatcatcaatagaaaaaacaatttcaaaagccaaaggacaacccagagaacctcaagtgtacacactaccaccatcacaagaagaaatgacaaaaaaccaagtttcactaacatgtttagttaaaggattttatccatcagatatagcagtagaatgggaatcaaacggacaaccagaaaacaactataaaacaaccccaccagtattagattcggatggatctttcttcttatattcaagactaacagtagacgaatcacgatggcaagaacacaatgtatttagctgctccgttatgcatgaagcactacataaccattatacccaaaaatctctatcattatcactaggtaaa

SEQ ID NO: 46034 - RNA, 642 nt, synthetic construct
  misc_feature 1..642: note = derived and/or modified sequence opt6 from Crotedumab_LightChain1
  source 1..642: mol_type = other RNA
gacatacaaatgacacaatcaccatccagcttatcagcatcagtaggagaccgcgtaacaataacatgcagagcatcacaaggaataagaaacgacctaggatggtaccaacaaaaacccggaaaagcaccaaaacgattaatatacgccgcatcatcactacaaagcggagtaccatcaagattctccggatcaggatcaggaacagaattcatactaacagtatcatcactacaaccagaagacttcgccacatattactgcttacaatacaacgaaaacccattcacattcggacccggaacaaaagtagacataaaaagaacagtagcagcacccagtgtattcatattcccaccatccgacgaacaattaaaatcaggaacagcatcagtagtatgcttactaaacaacttctacccaagagaagcaaaagtccaatggaaagtagacaacgcactacaatccggaaactcacaagaatcagtaacagaacaagacagcaaagactcaacatactcattaagctcaacattaacactatcaaaagcagattacgaagaacacaaagtatacgcctgcgaagtaacacaccaaggactatcatcaccagtaacaaaatcattcaacagaggcgaatgc

SEQ ID NO: 46035 - RNA, 642 nt, synthetic construct
  misc_feature 1..642: note = derived and/or modified sequence opt6 from Crotedumab_LightChain2
  source 1..642: mol_type = other RNA
gacatacaaatgacacaatcaccatcatcactaagtgcatccgtaggagacagagtaacaataacatgtcgagcatcacaaggaataagaaatgacctaggctggtaccaacaaaaacccggaaaagcaccaaaaagattaatatacgccgcttcctcactccaatcaggagtaccatcaagattctccggatcaggctctggaacagaattcatactaacagtatcctcactacaaccagaagactttgccacatactactgcttacaatataactcaaacccattcacattcggaccaggaacaaaagtagacataaaacgaacagtagcagccccatcagtattcatattcccaccatcagacgaacaactaaaatccggaacagcatcagtagtatgcttactaaacaacttctacccaagagaagcaaaagtacaaaacaaagtagacaacgcactccaatcaggaaactcacaagaatcagtaacagaacaagactcaaaagactcaacatactccctaagctccacattaacactatcagaagcagattacgaaaaacacaaagtatacgcatgcgaagtaacacaccaaggtctatcatcaccagtcacaaaatccttcaaccgaggagaatgc

SEQ ID NO: 46036 - RNA, 1332 nt, synthetic construct
  misc_feature 1..1332: note = derived and/or modified sequence opt6 from Dacetuzumab_HeavyChain1
  source 1..1332: mol_type = other RNA
gaagtacaattagtagaatcaggcggaggtctagtacaaccaggtggatccctaagactatcatgcgcagcctcaggctatagttttacaggatattacatacattgggtaagacaagcaccaggaaaaggactagaatgggtagcacgagtaataccaaatgcaggaggaacaagctataaccaaaaatttaaaggaagatttacattatcagtagataatagtaaaaatacagcatacttacaaatgaactctctcagagcagaagacacagcagtatattattgcgcaagagaaggaatatattggtggggtcaaggcacgctagtaacagtatcatcagcaagtacaaaaggaccatctgtattcccacttgcaccctcatcaaaatcaacatcaggaggcaccgcagcactaggctgcttagtaaaagactacttcccagaaccagtaacagtaagttggaatagcggagccctaactagcggagtacatacatttcccgcggtattacaaagctccggattatactcactaagctcagtagtaacagtaccatcaagtagtttaggcacacaaacatatatatgcaacgtaaaccacaaaccatcaaatacaaaagtagataaaaaagtcgaaccaaaatcatgtgacaaaacacacacctgcccaccatgcccagccccagaacttctaggtggtccatcagtattcctatttccaccaaaaccaaaagacaccctaatgatatccagaacccctgaagtaacatgcgtagttgtagacgtaagccatgaagacccagaagttaaatttaactggtatgttgacggagtagaagtacataatgcaaaaactaaacctagagaagaacaatacaattcaacatatagagtagtatcagtattaacagtactccatcaagactggctaaacggtaaagaatacaaatgcaaagtaagtaacaaagcattacctgccccaattgaaaaaacgatatcaaaggcaaagggccaacctagggaaccacaagtatacacattaccaccaagtagagaagaaatgacaaaaaaccaagtatcactaacttgcttagtgaaaggattctacccaagtgacatagcagtagaatgggaaagcaacggtcaaccagaaaataattacaaaaccactccacctgtactagacagcgacggatccttctttttatacagtaaattaacagtagacaaatcaagatggcaacaaggaaacgtattctcctgtagtgtaatgcatgaagctctacataatcattacacacaaaaatcactatcattaagtccaggaaaa

SEQ ID NO: 46037 - RNA, 657 nt, synthetic construct
  misc_feature 1..657: note = derived and/or modified sequence opt6 from Dacetuzumab_LightChain1
  source 1..657: mol_type = other RNA
gacatacaaatgacacaatcaccatcatcactatcagcatcagtaggagaccgagtaacaattacctgcagatcatcacaatcactagtacactcaaacggaaacacattcttacattggtaccaacaaaaaccaggaaaagcaccgaaactactaatatacacagtatcaaacagattctctggcgtaccatcaagattttcaggatccggatccggaacagacttcacactcacaatatcctcactccaaccagaagacttcgcaacatacttctgctcccaaacaacacacgtaccatggacattcggacaaggaaccaaagtagaaataaaaagaacagtagcagcaccatccgtattcatattcccaccatccgacgaacaactaaaatcaggaacagcttcagttgtatgcctattaaataacttctacccaagagaagcaaaagtacaatggaaagtagacaacgcattacaatccggaaactcacaagaatcagtaacagaacaagactcaaaagattcaacatactcattatcatcaacactaacactaagcaaagcagactacgaaaaacacaaagtatacgcatgcgaagtaacacaccaaggattatcatcaccagtaacaaaatcattcaacagaggagaatgc

SEQ ID NO: 46038 - RNA, 318 nt, synthetic construct
  misc_feature 1..318: note = derived and/or modified sequence opt6 from Dacliximab_LightChain_VJ-Region
  source 1..318: mol_type = other RNA
gacatacaaatgacacaatcaccatcaacactatcagcatcagtaggagacagagtaacaataacatgctcagcatcatcatcaatatcatacatgcactggtaccaacaaaaaccaggaaaagcaccaaaattactaatatacacaacatcaaacctagcatcaggagtaccagcaagattctcaggatcaggatcaggaacagaattcacactaacaatatcatcactacaaccagacgacttcgcaacatactactgccaccaaagatcaacatacccactaacattcggacaaggaacaaaagtagaagtaaaa

SEQ ID NO: 46039 - RNA, 348 nt, synthetic construct
  misc_feature 1..348: note = derived and/or modified sequence opt6 from Dacliximab_gamma2-Chain_VDJ-Region
  source 1..348: mol_type = other RNA
caagtacaattagtacaaagcggagcagaagtaaaaaaaccaggatcaagcgtaaaagtaagctgtaaagcaagcggatacacattcacaagctatagaatgcactgggtaagacaagcaccaggacaaggactagaatggataggatatataaatccatcaacaggatatacagaatataaccaaaaatttaaagataaagcaacaataacagcagacgaaagcacaaacacagcatatatggaactatcaagcttaagatcagaagatacagcagtatattactgtgcaagaggaggaggagtattcgattactggggacaaggaacactagtaacagtaagctca

SEQ ID NO: 46040 - RNA, 1326 nt, synthetic construct
  misc_feature 1..1326: note = derived and/or modified sequence opt6 from Daclizumab_HeavyChain
  source 1..1326: mol_type = other RNA
caagtgcaactagtacaaagtggtgcagaagtaaaaaaacccggatcatcagtaaaagtaagttgtaaagcatcaggttacacattcacaagctacagaatgcattgggtaagacaagctccaggacaaggtttagaatggatcggttatattaatccatcaacaggatacacagaatacaaccaaaaattcaaagataaagcgacaatcacagcagacgaatcaactaacactgcatatatggaactatcatcactcagaagcgaagacacagcagtttactactgtgcaagaggaggtggtgtcttcgattactggggccaaggcacaacactaacagtcagcagtggcccatcagtttttccactagcaccatcatcaaaaagcacaagcggaggaacagcagcactaggttgtttagtaaaagattattttcctgaaccagttacagtgtcttggaatagcggagcattaacatcaggagtacacacatttccagcagtattacaatcttctggcctatactccctatcctcagttgtaacagtaccaagctcaagcctaggaacacaaacatatatatgtaatgtaaatcacaaaccctcaaataccaaagtagacaaaaaagcagaaccaaaatcctgcgacaaaacacacacatgcccaccatgcccagcacctgagttactaggaggaccatcagttttcctatttccaccaaaaccaaaagacacactaatgatatcacgaacacccgaagtaacttgtgtagtagtagatgtatcccacgaagaccctgaagtaaaattcaactggtacgtagatggcgtagaagtacataatgcaaaaacaaaaccacgagaagaacaatacaattctacatacagagtagtttcagttctaacagtcctacaccaagactggctaaatggaaaagaatataaatgcaaagtatcaaataaagctctaccagcaccgatagaaaaaacaatatctaaagcaaaaggccaaccaagagaaccacaagtatacaccttaccaccatcaagagatgaactcacgaaaaaccaagtatcattaacatgcctcgtaaaaggattctatccatcagacatagccgtagaatgggaatcaaacggacaaccagaaaacaactataaaactacaccaccagtactcgattccgatggatcattcttcctttactcaaaactaacagtagataaatcaagatggcaacaaggcaacgtattttcatgtagtgtaatgcatgaagcattacacaatcattacacacaaaaaagcctttcactatcaccaggtaaa

SEQ ID NO: 46041 - RNA, 630 nt, synthetic construct
  misc_feature 1..630: note = derived and/or modified sequence opt6 from Daclizumab_LightChain
  source 1..630: mol_type = other RNA
gacatccaaatgacacaatctccatcaacactatcagcatcagtcggagacagagtaacaataacatgctcagcatcatcatcaatatcatacatgcactggtaccaacaaaaaccaggcaaagcacccaaactactaatatatacaacatctaacttagcatcaggagttccagcaagattctcaggctcaggatcaggaacagaattcacactaacaatatcatcattacaacccgatgacttcgcaacatactactgccaccaaagatcaacataccccctaacattcggatcaggaacaaaagtagaagtaaaaagaaccgtagcagcaccatcagtattcatattcccaccatcagacgaacaactaaaatcaggaacagcatcagtcgtatgcctattaaataacttctacccaagagaagcaaaagtacaatggaaagtagataacgcactacaatccggaaattcacaagaatctgtaacagaacaagactccaaagattcaacatactcactatcctcaacactaacactatccaaagcagactacgaaaaacacaaagtatacgcatgcgaagtaacacatcaaggactatcatcaccagtaaccaaatcattcaacaga

SEQ ID NO: 46042 - RNA, 1341 nt, synthetic construct
  misc_feature 1..1341: note = derived and/or modified sequence opt6 from Dalotuzumab_HeavyChain1
  source 1..1341: mol_type = other RNA
caagtacaattacaacaaagtggaccaggattagtcaaaccttcacaaactctatctctaacatgcacagtatcaggatggtcaatctcaggtggctggctatggaattggataagacaacctccaggaaaaggacttcaatggataggatggatatcctgggacggaacaaacaactggaaaccatcccttaaagatagagtaacaatatccgtagacacatcaaaaaatcaattctctttaaaactttcaagtgtaacagcagctgacacagccgtatggtggtgtgcacgatggggtagagtatttttcgattggtggggtcaaggtacactcgtaacagtcagtagtgcttcaaccaaaggcccatccgtattcccattagccccctcctcaaaatcaacatcaggaggaacagcagctctaggatgtctagttaaagactacttcccagaaccagtaacagtatcatggaactcaggagcattaacatcaggagtacacacatttcccgcagttttacaatcatcaggactatactcactatcatctgtagtcacagtaccatcatcttctttaggaacacaaacatacatatgcaacgtgaatcataaaccatcaaatacaaaagtcgataaaagagtagaaccaaaatcctgtgacaaaacccatacttgcccaccatgtccagccccagaactactaggaggaccatcagttttcctattcccaccaaaaccaaaagacaccctaatgatatcaagaacaccagaagtaacatgtgtagtcgtagatgtatcacacgaggacccagaagtcaaattcaattggtatgtagatggagtagaagtacacaatgcaaaaacaaaaccaagagaagaacaatataactctacatatagagtagtatcagtcttaaccgttctacatcaagactggttaaatggcaaagaatacaaatgcaaagtttcaaataaagctttacctgcaccaattgaaaaaacaatatctaaagccaaaggacaacccagagaaccacaagtttatacattaccaccttcaagagaagaaatgacaaaaaaccaagtctcactaacatgtctagtcaaaggattctatccatcagatatagcagtagagtgggaatcaaacggacaaccagaaaacaactacaaaaccacaccccccgttttagactcagacggaagtttctttctttactcaaaacttacagtagataaatcaagatggcaacaaggcaatgtattctcatgcagcgtcatgcacgaagcattacacaatcactacacccaaaaatctttatcactatcaccaggaaaa

SEQ ID NO: 46043 - RNA, 657 nt, synthetic construct
  misc_feature 1..657: note = derived and/or modified sequence opt6 from Dalotuzumab_LightChain1
  source 1..657: mol_type = other RNA
gatatagtaatgacacaatccccattatcattaccagtaacacctggacaaccagcctcaatatcatgcagatcatcacaatcaatagtacactcaaacggaaatacatggttacaatggtggctacaaaaaccaggacaatcaccacaactactaatatggaaagtatcaaacagactatggggagtaccagacagattctcaggatcaggatcaggaacagacttcacactcaaaatatcaagagtccaagctcaagatgtaggagtatggtggtgcttccaaggatcacacgtaccctggaccttcggacaaggaacaaaagtacaaataaaacgaacagtcgcagccccatcagtatttatattcccaccctcagacgaacaactaaaatcaggaacagcatcagtagtatgcctactaaacaacttctacccaagagaagcaaaagtacaatggaaagtagacaacgcactacaaagcggaaactcacaagaatcagtaacagaacaagactcaaaagactcaacatactcattatcatcaacactaacactatcaaaagccgactacgaaaaacacaaagtatacgcatgcgaagtaacacatcaaggactatcatcaccagtaacaaaatcattcaacagaggagaatgt

SEQ ID NO: 46044 - RNA, 687 nt, synthetic construct
  misc_feature 1..687: note = derived and/or modified sequence opt6 from Dapirolizumab_pegol_HeavyChain1
  source 1..687: mol_type = other RNA
gaagtacaattagtagaaagtggaggaggactagtacaaccaggaggaagtctacgattaagctgtgcagtatcaggattctcaagcacaaattatcacgtacactgggtaagacaagcaccaggaaaaggattagaatggatgggagtaatatggggagacggagatacatcatacaatagcgtattaaaaagtagattcacaatatcacgagatacatcaaaaaatacagtatacttacaaatgaactcattaagagcagaagacacagccgtatattattgcgcaagacaactaacacattattacgtattagcagcatggggacaaggaactctcgtaacagtaagttcagcatcaactaaaggaccaagtgtgttcccactagcaccctcaagcaaaagcacaagtggaggaacagccgcattaggatgtctagtaaaagactatttcccagaaccagtaacagtatcatggaatagcggagcattaacatcaggcgtacacacattcccagcagtactacaaagctcaggcctatactcattatcaagcgtagtaacagtacctagttcaagcttaggaacgcaaacatacatatgtaatgtaaatcacaaaccttcaaacacaaaagtagataaaaaagtagaaccaaaatcatgcgataaaacacacacatgcgcagca

SEQ ID NO: 46045 - RNA, 642 nt, synthetic construct
  misc_feature 1..642: note = derived and/or modified sequence opt6 from Dapirolizumab_pegol_LightChain1
  source 1..642: mol_type = other RNA
gatatacaaatgacacaatcaccctcatcactatcagcatcagtaggagacagagtaaccatcacatgcagagcatcagaagacctatactacaatctagcatggtaccaaagaaaaccaggaaaagcaccaaaactactaatatacgacacatacagattagcagatggagtaccaagcagattctcaggatcaggatcaggaacagactacacattaacaataagctcactacaaccagaagacttcgcatcatactactgccaacaatactacaaattcccattcacatttggacaaggaacaaaagtagaaataaaaagaacagtagcagcaccatccgtattcatattccccccatcagacgaacaactaaaatcaggcacagcatcagtagtatgcttactaaacaacttttacccaagagaagcaaaagtacaatggaaagtagacaacgcattacaatcaggtaactcacaagaatcagtaacagaacaagactcaaaagactcaacatactcactatcatcaacattaacactaagcaaagcagactacgaaaaacacaaagtatacgcatgcgaagtcacacaccaaggattatcatcaccagtaacaaaatcattcaacagaggagaatgc

SEQ ID NO: 46046 - RNA, 1356 nt, synthetic construct
  misc_feature 1..1356: note = derived and/or modified sequence opt6 from Daratumumab_HeavyChain1
  source 1..1356: mol_type = other RNA
gaagtacaattactagaatcaggcggaggactagtacaaccaggaggatccctaagattatcatgtgccgtatctggtttcacattcaattcatttgcaatgtcatgggtaagacaagccccaggtaaaggcttagaatgggtaagcgcaatttcaggatctggaggaggaacttactatgcagactcagtaaaaggaagatttaccatatcacgcgacaattcaaaaaacactttatacttacaaatgaattcattacgcgcagaagacacagcagtatatttctgtgcaaaagacaaaatattatggttcggagaacctgtattcgattactggggtcaaggaacattagtaacagtctcatcagcttcaacaaaaggaccatctgtatttccattagcaccttcatccaaatctacatcaggtggaactgcagcattaggatgtttagtcaaagattatttcccagaacctgtaactgtatcatggaattcaggcgcacttacttcaggcgtccacacattcccagcagtcctacaatcatccggtttatactccctatcatcagtagtaacggttccttcatcttcactaggaacacaaacttacatatgtaatgtcaatcacaaaccatcaaacacaaaagttgataaaagagtagaacctaaatcatgtgataaaacacacacttgcccaccatgtccagcaccagaactacttggtggcccatcagtttttctattcccaccaaaaccaaaagatacactaatgataagcagaacaccagaagtaacatgtgtagtagtagacgtttcacacgaagatcccgaagtaaaattcaattggtacgttgacggagtagaagtacataacgcaaaaaccaaaccacgagaagaacaatataattcaacataccgagtagtatcagtcctaacagtattgcatcaagattggttaaacggtaaagaatataaatgtaaagtctcaaacaaagcactaccagcacctatagaaaaaacaatctctaaagccaaaggacaacccagagaacctcaagtctacacattaccaccaagtagagaagaaatgacaaagaatcaagtatcattaacttgtcttgtcaaaggtttttatccctctgacattgcagtagaatgggaatcaaatggacaacctgaaaacaattataaaactactccccccgttttagacagtgacggatctttttttctatactcgaaactaacagtagacaaatctagatggcaacaaggtaatgtattttcttgttcagttatgcatgaagcattacataaccattacacacaaaaatcattatcattatcacctggaaaa

SEQ ID NO: 46047 - RNA, 642 nt, synthetic construct
  misc_feature 1..642: note = derived and/or modified sequence opt6 from Daratumumab_LightChain1
  source 1..642: mol_type = other RNA
gaaatagtattaacacaatcaccagcaacattatcattatcaccaggagaaagagcaacattatcatgcagagcatcacaaagcgtatcatcatacctagcatggtaccaacaaaaaccaggacaagcaccaagattattaatatacgatgcatcaaatagagcaacaggaataccagccagattctcaggctcaggatcaggaacagacttcaccctaacaatatcatcactagaaccagaagacttcgcagtatattactgccaacaaagatcaaactggccaccaacattcggacaaggaacaaaagtagaaatcaaaagaacagtagcagcaccatctgtattcatattcccaccatcagacgaacaactaaaatcaggaacagcctctgtagtatgcctactaaacaacttctacccaagagaagcaaaagtacaatggaaagtagacaacgcactacaaagcggaaactcacaagaatcagtaacagaacaagattcaaaagactcaacctactcactaagttcaacactaacattaagcaaagcagactacgaaaaacataaagtatacgcatgcgaagtaacacaccaaggattatcatctcccgtaaccaaatcattcaacagaggagaatgc

SEQ ID NO: 46048 - RNA, 1350 nt, synthetic construct
  misc_feature 1..1350: note = derived and/or modified sequence opt6 from Dectrekumab_HeavyChain1
  source 1..1350: mol_type = other RNA
gaagttcaactagtcgaatcaggcggtggagtagtacaaccaggcagatccctaagactatcatgcgcagcatcaggtttcacattttcaagctacggaatgcattgggtacgacaagcaccaggaaagggattagaatgggtagctatcatatggtacgacggttctaacaaatattacgctgactctgtaaaaggacgattcacaatatcaagagacaattcaaaaaacacattatatttacaaatgaactcactaagagccgaagacacagcagtatactactgcgcacgcttatggttcggagacttagacgcattcgatatatggggacaaggaacaatggtaacagtctcatccgcatcaacaaaaggaccatctgtattcccattagcaccttcctccaaatcaacctcaggtggaacagcagcactcggatgcctagtaaaagactactttcccgaacctgtaacagtatcatggaactcaggagcactaactagcggcgtccacacctttccagctgtactacaatcatctggtctatattcactaagttcagtagtcacagtaccatcctcatcactaggaactcaaacctatatatgcaacgtaaaccacaaaccatccaacaccaaagtcgataaaagagtcgaaccaaaatcatgcgacaaaacacatacatgcccaccctgcccagcaccagaactacttggaggtccatcagtctttttattccctccaaaaccaaaagacactctaatgatatccagaactccagaagtaacttgcgtagtcgtagacgttagccacgaagatcccgaagtaaaatttaactggtacgtcgacggagtagaagtacacaatgcaaaaacaaaacccagagaagaacaatacaattcaacctacagagtagtatcagtattaaccgtattacatcaagactggttaaatggaaaagaatacaaatgcaaagtatcaaataaagcattaccagcaccaatagaaaaaacaatatccaaagccaaaggccaaccacgagaaccacaagtatatacattaccaccttcaagagaagaaatgaccaaaaaccaagtaagcctcacttgcttagtaaaaggattctatccatcagacatagcagtagaatgggaatccaacggacaaccagaaaacaattacaaaacaactcccccagtacttgactctgacggatcatttttcctctactcaaaactaaccgtagacaaatcaagatggcaacaaggaaatgtattcagctgctctgtaatgcacgaagcattacacaatcactacactcaaaaatccctatcattatcaccaggcaaa

SEQ ID NO: 46049 - RNA, 648 nt, synthetic construct
  misc_feature 1..648: note = derived and/or modified sequence opt6 from Dectrekumab_LightChain1
  source 1..648: mol_type = other RNA
gaaatagtattaacacaatcaccagcaacactaagcctatcaccaggagaacgagcaatcttatcatgtagagcaggacaatcagtatcatcttacttagtctggtaccaacaaaaacccggacaagcaccaagactactaatatatgacgcaagcaaccgagcaacaggaatacctgcaagattctcaggatcaggctcaggtacagactttacattaacaatatcatcactagaaccagaagactttgccgtatactactgccaacaaagaagctcatggccaccagtttacacattcggacaaggaaccaaactagaaataaaacgaacagtagcagcaccaagcgtattcatattcccaccatcagacgaacaattaaaatcaggaacagcatcagtagtatgcttactaaataacttttacccaagagaagcaaaagtacaatggaaagtagataacgcactacaaagcggaaactcacaagaaagcgttacagaacaagactcaaaagactcaacatatagcctatcatcaacattaacactatcaaaagccgattacgaaaaacacaaagtatacgcctgtgaagtaacacaccaaggcttaagctcaccagtaaccaaatcattcaacagaggcgaatgc

SEQ ID NO: 46050 - RNA, 1332 nt, synthetic construct
  misc_feature 1..1332: note = derived and/or modified sequence opt6 from Demcizumab_HeavyChain1
  source 1..1332: mol_type = other RNA
caagtacaattagtacaatccggagcagaagtaaaaaaaccaggagcatctgtaaaaataagttgtaaagcatctggatactcattcacagcatattacatacactgggtcaaacaagcaccaggacaaggattagaatggataggatacatatcaagctacaacggagccactaattacaaccaaaaattcaaaggtagagtaactttcacaaccgacacatcaacctctacagcctatatggaattaagatctctacgatcagacgacacagcagtatattactgtgcaagagactacgactacgacgttggaatggactactggggacaaggaacattagtcacagtatcatcagcatcaaccaaaggaccatcagtatttccactagcaccctgctccagatcaacatctgaatcaacagcagctctcggatgcctagtaaaagactacttccctgaaccagtaacagtctcatggaattccggtgcactaacatcaggagtccacaccttcccagcagttctacaatcatcaggattatactcactttcatcagtagtaaccgtcccatcctcaaacttcggaacacaaacatatacttgcaacgtcgatcataaaccatcaaatactaaagttgataaaaccgtagaacgcaaatgttgcgtagaatgccctccatgccccgcacctccagtagcaggaccatcagtcttcctattcccacctaaaccaaaagacacactaatgatctcaagaaccccagaagtcacctgtgtagttgttgacgtatcacacgaagacccagaagtacaattcaactggtacgtagacggcgtagaagtacacaacgcaaaaacaaaaccaagagaagaacaattcaattctactttcagagtagtatcagtattaacagtagtacaccaagattggttaaacggtaaagaatacaaatgcaaagtctccaacaaaggcctaccagcgccaatagaaaaaactatatcaaaaactaaaggtcaaccaagagaaccacaagtatacacattaccaccatcaagagaagaaatgacaaaaaaccaagtctccttaacttgtttagtaaaaggattctacccctcagatatagcagtcgaatgggaatccaacggccaacctgaaaacaattacaaaaccacaccaccaatgttagattcagacggatctttcttcttatacagcaaactaacagtcgacaaatcaagatggcaacaaggaaatgtattctcttgctcagtaatgcacgaagcattacacaaccactacacacaaaaatctctatccttatctcccgga

SEQ ID NO: 46051 - RNA, 654 nt, synthetic construct
  misc_feature 1..654: note = derived and/or modified sequence opt6 from Demcizumab_LightChain1
  source 1..654: mol_type = other RNA
gatatagtaatgacacaatcacctgatagtttagcagtaagcctaggagaaagagcaacaataagctgtagagcaagtgaaagcgtagacaattacggaatatcattcatgaaatggttccaacaaaaaccaggacaaccaccaaaactattaatatatgcagcaagcaatcaaggatcaggagtaccagacagattctcaggatcaggatcaggaacagactttacattaacaataagctcattacaagcagaagacgtagcagtatactattgccaacaatcaaaagaagtaccatggacattcggaggaggaacaaaagtagaaataaaaagaacggtagcagcaccaagcgtattcatattcccaccatcagacgaacaattaaaatcaggaacagcatcagtagtatgcttactaaataacttttacccaagagaagccaaagttcaatggaaagtagataacgcactacaaagcggaaactcacaagaaagtgtaaccgaacaagacagtaaagactcaacatatagcttaagctcaacattaacattaagcaaagcagattacgaaaaacataaagtatacgcatgtgaagtaacacaccaaggactaagctcaccagtaaccaaaagctttaacagaggagaatgc

SEQ ID NO: 46052 - RNA, 1350 nt, synthetic construct
  misc_feature 1..1350: note = derived and/or modified sequence opt6 from Denintuzumab_mafodotin_HeavyChain1
  source 1..1350: mol_type = other RNA
caagttcaactacaagaatcaggacccggattagtaaaaccatcccaaacactatccttaacttgcactgtatccggaggatccataagtacatcaggaatgggagtaggatggataagacaacacccaggcaaaggactagaatggataggacacatatggtgggatgacgataaaagatacaatcctgcactaaaatcaagagtaacaatatcagttgacacaagcaaaaaccaattttctttaaaactatcatctgtaacagcagcagacacagcagtctattactgcgcaagaatggaattatggtcatactacttcgactactggggccaaggcactttagtcacagttagctcagcatcaaccaaaggaccatccgtattcccactcgcaccatcatccaaaagcacatctggaggaaccgccgcactaggatgcctagttaaagactactttccagaaccagtcactgtctcatggaatagtggagcactaacatctggagtacatacattccccgccgtactacaatcatcaggcctatactcattaagctcagtagtaacagtaccatcatcatccttaggaacacaaacatacatatgtaacgtcaatcacaaaccatcaaacacaaaagtagacaaaaaagtagaaccaaaatcatgcgataaaacacacacatgtcccccatgtccagcaccagaactcctaggaggaccatccgtattcctatttcctcctaaacccaaagatacattaatgatatccagaacaccagaagtcacatgcgtagtagttgacgtatcccatgaagacccagaagtaaaattcaactggtacgtagacggagtagaagtacacaatgccaaaacaaaaccaagagaagaacaatacaatagcacatatcgagtagtatcagtattaacagtattacatcaggactggctaaatggtaaagaatacaaatgtaaagtctcaaacaaagccctaccagccccaatagaaaaaaccataagcaaagcaaaaggacaaccaagagaacctcaagtatatacactaccaccttccagagatgaattaacaaaaaaccaagtcagtttaacatgtctcgtaaaaggattttacccctcagacatagccgtagaatgggaatcaaacggacaacccgaaaataactacaaaacaacaccaccagttctagattctgacggatcattctttctttactccaaactaacagtcgataaatcaagatggcaacaaggaaatgtattttcctgcagcgtaatgcatgaagcactacataatcactatacacaaaaatcattatccctatcaccaggtaaa

SEQ ID NO: 46053 - RNA, 639 nt, synthetic construct
  misc_feature 1..639: note = derived and/or modified sequence opt6 from Denintuzumab_mafodotin_LightChain1
  source 1..639: mol_type = other RNA
gaaatagtactaacacaatcaccagcaacattatcactatcaccaggagaaagagcaacactttcatgctcagcctcctcatcagtatcatacatgcactggtaccaacaaaaacccggacaagcaccacgactactaatatacgacacatcaaaattagcatcaggaataccagcaagattctcaggatcaggttcaggaacagacttcacactaacaatatcatcacttgaaccagaagacgtagcagtatactactgcttccaaggatcagtatacccattcacatttggacaaggaacaaaactagaaataaaaagaacagtagcagcaccatcagtattcatatttccaccctcagacgaacaactaaaatcaggtacagcatcagtagtatgcctactaaacaacttctacccaagagaagcaaaagttcaatggaaagtagacaacgcactacaatcaggaaactcacaagaatccgtaaccgaacaagactcaaaagactccacatactccctatcatcaacactaacactatcaaaagcagactacgaaaaacacaaagtatacgcatgcgaagtaacacatcaaggactatcatcaccagtaacaaaatcattcaaccgaggagaatgt

SEQ ID NO: 46054 - RNA, 1356 nt, synthetic construct
  misc_feature 1..1356: note = derived and/or modified sequence opt6 from Denosumab_HeavyChain
  source 1..1356: mol_type = other RNA
gaagtccaacttttagaatcaggtggcggactagtacaaccaggaggaagcctaagactatcttgtgcagcttcaggatttacattttcctcatacgctatgtcctgggtaagacaagcacccggaaaaggattagaatgggtatcaggaatcacaggttctggaggatcaacatactacgcagatagcgtaaaaggacgtttcacaatatccagagacaactcaaaaaacaccctatatctccaaatgaattccttaagagcagaagatacagccgtatattactgcgcaaaagacccaggcactacagtaataatgagttggtttgacccctggggacaagggacattagttaccgtatcatcagcatccacaaaaggtccctcagttttcccactagcaccatcatcaaaatcaacatcaggcggaacagcagcattaggatgcttagtaaaagactattttccagaaccagtaacagtatcatggaactcaggagcattaacatccggcgtacatacattccccgcagtattacaatcatctggtctttactcactctcatcagtagtaactgtaccatcatcctcattaggaacacaaacctacatatgtaatgtaaaccataaaccctcaaacactaaagtagacaaaaaagtagaacccaaatcttgtgataaaactcacacatgcccaccctgcccagcccccgaactattaggaggtccttcagtattcctcttcccaccaaaaccaaaagatacattaatgatatcacgaacaccagaagtaacctgcgtagtagtagacgtatcacacgaagatccagaagtcaaatttaactggtatgtagacggagtagaagtacacaatgctaaaaccaaaccaagagaagaacaatacaactctacatacagagttgtatcagtactaaccgtactccaccaagactggctaaacggaaaagaatacaaatgtaaagtatcaaacaaagcactaccagcaccaatagaaaaaaccatatcaaaagcaaaaggacaaccacgagaaccccaagtatataccctacctccatcacgagacgaactaaccaaaaatcaagtcagcctaacatgtctagttaaaggtttctatccctcagacatagctgtagaatgggaatccaatggccaaccagaaaacaactacaaaacaacaccaccagtcttagattcagacggctcattcttcttatattcaaaattaacagtagataaatctcgatggcaacaaggcaatgtattctcatgttctgttatgcacgaagcactacacaaccattatacacaaaaaagtctatcattatccccaggaaaa

SEQ ID NO: 46055 - RNA, 645 nt, synthetic construct
  misc_feature 1..645: note = derived and/or modified sequence opt6 from Denosumab_LightChain
  source 1..645: mol_type = other RNA
gaaatagtactaacacaatcaccaggtacattatcactatcaccaggagaaagagcaacactatcatgcagagcatcacaatccgtaagaggaagatacctagcctggtaccaacaaaaaccaggacaagcaccaagactactaatatacggagcatcatcacgagccacaggaataccagacagattttcaggatcaggatcaggaacagacttcacactaaccatatcaagactagaaccagaagacttcgcagtattctactgccaacaatacggatcaagcccaagaacattcggccaaggaacaaaagtagaaataaaaagaacagtagcagcaccatcagtattcatatttccaccatcagacgaacaactaaaatcaggaacagcatcagtagtatgcttactaaacaacttctacccaagagaagcaaaagtacaatggaaagtagacaacgcactacaatcaggaaactcacaagaatcagtaaccgaacaagactcaaaagactcaacatactcactatcctccacattaaccttatcaaaagcagattacgaaaaacacaaagtatacgcatgcgaagtaacacaccaaggcttaagctcacccgtaacaaaatcattcaacagaggagaatgc

SEQ ID NO: 46056 - RNA, 1338 nt, synthetic construct
  misc_feature 1..1338: note = derived and/or modified sequence opt6 from Depatuxizumab_HeavyChain1
  source 1..1338: mol_type = other RNA
caagtacaactacaagaatcaggaccaggactcgttaaaccaagccaaacattatcactaacatgcacagttagtggctattcaataagttctgatttcgcatggaattggatacgtcaaccacccggaaaaggactagaatggatgggatacatatcttactcaggaaatacaagataccaaccaagcctaaaatctagaataaccatatcaagagacacctcaaaaaatcaattcttcctaaaactaaactccgtaacagcagccgacacagccacttactattgcgttacagcaggaagaggattcccatattggggacaaggaacattagtaacggtatcctctgcatctacaaaaggaccatccgtcttccctttagcaccatcttccaaatcaacatcaggaggaacagccgccctcggttgcctagtaaaagactacttcccagaaccagtcacagtatcctggaattcaggagcactaaccagtggagtccatacattccccgctgtactacaaagctcaggactatattccttatcatccgtagtaactgtaccatcatcctcactaggaacacaaacatatatatgtaacgtaaatcacaagccctcaaacaccaaagttgacaaaaaagtagaacccaaatcttgcgataaaacacacacatgccccccatgtcccgcaccagaactactaggaggaccatcagtatttctctttccaccaaaacctaaagacacactaatgatctcaagaacacctgaagtaacatgcgtagttgtcgatgtctcacacgaagatccagaagtaaaattcaactggtatgtagatggagtcgaagtacataacgctaaaacaaaaccaagagaagaacaatacaactcaacctaccgagtagtctcagtactaactgtattacatcaagactggttaaacggcaaagaatacaaatgcaaagtatcaaataaagcattaccagctccaatagaaaaaacaatatcaaaagcaaaaggacaacctagagaaccccaagtatacaccttaccaccatcaagagacgaattaactaaaaatcaagtaagtttaacatgcctagtaaaaggattctacccaagcgatatagcagtagaatgggaatccaacggacaaccagaaaacaattacaaaacaacaccccctgtactagacagcgatggatcgtttttcttatattcaaaactaactgtagataaatcaagatggcaacaaggaaacgtattctcctgttcagtaatgcatgaagcacttcacaatcattacacacaaaaatcactatctttatcaccaggaaaa

SEQ ID NO: 46057 - RNA, 642 nt, synthetic construct
  misc_feature 1..642: note = derived and/or modified sequence opt6 from Depatuxizumab_LightChain1
  source 1..642: mol_type = other RNA
gatatacaaatgacacaatcaccctcatccatgtcagtaagcgtaggagaccgagtaacaataacatgccactcaagtcaagacataaactcaaacataggatggctacaacaaaaaccaggaaaatcattcaaaggactaatataccacggaacaaacctagacgacggagtcccatcaagattctcaggatctggatcaggaacagactacacactaacaatatcatcactacaaccagaagacttcgcaacatactactgcgtacaatacgcacaattcccatggacattcggcggaggaacaaaactagaaataaaaagaacagtagcagcaccatcagtcttcatattcccaccatctgacgaacaactaaaatcaggcacagcttcagtagtctgcctattaaacaacttctatccaagagaagcaaaagtacaatggaaagtagataacgcactacaatccggaaactcacaagaatcagtaacagaacaagactcaaaagactcaacatactcactatcatcaacactaacattaagcaaagcagactacgaaaaacataaagtatacgcatgtgaagtaacacatcaaggactatcatcaccagtaacaaaatcatttaatagaggagaatgc

SEQ ID NO: 46058 - RNA, 1338 nt, synthetic construct
  misc_feature 1..1338: note = derived and/or modified sequence opt6 from Depatuxizumab_mafodotin_HeavyChain1
  source 1..1338: mol_type = other RNA
caagtccaacttcaagaatcaggaccaggattagtaaaaccatcacaaacattatcattaacttgcaccgtatccggatattcaatatcatcagacttcgcatggaattggataagacaaccacccggaaaaggactagaatggatgggatacatatcttattctggaaatacacgataccaaccatcattaaaatcaagaataacaatatcaagagacacgtctaaaaaccaatttttcctcaaactaaattccgtcacagcagctgatacagcaacatactattgcgtaacagcaggaagaggattcccctactggggacaaggaacactagtaaccgtaagttcagcatcaacaaaaggacctagcgtattcccattagcaccatcatctaaatctacatcaggcggaacagccgcactaggctgcctcgttaaagactacttcccagaacccgtcacagtaagctggaactccggcgccttaacatcaggtgtccacacttttcccgcagtcctgcaaagctctggactatactcattatcctcagtagtaaccgtaccaagttcctcactaggaacacaaacatacatctgcaacgtaaaccacaaaccttccaacacaaaagttgacaaaaaagtagaaccaaaatcctgcgataaaacacacacatgcccaccatgcccagcacctgaactattaggaggaccttcagtattcctattccctccaaaacccaaagacactcttatgatatcacgaacaccagaagttacatgtgttgtagtcgacgtctcacacgaagaccccgaagtaaaattcaactggtacgttgacggagtagaagtccacaacgccaaaacaaaaccaagagaagaacaatataattccacatacagagtagttagtgtcctcacagtcttacaccaagactggctaaacggaaaagaatacaaatgcaaagtatcaaacaaagccttaccagccccaatcgaaaaaacaatatccaaagccaaaggacaaccaagagaacctcaagtatacacactacccccatctagagacgaactaacaaaaaaccaagtatcattaacatgtttagtaaaaggattctacccttcagacattgcagtagaatgggaaagcaacggacaaccagaaaataactacaaaacaactccaccagtattagactccgatggatcattcttcctatattcaaaattaacagtagacaaatcaagatggcaacaaggaaatgtattttcatgcagcgtaatgcacgaagcactacacaatcactatacacaaaaatcattatcactatcacctggaaaa

SEQ ID NO: 46059 - RNA, 642 nt, synthetic construct
  misc_feature 1..642: note = derived and/or modified sequence opt6 from Depatuxizumab_mafodotin_LightChain1
  source 1..642: mol_type = other RNA
gacatacaaatgacacaatcaccatcatcaatgtcagtatccgtaggagacagagtaacaataacatgccactcatcccaagacataaactcaaacataggatggctacaacaaaaaccaggaaaatcatttaaaggactaatataccacggcacaaacctagacgacggagtcccatcacgattctcaggatcaggctcaggaacagattacacactaacaatatcatcactacaaccagaagacttcgcaacatactactgcgtacaatacgcacaatttccatggacattcggaggcggaacaaaactagaaataaaacgaacagtagcagcaccatccgtattcatattcccaccatcagacgaacaattaaaatcaggaacagcatcagtagtatgcttactaaataacttctacccacgagaagcaaaagtacaatggaaagtagacaacgcactacaatcaggaaactcacaagaatcagtaacagaacaagactccaaagactccacatacagcttatcctcaacactaacactatcaaaagcagactacgaaaaacacaaagtatacgcatgcgaagtcacacaccaaggcctatcatcaccagtaacaaaatcattcaacagaggagaatgc

SEQ ID NO: 46060 - RNA, 1329 nt, synthetic construct
  misc_feature 1..1329: note = derived and/or modified sequence opt6 from Dinutuximab_beta_HeavyChain1
  source 1..1329: mol_type = other RNA
gaagtccaactactacaatccggaccagaattagaaaaaccaggagcctcagtaatgataagttgtaaagcaagcggatcatctttcacaggttataacatgaactgggtaagacaaaacataggaaaatcactagaatggataggagcaatcgacccatactacggtggaacaagctataaccaaaaattcaaaggtagagcaacactaactgtcgataaatcatcgtcaactgcctacatgcacttaaaatccttaacctcagaagactcagcagtatactactgtgtctcaggaatggaatactggggccaaggaacaagtgtaacagtctcttcagcaagcactaaaggaccatcagtatttcctctagcacccagttcaaaatcaacttcaggcggaacagcagctctcggttgcttagtgaaagactactttccagaacctgttacagtatcctggaattcaggagcactaacatctggagtacacacattcccagctgtcttacaatcttcaggtttatattcactatcatcagtagtcacagtaccttcatcctctctaggtacccaaacatacatctgcaacgtaaatcacaaaccttccaatacaaaagttgacaaacgagttgaacctaaatcatgtgacaaaacccatacatgcccaccatgccctgccccagaattactaggtggtccatcagttttcctattcccaccaaaaccaaaagacacactaatgatctcaagaactccagaagtaacatgcgtagtcgtcgacgtatcacatgaagatccagaagtaaaattcaactggtacgtagatggagtagaagtacacaacgcaaaaactaaaccaagagaagaacagtataactcaacctaccgagtagtatcagtattaacagtactacaccaagactggctcaacggaaaagaatacaaatgcaaagtatccaacaaagcattacccgcaccaatagaaaaaacaatatcaaaagcaaaaggacaacccagagaacctcaagtatacacattaccaccttccagagaagaaatgacaaaaaaccaagtctcactaacttgcctcgtaaaaggattctacccttcagatatagcagttgaatgggaatcaaatggacaaccagaaaataactacaaaacaacaccacctgtactagatagcgatggatccttctttttatattcaaaactaacagtcgacaaatcaagatggcaacaaggcaacgtattctcatgctcagtaatgcacgaagcattacataaccattatacacaaaaatcactaagcctatcacccggaaaa

SEQ ID NO: 46061 - RNA, 660 nt, synthetic construct
  misc_feature 1..660: note = derived and/or modified sequence opt6 from Dinutuximab_beta_LightChain1
  source 1..660: mol_type = other RNA
gaaatagtaatgacacaatcaccagcaaccttatcagtaagtccaggtgaaagagcaacattatcctgcagatcatcacaaagcttagtacatcgcaatggcaatacatatctacattggtatctacaaaaaccaggacaatcaccaaaattactcatacacaaagtatcaaacagattctcaggagtaccagatagattttcaggaagcggaagcggaacagacttcacactaaaaatatcaagagtagaagcagaagatctcggagtatatttctgtagccaatcaacacacgtaccaccactaacattcggagcaggaacaaaactagaactcaaacgaacagtagcagcaccatcagtattcatattcccaccatctgacgaacaactaaaatcaggaacagcatcagtagtatgcctactaaataacttttacccacgagaagcaaaagtacaatggaaagtagataacgcactacaaagcggaaactcacaagaatcagtaacagaacaagacagcaaagactcaacatattcattatcatcaacattaacattatcaaaagcagattacgaaaaacataaagtctacgcatgcgaagtaacacaccaaggattatcatcaccagtaacaaaatcatttaacaggggagaatgt

SEQ ID NO: 46062 - RNA, 1329 nt, synthetic construct
  misc_feature 1..1329: note = derived and/or modified sequence opt6 from Dinutuximab_HeavyChain1
  source 1..1329: mol_type = other RNA
gaagtacaactactacaatcaggaccagaactagaaaaaccaggcgcttcagtaatgatatcatgtaaagcttcaggatcaagctttacaggatacaacatgaactgggtaagacaaaatataggtaaatcattagaatggataggagcaatagatccatactacggaggcacatcatacaatcaaaaattcaaaggacgagcaacactaacagtagataaatctagttcaacagcatatatgcacttaaaatcattaacatctgaagatagcgcagtttactactgcgtatctggaatggaatactggggccaaggaacaagcgtaactgtatcatcagcttcaacaaaaggaccatcagtattcccattagcaccatcatcaaaatcaacatcaggaggaacagccgctctcggatgcctagttaaagactactttccagaaccagttacagtatcatggaattcaggcgctttaacttcaggagtacacacattcccagcagtcctacaatcatctggactatacagcttatcatcagtagtaacagtcccgtcttcatcactaggaacacaaacctatatatgtaacgtaaaccacaaaccttcaaacacaaaagtagacaaacgagtagaaccaaaaagctgcgacaaaacacatacatgtcctccatgccccgcacctgaactattaggaggaccatcagttttcttatttccaccaaaaccaaaagacaccttaatgatatcaagaacaccagaagtaacatgcgttgttgtagatgtctctcacgaagaccccgaagttaaatttaactggtacgtagacggagtagaagtccataacgccaaaacaaaacccagagaagaacagtacaactcaacatatcgagtagtatcagtattaacagtactacatcaagattggctaaacggaaaagaatacaaatgcaaagtatcaaacaaagctttaccagcaccaatagaaaaaacaatatcaaaagccaaaggacaaccaagagaaccacaagtctacacactaccaccatcacgagaagaaatgacgaaaaaccaagtatcactaacatgcctagtaaaaggattttacccatcagacatagcagtcgaatgggaatcaaacggacaaccagaaaacaactacaaaacaacaccaccagtactagattcagatggatcattcttcctatactccaaattaactgtagacaaatcaagatggcaacaaggtaacgtattctcctgctccgtaatgcacgaagccctacacaaccactatacccaaaaatctttatctttatcaccaggaaaa

SEQ ID NO: 46063 - RNA, 660 nt, synthetic construct
  misc_feature 1..660: note = derived and/or modified sequence opt6 from Dinutuximab_LightChain1
  source 1..660: mol_type = other RNA
gaaatagtaatgacacaatcaccagcaacattaagtgtaagcccaggagaaagagcaacactaagctgccgctcatcacaaagcctagtacatagaaatggaaatacatatctacattggtatctccaaaaaccaggacaatcaccaaaactattaatacacaaagtatctaacagattctcaggagtaccagatagatttagcggatcaggatcaggaactgatttcacactaaaaatatcacgagtagaagctgaagatctaggagtatatttctgtagccaatcaacacacgtaccaccactaacattcggagcaggaaccaaactagaactaaaacgcacagtagcagcaccatcagtattcatattcccaccatcagacgaacaattaaaatcaggaacagcatccgtagtatgcttactaaataacttttacccacgagaagcaaaagtacaatggaaagtcgataacgcactacaaagcggaaactcacaagaatcagtaacagaacaagattcaaaagactcaacatattcactatcatcaacattaacactaagcaaagcagattacgaaaaacataaagtatacgcatgcgaagtaacacaccaaggattatcatcaccagtaacaaaaagctttaacagaggagaatgc

SEQ ID NO: 46064 - RNA, 660 nt, synthetic construct
  misc_feature 1..660: note = derived and/or modified sequence opt6 from Dinutuximab_LightChain
  source 1..660: mol_type = other RNA
gaaatagtaatgacacaatcaccagcaacattatcagtatcaccaggagaaagagcaacattaagctgtagatcatcacaatcattagtacatagaaacggaaacacatatctacactggtacctccaaaaaccaggacaatcaccaaaattactaatacacaaagtatcaaacagattctcaggcgtaccagacagattctcaggatcaggctcaggaaccgacttcacactcaaaatatcaagagtagaagcagaagatctaggagtatacttctgtagccaatcaacacacgtaccaccactaacattcggagcaggaacaaaactcgaactaaaaagaacagtcgcagcaccatccgtattcatattcccaccatcagacgaacaactaaaatcaggaacagcatcagtagtatgtctactaaataacttctacccacgagaagcaaaagtacaatggaaagtagacaacgcattacaatccggaaactctcaagaaagcgtaactgaacaagactcaaaagactcaacatattcattatcctcaaccttaacattaagtaaagcagattacgaaaaacataaagtatacgcatgcgaagtaacacaccaaggattaagttcacccgtaacaaaaagtttcaacagaggagaatgc

SEQ ID NO: 46065 - RNA, 1350 nt, synthetic construct
  misc_feature 1..1350: note = derived and/or modified sequence opt6 from Diridavumab_HeavyChain1
  source 1..1350: mol_type = other RNA
gaagttcaactcgtagaatccggagccgaagtcaaaaaaccagggagttccgtcaaagtttcatgtaaagcatcaggaggaccattcagatcctatgcaatatcatgggtaagacaagcaccaggacaaggaccagaatggatgggaggaataatacctatttttggaacaacaaaatacgccccaaaattccaaggaagagtcacaattacagcagatgattttgctggaacagtatacatggaactatcttcactaagatcagaagacacagcaatgtattactgtgcaaaacacatgggataccaagtacgcgaaaccatggatgtatggggaaaaggaactacagtcacagttagcagcgcatcaactaaaggcccatccgttttcccactagcaccatcatctaaatccacctcaggaggaacagcagctcttggatgtctagtaaaagattattttccagaacctgtaacagtatcatggaattcaggagcgctaacatcaggtgtccatacattcccagctgtattacaatcctcaggactatactcattatcatcagtagtaacagtaccctcatcatcactcggcactcaaacgtacatatgcaatgtaaaccacaaaccctcaaatacaaaagtagacaaacgtgttgaaccaaaatcatgcgataaaacacatacatgtccaccctgtccagcccctgaattattaggaggaccatcagttttcctattcccaccaaaacctaaagatacactaatgattagtcgaacacccgaagtaacatgtgtagtagtagatgtttcacatgaggatccagaagttaaatttaactggtatgttgacggagtagaagtacataatgccaaaacaaaaccaagagaagaacaatataactcaacatatagagtcgtatctgtactaacagtccttcatcaagattggttaaatggaaaagaatataaatgcaaagtttcaaacaaagctttaccagcacccatagaaaaaacaatttccaaagcaaaaggccaaccaagagaaccacaagtatatacattacccccatcaagggaagaaatgacaaaaaatcaagtctctttaacatgtttagttaaaggattttatccatcagacatagcagtagaatgggaatctaatggtcaacctgaaaacaactataaaactaccccaccagtattagattctgatggttcttttttcctctatagtaaactaaccgtagataaatcaagatggcaacaaggaaatgtattctcatgctctgtaatgcatgaagctctacataatcactacacacaaaaatcattaagtctatcaccagga

SEQ ID NO: 46066 - RNA, 651 nt, synthetic construct
  misc_feature 1..651: note = derived and/or modified sequence opt6 from Diridavumab_LightChain1
  source 1..651: mol_type = other RNA
caatcagtactaacacaaccaccaagcgtatcagcagcaccaggacaaaaagtaacaatatcatgctcaggatcatcatcaaacatcggaaacgactacgtatcatggtaccaacaactcccaggaacagcaccaaaattactaatatacgacaacaacaaaagaccatcaggaataccagacagattctcaggatcaaaatccggaacctcagcaacactaggaataacaggactacaaacaggcgacgaagcaaattactactgcgcaacatgggacagacgaccaacagcatacgtagtattcggaggaggaacaaaactaacagtactaggacaaccaaaagcagcaccatcagtcacactattcccaccatcatcagaagaactacaagcaaacaaagcaacattagtatgcctaatatcagacttttacccaggcgcagtaacagttgcatggaaagccgactcatcaccagtaaaagcaggagtagaaacaacaacaccatcaaaacaatcaaacaacaaatacgcagcatcatcctacctatcactaacaccagaacaatggaaatcacacagatcctactcatgccaagtaacacacgaaggatcaacagtagaaaaaacagtagcaccaacagaatgctca

SEQ ID NO: 46067 - RNA, 1338 nt, synthetic construct
  misc_feature 1..1338: note = derived and/or modified sequence opt6 from Domagrozumab_HeavyChain1
  source 1..1338: mol_type = other RNA
gaagttcaactcctagaatcaggcggaggtctagtacaaccaggaggatccttaagattaagttgcgcagcctccggattcacattctcttcttacgcaatgtcatgggtacgacaagctcctggaaaaggattagaatgggtatcaactatttcatcaggaggctcctacacgtcttaccccgactctgtaaaaggtcgatttacaatatcacgagataattcaaaaaacacactatatctacaaatgaactccctaagagcagaagacacagcagtatactactgcgcaaaacaagactacgcaatgaactactggggacaaggaacattagtaacagtatcctcagcatctacaaaaggaccatcagtatttccattagcaccatcatcaaaatccacaagtggtggaaccgctgcacttggatgccttgtaaaagactatttcccagaaccagtcaccgtatcatggaactcaggcgctttaacttcaggagtacacaccttcccagctgtattacaaagttccggactctactcactttcatcagtagtaacagtaccttcttcatcactaggcactcaaacttacatctgtaacgtcaatcacaaaccatcaaacacaaaagtagacaaaaaagtagaaccaaaatcatgcgataaaacccatacatgccccccttgcccagctccagaagcagcaggcgcaccatctgttttcttattcccccccaaaccaaaagacacattaatgatatcaagaaccccagaagtaacatgcgtagtagtagacgtatcccacgaagacccagaagtcaaatttaattggtacgtcgatggagtagaagtacataatgcaaaaactaaaccacgcgaagaacaatataactcaacctacagagtagtatcagtactaactgttctacaccaagactggttaaacggaaaggaatataaatgtaaagtatcaaacaaagcattacccgcacctatcgaaaaaacaatatctaaagcaaaaggacaaccacgagaaccacaagtctatacactcccaccatctagagaagaaatgactaaaaaccaagtctctttaacatgtttagtaaaaggattctatccatcagatatcgcagtagaatgggaatccaacggacaacctgaaaataactataaaaccacaccaccagttctagatagtgacggatcattctttttatactccaaattaacagttgacaaatcaagatggcaacaaggaaacgtcttctcctgttctgtaatgcacgaagcacttcacaaccactatacacaaaaatcactatccctttcaccaggaaaa

SEQ ID NO: 46068 - RNA, 1335 nt, synthetic construct
  misc_feature 1..1335: note = derived and/or modified sequence opt6 from Domagrozumab_HeavyChain
  source 1..1335: mol_type = other RNA
gaagtacaactactagaatctggaggaggtcttgtacaacccggaggatctcttcgtttatcttgtgcagcatcaggattcacattcagctcatatgccatgtcatgggtacgtcaagcaccaggtaaaggactagaatgggtatctaccatctcatctggaggttcatacacatcatatccagactctgtaaaaggaagattcacaatctcaagagacaatagcaaaaacaccttatacctacaaatgaattcactaagagcagaagacacagccgtatactactgcgccaaacaagattacgcaatgaactactggggacaaggaactttagtaacagtatcttcagcaagcacaaaaggaccttcagtattccccttagcaccatcatcaaagtcaacatcaggcggaacagctgcactaggatgtcttgtaaaagactactttcccgaaccagttacagtatcctggaatagtggagccctaacatctggagtacataccttccccgcagtacttcaatcaagtggactctactcactatcatcagtagttacagtaccatcatcatcattaggaactcaaacatatatatgcaatgtaaaccataaaccctccaacacaaaagtcgacaaaaaagtagaaccaaaaagttgcgataaaacacatacatgccccccatgccctgctcctgaagcagctggagccccatcagtcttcttattccccccaaaaccaaaagacacactaatgatctccagaaccccagaagtaacctgcgtagtagtagacgtctcacacgaagacccagaagtaaaattcaattggtatgtagacggcgtagaagtacacaatgcaaaaactaaaccaagagaagaacaatacaattcaacatatagagtagtctcagtcctaacagtattacaccaagactggctaaacggaaaagaatacaaatgcaaagtatcaaataaagccctaccagcaccaatagaaaaaacaatatcaaaagcaaaaggccaaccacgagaacctcaagtatacaccctaccgccatcaagagaagaaatgacaaaaaatcaagtatcactaacatgcttagtcaaaggattttacccatcagatattgcagtagaatgggaatccaatggacaaccagaaaacaactataaaactacacccccagtacttgattcagatggatcattctttctctactcaaaattaacagtagataaatcaagatggcaacaaggaaatgtattctcctgttctgtaatgcacgaagctttacacaaccactacacacaaaaatcactttccctatcacctgga

SEQ ID NO: 46069 - RNA, 642 nt, synthetic construct
  misc_feature 1..642: note = derived and/or modified sequence opt6 from Domagrozumab_LightChain1
  source 1..642: mol_type = other RNA
gacatacaaatgacacaatcaccatcctcactatcagcatccgtaggcgatagagtaacaataacatgcaaagcatcccaagacgtatcaacagcagtagcatggtaccaacaaaaacccggaaaagcaccaaaactactaatatactcagcatcataccgatacacaggagtaccatcaagattttcaggatcaggatcaggcacagacttcacactaacaatatcatcactacaaccagaagacttcgcaacatactattgtcaacaacactactcaacaccatggacattcggaggaggaacaaaagtagaaataaaacgaacagtagcagcaccatccgtattcatattcccaccatcagacgaacaattaaaatctggaacagcctcagtcgtatgcctactaaacaacttctacccaagagaagcaaaagtacaatggaaagtagacaacgcactacaatcaggaaactcacaagaatcagtaactgaacaagactcaaaagactcaacatacagcctatcatccacactaacactatcaaaagcagactacgaaaaacacaaagtatacgcatgcgaagtaacacaccaaggattatcatcaccagtaacaaaatcattcaacagaggcgaatgc

SEQ ID NO: 46070 - RNA, 1335 nt, synthetic construct
  misc_feature 1..1335: note = derived and/or modified sequence opt6 from Drozituab_HeavyChain1
  source 1..1335: mol_type = other RNA
gaggtacaactagtacaatcaggaggaggagtagaaagaccaggaggttcactaagattatcctgcgcagcatcaggatttacatttgacgattatgcaagttgggtaagacaagcccccggaaaaggactagaatgggtcagtggcatcaattggcaagggggatccactggttatgccgatagtgtaaaaggacgagtgacaataagcagagacaacgctaaaaactcactatatcttcaaaactcactaagagcagaagacacagcagtatactactgcgcaaaaatacttggagctggaagaggttggtattttgattactggggaaaaggtactaccgtcacagtatcatcagcttcaacaaaaggtccatcagtatttccattagcaccatcttcaaaatctacatcaggaggaaccgcagcactaggatgcctagtaaaagactatttcccagaaccagtaacagtatcatggaactcaggagcattaacatcaggagtccacacttttccggcagttttacaaagctcaggattatactcactatcatcagtagtaacagtaccaagcagttcactaggaacacaaacatacatatgcaatgtaaatcacaaaccatcaaatactaaagtagataaaaaagtagaaccaaaaagctgcgataaaacacatacatgcccaccatgtccagcaccagaactacttggaggaccctccgtatttttatttccaccaaagccaaaagatacattaatcagtagaacaccagaagtaacatgcgtagtagtagacgtatcacatgaagatcccgaagtaaaattcaactggtacgtagatggagtagaagtacataatgccaaaaccaaaccaagagaagaacaatataactcaacctatcgagttgtttcagtactaacagttctacatcaagactggctaaatggaaaagaatataaatgtaaagtatcaaacaaagcattaccagcaccaatagaaaaaacaataagtaaagctaaaggacaacccagagaacctcaagtatacaccctacctccttcaagagaagaaacaaaaaatcaagtatccctaacatgcttagtaaaaggtttctatccatccgacatagcagtagaatgggaaagtaacggacaaccggaaaacaattacaaaacaaccccaccagtactagatagcgatggatcatttttcctatatagtaaactaacagtcgataaatcacgatggcaacaaggaaatgtattttcatgttcagtacacgaagcattacacaatcactatacacaaaaaagtttaagtttatcaccagga

SEQ ID NO: 46071 - RNA, 639 nt, synthetic construct
  misc_feature 1..639: note = derived and/or modified sequence opt6 from Drozituab_LightChain1
  source 1..639: mol_type = other RNA
tcagaactaacacaagacccagcagtctcagtagcactaggacaaacagtaagaataacatgctcaggtgactcactaagatcatactacgcatcatggtaccaacaaaaaccaggacaagcaccagtcctagtaatatacggagcaaacaacagaccatcaggaataccagaccgattctcaggatcatcatcaggaaatacagcatcactaacaataacaggagcacaagcagaagacgaagcagactactactgcaactcagcagactcctcaggcaaccacgtcgtattcggaggaggaaccaaacttacagtactaggacaaccaaaagcagcaccatcagtaacattattcccaccatcatcagaagaactacaagcaaacaaagcaacattagtatgcctaatatcagatttctacccaggagcagtaacagtagcatggaaagcagactcatcaccagtaaaagccggagtagaaacaacaacaccatccaaacaatcaaacaacaaatatgcagcctcatcatacctatcactaacaccagaacaatggaaatcacacaaatcatactcatgccaagtaacacacgaaggctcaacagtagaaaaaacagtagcaccaacagaatgctca

SEQ ID NO: 46072 - RNA, 1353 nt, synthetic construct
  misc_feature 1..1353: note = derived and/or modified sequence opt6 from Drozitumab_HeavyChain1
  source 1..1353: mol_type = other RNA
gaagtacaacttgtacaatcaggaggaggagtagaaagaccaggaggaagcttaagattatcctgcgccgcatcaggattcacattcgatgactacgcaatgtcatgggtaagacaagcaccaggaaaaggtctagaatgggtttccggaataaactggcaaggaggatcaacaggatacgccgactcagtaaaaggaagagtaacaatatcaagagataatgcaaaaaactcactatatttacaaatgaattcactaagagcagaagatacagcagtatattattgcgcaaaaatactaggcgctggaagaggatggtactttgattattggggaaaaggcacaactgtaactgtatcttcagcaagcacaaaaggaccatcagtattcccattagcaccaagctcaaaaagtacatcaggaggaacagcagccttaggctgcttagtaaaagactacttccccgaacctgttacagtgtcatggaacagtggagcactaacatcaggagtacatacattcccagcagttttacaatcatcaggactctattcattatcaagcgtcgtaacagtccccagttcatcactaggaacacaaacctacatatgcaacgtaaaccataaacctagcaacacaaaagtagacaaaaaagtagaaccgaaatcatgcgataaaacacatacgtgtcctccatgcccagcaccagaactactaggaggaccatcagttttcttatttccacccaaaccaaaagacacacttatgatatcaagaacacctgaagtaacttgcgtagtagtagatgtatcacatgaagaccctgaagtaaaattcaattggtatgtagacggagtcgaagtacacaatgccaaaaccaaacctagagaagaacaatataactcaacctacagagttgttagtgttttaactgtactacaccaagactggctaaacggaaaagaatataaatgcaaagtatctaacaaagccctaccagcaccaatagaaaaaacaataagcaaagcaaaaggacaaccaagagaacctcaagtttataccttaccaccatcaagagaagaaatgacaaaaaatcaagtatcattaacatgtctagtaaaaggattctatccatccgacatagcagtagaatgggaatcaaatggccaaccagaaaacaactacaaaacaacaccacccgtattagacagtgatggatcatttttcctatattcaaaactaaccgtagacaaaagtcgatggcaacaaggaaacgtattttcatgttcagtaatgcacgaagcactacataaccactatacacaaaaatcactaagcctctctcccggaaaa

SEQ ID NO: 46073 - RNA, 639 nt, synthetic construct
  misc_feature 1..639: note = derived and/or modified sequence opt6 from Drozitumab_LightChain1
  source 1..639: mol_type = other RNA
tcagaactaacacaagacccagcagtatcagtagcactaggacaaacagtaagaataacatgctcaggagatagcctaagatcatattacgcatcatggtaccaacaaaaaccaggacaagcaccagtactagtaatatacggagcaaacaaccgcccatcaggaataccagacagattcagcggctcatcatcaggaaacacagcatcactaacaataactggagcacaagcagaagacgaagcagactactactgcaactccgcagactcctctggaaaccacgtcgtattcggaggaggaacaaaattaacagtactaggacaacccaaagcagccccatcagtaacactattcccaccatcatcagaagaactacaagccaacaaagcaacattagtatgtctaatatcagacttctacccaggagcagtaacagtagcatggaaagcagactcatcacctgtaaaagctggagtagaaacaacaacaccatcaaaacaatcaaacaacaaatacgcagcatcatcatacttatcattaacaccagaacaatggaaatcacacaaatcatactcatgccaagtaacacacgaaggctcaacagtagaaaaaacagtagcaccaacagaatgcagc

SEQ ID NO: 46074 - RNA, 1353 nt, synthetic construct
  misc_feature 1..1353: note = derived and/or modified sequence opt6 from Duligotumab_HeavyChain1
  source 1..1353: mol_type = other RNA
gaagtacaattagttgaaagtggaggaggcctagtacaaccaggaggatcactaagactaagttgcgcagcatcaggttttacactatcaggagattggatacactgggttagacaagcacccggaaaaggactagaatgggtaggcgaaatatcagcagcaggaggatacactgactatgcagattcagtaaaaggacgcttcactataagtgcagatacatctaaaaacacagcatacttacaaatgaactcattaagagcagaagacacagccgtttactattgtgcaagagaaagtcgagtatcttttgaagcagcaatggattattggggacagggaacactagtaaccgtctcatcagcatctacaaaaggacctagtgtatttccactcgccccatcatcaaaatcaacgtcaggcggaacagcagcactaggatgcctagttaaagattacttcccagaacctgtaaccgtatcgtggaactcaggtgcccttacatcaggagtacatacatttcctgctgtactccaatcatcaggactttattcattaagttccgtagtaactgttccatcatcatcattaggaacccaaacatatatatgcaatgtaaaccataaaccaagcaatactaaagtcgataaaaaagtagaaccaaaaagttgtgacaaaacacacacatgtccaccatgtccagctccagaacttcttggaggtccaagtgtatttttatttccacccaaaccaaaagacactctaatgatatcaagaacaccagaggttacatgtgtagtcgtagacgtatcacacgaagacccagaagtaaaattcaattggtatgtagacggcgtagaagtccacaacgcaaaaacaaaaccaagagaagaacaatataactcaacatacagagtcgtatcggttctaacagtattacatcaagactggttaaacggaaaagaatataaatgcaaagtatcaaacaaagctttaccagcgccaatagaaaaaacaatatcaaaagcaaaaggacaacccagagaaccacaagtatacacattaccaccatcacgagaagaaatgacaaaaaaccaagtatcactcacatgtttagtaaaaggcttctacccatccgatatcgcagtagaatgggaatctaacggacaaccagaaaacaattataaaacaacaccaccagtattagattcagacggaagtttttttttatatagtaaactaacagtagacaaatcaagatggcaacaaggaaatgtattttcatgttcagttatgcacgaagcactacataatcattacacacaaaaatctttatcattaagtcccggaaaa

SEQ ID NO: 46075 - RNA, 642 nt, synthetic construct
  misc_feature 1..642: note = derived and/or modified sequence opt6 from Duligotumab_LightChain1
  source 1..642: mol_type = other RNA
gacatacaaatgacacaatcaccatcatcactatcagcatcagtaggagacagagtaacaataacatgcagagcatcacaaaacatagcaacagacgtagcatggtaccaacaaaaaccaggaaaagcaccaaaattattaatatactccgcatcatttctatactcaggagtaccatcaagattctcaggatccggatcaggaacagatttcacactaaccataagctcattacaaccagaagacttcgccacatactactgccaacaatcagaaccagaaccatatacatttggacaaggcacaaaagtagaaataaaaagaacagtagcagcaccatcagtattcatattcccaccatcagacgaacaattaaaatcaggaacagcatcagtcgtatgcctactaaataacttctacccaagagaagcaaaagtacaatggaaagtagacaacgcactacaatcaggaaactcacaagaatcagtaacagaacaagactcaaaagactcaacatattcactatcatcaaccttaaccctatcaaaagccgactacgaaaaacacaaagtatatgcatgcgaagtaacacaccaaggattatcctcacccgtaaccaaatcattcaacagaggcgaatgc

SEQ ID NO: 46076 - RNA, 1353 nt, synthetic construct
  misc_feature 1..1353: note = derived and/or modified sequence opt6 from Duligotuzumab_HeavyChain1
  source 1..1353: mol_type = other RNA
gaagtccaactcgtcgaatcaggaggaggactagtacaaccaggaggatctttaagattatcatgcgcggcatcaggattcacattatcaggagattggatacactgggtacgacaagcacccggaaaaggactagaatgggtaggagaaatttctgcagcaggaggatacacagattacgcagacagtgtaaaaggacgtttcacaatatccgcagacacttcaaaaaatacagcatacttacaaatgaattcattaagagctgaagatacagcagtatattactgcgcacgagaatcaagagtatcattcgaagctgccatggactattggggacaaggaacactagtcacagtatcatcagcctccacaaaaggcccttctgtatttccactagcaccatcttcaaagtcaacatcaggaggaacagcagccttaggatgcttagtaaaagattacttccccgaacccgtaacagtaagttggaactccggagcactaacatcaggcgttcatacattcccagcagttcttcaatcttccggcctatattcactatcatcagtagtaacagtaccatcatcatcactaggaacacaaacatacatatgcaatgtaaaccataaaccctcaaacacaaaagttgataaaaaagtagaacctaaatcatgcgacaaaacacatacctgtccaccatgcccagcaccagaactactaggaggacctagtgtattccttttcccaccaaaaccaaaagacacactaatgatatccagaacaccagaagtaacttgcgtagtagtagacgtatctcacgaagatcctgaagtcaaatttaactggtacgtagatggcgtagaagtacacaatgctaaaacaaaaccaagagaagaacaatataactcaacataccgtgtcgtatcagtactaacagtactacaccaagactggctaaatggaaaagaatacaaatgtaaagtatccaacaaagcattacccgcaccaatagaaaaaacaatatcaaaagcaaaaggccaaccacgagaaccacaagtatatactctacccccgtctagagaagaaatgaccaaaaaccaagtatcattaacctgcctagtcaaaggattttacccatcagatattgcagtagaatgggaatctaacggacaaccagaaaataactacaaaacaacaccccccgttttagattcagacggctcatttttcttatattcaaaattaacagttgacaaatccagatggcaacaaggaaacgtattctcatgtagtgtcatgcacgaagcacttcataaccactatacacaaaaatcactaagtttatctcctggcaaa

SEQ ID NO: 46077 - RNA, 642 nt, synthetic construct
  misc_feature 1..642: note = derived and/or modified sequence opt6 from Duligotuzumab_LightChain1
  source 1..642: mol_type = other RNA
gacatacaaatgacacaatcaccatcaagcttatcagcatcagtaggagacagagtaacaataacatgcagagcatcccaaaatatagcaacagacgtagcatggtatcaacaaaaaccaggaaaagcaccaaaactactaatatactcagcatccttcctatactcaggagtaccatcaagattctcaggttcaggatcaggaacagacttcacactaacaatatcctcactacaacccgaagacttcgcaacttactactgccaacaatcagaaccagaaccatacacattcggacaaggaacaaaagtagaaataaaaagaacagtagcagcaccatcagtcttcatatttccaccatcagacgaacaactaaaatccggaacagcatcagtagtatgtctactaaacaacttctacccaagagaagcaaaagtacaatggaaagtagacaatgcactacaatcaggaaattcacaagaatcagtaacagaacaagactcaaaagactcaacatactcactatcctcaacactaacattatcaaaagcagactacgaaaaacacaaagtttacgcatgcgaagtaacacatcaaggactatcatcacccgtaacaaaatcattcaacagaggagaatgc

SEQ ID NO: 46078 - RNA, 1353 nt, synthetic construct
  misc_feature 1..1353: note = derived and/or modified sequence opt6 from Dupilumab_HeavyChain1
  source 1..1353: mol_type = other RNA
gaagtccaactagtagaatcaggaggaggtcttgaacaaccaggaggatcactaagactatcctgtgcaggatcaggattcacattccgagactacgcaatgacatgggtacgtcaagctccaggaaaaggactagaatgggtatcatcaatatcaggatctggaggaaacacatactatgcagactcagtaaagggaagatttactatatcacgagacaattcaaaaaacacactataccttcaaatgaattcactcagagcagaagacacagctgtatattactgcgcaaaagatcgattatcaatcaccataagaccacgctattacggactagatgtatggggacaaggtacaacagtcacagtaagttccgcatcaacaaaaggaccaagtgtattccctctagcaccctgttcaagatccacatcagaaagtacagccgcgttaggatgtttagtaaaagattatttcccagaaccagtaacagtttcatggaactcaggagctttaacatcaggcgtacacacatttccagcagtactacaatcttcaggactatattcattatcatcagtagtaacagtaccatcatcatctttaggtacaaaaacttatacatgtaacgtagatcataaaccatcaaacacaaaagtagacaaaagagtagaatcaaaatacggacccccatgcccaccatgcccagctcctgaattcttaggaggcccaagtgtattcctctttccaccaaaacctaaagatacattaatgatttcaagaacaccagaagtaacctgtgtagtagtagatgtatcgcaagaagacccagaagtacaattcaactggtacgtagatggagtagaagtacataacgcaaaaactaaaccaagagaagaacaattcaactctacatatagagtagtatcagtcctaacagtattacatcaggactggctaaatggaaaagaatacaaatgtaaagtctccaataaaggattaccatcaagtatagaaaaaaccatttcaaaagcaaaaggacaaccaagagaaccacaagtatacacactaccaccctcccaagaggaaatgacaaaaaaccaagtatccttaacatgcctagtcaaaggattctacccctccgacatagccgttgaatgggaatcaaacggacaaccagaaaacaactataaaacaacaccacccgtattagattcagatggaagtttctttctatattcaagactaacagtagataaaagtagatggcaagaaggaaatgtatttagctgttcagtaatgcatgaagcattacataaccactatacacaaaaaagcttatctctatcactcggt

SEQ ID NO: 46079 - RNA, 657 nt, synthetic construct
  misc_feature 1..657: note = derived and/or modified sequence opt6 from Dupilumab_LightChain1
  source 1..657: mol_type = other RNA
gacatagtaatgacacaatccccactatcactaccagtaacaccaggagaaccagcctcaatctcatgcagatcatcacaatcactattatactcaataggatacaattacctagactggtacctacaaaaatcaggacaatcaccacaactactaatatacctaggatccaatagagcatctggagtaccagacagattctcaggatcaggatcaggcaccgacttcacactaaaaatatcaagagtagaagcagaagacgtaggcttctactattgcatgcaagcactacaaacaccatacacattcggacaaggaacaaaactagaaattaaaagaacagtagcagcaccatcagtattcatattcccaccatcagacgaacaactaaaatcaggaacagcatcagtagtatgcctactaaacaacttttacccaagagaagcaaaagtacaatggaaagtcgacaacgcactccaatccggaaactcacaagaatcagtaacagaacaagacagtaaagactcaacatactcactatcatccactttaaccctatcaaaagcagactacgaaaaacacaaagtatacgcatgcgaagtaacacaccaaggattatcatcaccagtaacaaaatccttcaacagaggagaatgc

SEQ ID NO: 46080 - RNA, 1353 nt, synthetic construct
  misc_feature 1..1353: note = derived and/or modified sequence opt6 from Durvalumab_HeavyChain1
  source 1..1353: mol_type = other RNA
gaagtacaacttgtagaatctggtggaggattagtacagccaggaggttcattaagactatcatgcgctgcaagcggatttacattctccagatattggatgtcatgggtaagacaagcaccaggaaaaggcttagaatgggtagcaaacataaaacaagatggatcagaaaaatactacgtggacagtgtaaaaggacgatttactatatcaagagacaatgcaaaaaactctctatacttacaaatgaattcattaagagctgaagatacagctgtatactattgcgcaagagaaggaggatggttcggagaactagcattcgactactggggacaaggaacattagtcacagtaagttcagcatcaacaaaaggaccctcagtattcccattagctccaagctcaaaatcaacgtcaggcggcactgcagcactaggatgtttagtcaaagactatttcccagaaccagtaacagtttcatggaatagcggagcattaacaagtggggtacacactttccctgcagtattacaaagcagcggattatattcattaagtagcgtagtcactgtaccatcatcatctctaggaacacaaacatacatatgtaatgtaaatcacaaaccatcaaatacaaaagtagataaaagagtagaaccaaaatcatgcgacaaaacacatacctgtccaccatgtccagcaccagaatttgaaggtggaccatcagtatttctattcccaccaaaaccaaaagatacactcatgataagtagaaccccagaagtcacatgtgtagtagtagatgtatcacacgaagatccagaagtaaaatttaactggtatgtagatggagtcgaagttcataacgcaaaaacaaaaccaagagaagaacaatataacagtacatatagagtagtgtcagtattaacagtactacatcaagactggttaaacggcaaagaatacaaatgtaaagtatcaaataaagcactacccgcatcaatagaaaaaacaatatccaaagccaaaggacaaccaagagaacctcaagtatacactctaccaccttcaagagaagaaatgactaaaaaccaagtatcactaacatgcttagtaaagggtttttacccatcagacatagctgtggaatgggaaagtaacggacaaccagaaaataactataaaacaaccccaccagtacttgattcagacggatccttttttctctactcaaaactaacagtcgacaaatccagatggcaacaaggtaacgtattttcttgctcagtaatgcacgaagcactacacaatcattacactcaaaaaagcttaagtctatcaccaggaaaa

SEQ ID NO: 46081 - RNA, 645 nt, synthetic construct
  misc_feature 1..645: note = derived and/or modified sequence opt6 from Durvalumab_LightChain1
  source 1..645: mol_type = other RNA
gaaatagtactaacacaatcaccaggaacactatcactatcacccggagaaagagcaacattatcctgtagagcatcacaaagagtatcatcatcatacctagcatggtaccaacaaaaaccaggacaagcacccagactactaatatacgacgcatcctccagagcaacaggaataccagacagattctcaggatcaggctcaggaacagacttcacattaacaatatcaagactagaaccagaagacttcgcagtatattactgccaacaatacggaagcctaccatggacattcggacaaggaacaaaagtagaaataaaaagaacagtagcagcaccatccgtattcatattcccaccatcagacgaacaactaaaatcaggaacagcatcagtagtatgtctactaaacaacttctacccaagagaagcaaaagtacaatggaaagtagacaacgcactacaatcaggaaactcacaagaatcagtaacagaacaagactcaaaagattcaacatactcactaagctcaacactcacactaagcaaagccgactacgaaaaacacaaagtctatgcatgtgaagtaacacaccaaggactatcctcaccagtcacaaaatcattcaacagaggagaatgc

SEQ ID NO: 46082 - RNA, 1338 nt, synthetic construct
  misc_feature 1..1338: note = derived and/or modified sequence opt6 from Dusigitumab_HeavyChain1
  source 1..1338: mol_type = other RNA
caagtacaactagtacaatcaggagcagaagtaaaaaaaccaggagcctcagtaaaagtaagctgcaaagcatcaggatatacattcactagttacgatataaattgggttcgacaagcaactggccaaggcttagaatggatgggatggatgaacccaaattccggaaatactggatacgctcaaaaattccaaggccgagtaacaatgacaagaaatacatctatatcaaccgcttacatggaactatcatcattaagatcagaagacactgccgtatactactgcgcacgtgatccatactattattactatggcatggatgtatggggtcaaggaacaacagttacagtttcaagtgcatcaactaaaggaccctcagtatttccattagctccttgctcaagatcaacatcagaatcaacagctgcattaggatgtttagtaaaagattatttccccgaacctgtaacagtaagctggaactcaggagcactaacatcaggagtccatacatttccagcagtattacaatcaagtggattatattcactaagttcagtagtcacagtaccatctagcaactttggtacccaaacatatacatgtaatgttgaccataaaccatccaacacaaaagttgataaaacagtagaaagaaaatgctgcgtagaatgccctccatgtccagcaccaccagtagcaggtccaagcgtattcctattcccacccaaaccaaaagatacactaatgataagtagaactccagaagtaacatgtgttgtagtagacgtttcacatgaagatccagaagttcaatttaattggtatgtcgacggcgttgaagtacacaatgcaaaaacaaaacccagagaagaacaatttaattcaacattccgagtagtatcagtactcacagtagtacatcaagattggcttaacggaaaagaatacaaatgcaaagtatccaacaaaggacttccagcaccaatagaaaaaactataagcaaaacaaaaggacaacccagagaaccacaagtatatacactaccaccatcaagagaagaaatgacaaaaaaccaagtatcattaacttgcttagtaaaaggattttacccaagcgatatagcagtagaatgggaaagcaacggccaaccagaaaacaattacaaaaccacacccccaatgctcgattctgacgggtcattttttctatactcaaaacttactgttgacaaatcaagatggcaacaaggcaatgtattctcttgttcagtcatgcatgaagcactacacaaccactatacacaaaaatcattatcgttatcaccaggtaaa

SEQ ID NO: 46083 - RNA, 651 nt, synthetic construct
  misc_feature 1..651: note = derived and/or modified sequence opt6 from Dusigitumab_LightChain1
  source 1..651: mol_type = other RNA
caatcagtactaacacaaccaccatcagtatcagcagcaccaggacaaaaagtaacaatatcctgctcaggaagctcatcaaacatagaaaacaaccacgtatcatggtatcaacaattaccaggaacagcaccaaaattattaatttacgacaacaacaaaagaccaagcggaataccagacagattttctggatcaaaatcaggaacatcagcaacactaggaataacaggactacaaacaggagacgaagcagactactactgcgaaacatgggatacatcactaagcgcaggaagagtattcggaggaggaacaaaattaacagtactaggacaaccaaaagcagctccatcagtaacattattcccaccatcatcagaagaactacaagcaaacaaagcaacactagtatgcttaatatcagacttctatccaggagcagtaacagtagcatggaaagccgacagctcaccagtaaaagcaggagtagaaacaacaacaccatcaaaacaatcaaacaacaaatatgcagcatcaagttacctctcactaacaccagaacaatggaaatcacacagatcatactcatgccaagtaacacacgaaggatcaacagtagaaaaaacagtagcaccaacagaatgttca

SEQ ID NO: 46084 - RNA, 1347 nt, synthetic construct
  misc_feature 1..1347: note = derived and/or modified sequence opt6 from Ecromeximab_HeavyChain1
  source 1..1347: mol_type = other RNA
gaagtaacactagttgaatcaggtggagattttgtaaaacccggaggttcattaaaagttagctgcgcagcctccggatttgcattctctcactacgcaatgtcatgggtaagacaaacccccgcaaaacgactagaatgggtagcatatataagttccggaggatcaggaacctactattccgactctgttaaaggaagattcactatatcccgagacaatgccaaaaacactttataccttcaaatgagatccctacgatcagaagattcagcaatgtatttctgcacaagagtaaagttaggcacctattacttcgattcatggggccaaggcacaaccttaacggtctcatcagcatcaactaaaggaccatcagtattcccattagcaccttcctcaaaatcaacatcaggaggaacagcagcattaggatgcctagtaaaagattacttccccgaaccagtaacagtatcctggaactcaggagcattaacatctggtgtacacacattccctgcagtactacaatcatcaggactatactctttaagttcagtagtaacagtaccatctagttcattaggaacacaaacctacatatgtaatgtaaatcataaaccatcaaataccaaagtagacaaaaaagtagaaccaaaatcctgcgacaaaacccacacatgcccaccttgtccagcaccagaattactaggaggcccatcagtatttctattcccaccaaaaccaaaagataccctaatgatatcaagaacccccgaagtaacatgcgtagtagttgacgtctcacatgaagacccagaagttaaattcaactggtacgttgatggagtagaagtacataatgcaaaaactaaaccaagagaagaacaatacaattcaacatatcgagtagtaagtgtcttaacagtattacatcaagattggctcaacggaaaagaatataaatgcaaagtatcaaacaaagcacttccagccccaatagaaaaaacaatatcaaaagctaaaggtcaaccaagagaaccacaagtatacacactacccccctcacgagacgaactaacgaaaaaccaagtttctctaacatgcctcgtaaaaggattttatccatccgatatagcagtagaatgggaatcaaatggacaaccagaaaataactataaaaccacaccaccagtactcgactcagacggatcctttttcttatactcaaaattaacagtagataaatctagatggcaacaaggaaacgtattttcatgctcagtaatgcacgaagcacttcacaaccactacacccaaaaatccctatcattatcaccaggaaaa

SEQ ID NO: 46085 - RNA, 642 nt, synthetic construct
  misc_feature 1..642: note = derived and/or modified sequence opt6 from Ecromeximab_LightChain1
  source 1..642: mol_type = other RNA
gacatacaaatgacacaaacagcatcatcattaccagcatcactaggcgatagagtaactatatcatgctcagcatcccaagacataagtaactacctaaactggtaccaacaaaaaccagacggtacagtcaaattactaatattctactcatcaaacctccactcaggagtaccatcacgattctcaggaggaggatcaggaacagactattctctaacaatatccaacctagaaccagaagacatagcaacatacttctgccaccaatactcaaaactaccatggacattcggaggaggaaccaaactagaaataaaaagaacagttgcagcaccatcagtattcatattcccaccatcagacgaacaactaaaatcaggaacagcatcagtcgtatgcttactaaataatttctacccaagagaagcaaaagtacaatggaaagtcgacaacgcactacaatcaggaaactcacaagaatcagtaacagaacaagactcaaaagactcaacatactcactatcatcaacactaacattatccaaagcagactacgaaaaacacaaagtatacgcatgcgaagtaacacaccaaggactatcatcaccagtaacaaaatcattcaacagaggagaatgc

SEQ ID NO: 46086 - RNA, 1341 nt, synthetic construct
  misc_feature 1..1341: note = derived and/or modified sequence opt6 from Eculizumab_HeavyChain1
  source 1..1341: mol_type = other RNA
gtacaactagtccaatccggtgcagaagttaaaaaaccaggagcatcagttaaagtttcctgcaaagcatcaggctacatattctctaactactggattcaatgggtccgacaagctcccggtcaaggcctagaatggatgggagaaatattaccaggatcaggatcaaccgaatacacagaaaacttcaaagacagagtgactatgactcgagacacaagcacatccacagtctatatggaactctcttcactaagatctgaagatacagcagtatattactgcgcaagatactttttcggatcatcaccaaactggtacttcgacgtctggggacaaggaactcttgtaacagtatcttccgcaagcacaaaaggaccatcagtatttccattagctccatgttcacgctccactagcgaatccaccgcagctctaggatgcctagtaaaagactatttcccagaacctgttacagtttcttggaactctggagcactaaccagtggagtacacacattccccgcagtcctacaatctagtggattatattcattatcatcagtcgtaactgtaccatcctcaaattttggcacacaaacatacacttgtaacgtagaccataaaccatctaacacaaaagtagacaaaacagtagaaagaaaatgttgcgtagaatgtccaccatgcccagcccccccagtagcaggaccttcagtttttctattcccaccaaaaccaaaagatacattaatgatatccagaacacccgaagtcacatgcgtagtagtagacgtatcacaagaagatcccgaagttcaattcaactggtatgtcgacggagtagaagtacacaacgcaaaaacaaaaccaagagaagaacaattcaattcaacttatagagttgtaagcgtcctaacagtactacatcaagactggttaaatggcaaagagtacaaatgcaaagtttctaacaaaggtttaccatcatcaatagaaaaaacaatatccaaagcaaaaggtcaacccagagaaccacaagtatatacactaccaccttcacaagaagaaatgactaaaaatcaagtatcattaacatgtttagtaaaaggattctacccatcagacatagcagttgaatgggaatcaaacggtcaaccagaaaataactataaaacaaccccacccgtattagactcagacggctctttctttctatactcacgactaaccgtagataaatcaagatggcaagaaggaaacgtattttcttgctcagtaatgcatgaagccttacacaatcactacacacaaaaatcactatcactatctttaggaaaa

SEQ ID NO: 46087 - RNA, 642 nt, synthetic construct
  misc_feature 1..642: note = derived and/or modified sequence opt6 from Eculizumab_LightChain1
  source 1..642: mol_type = other RNA
gacatacaaatgacacaatcaccatcaagcttatcagcaagcgtaggagacagagtaacaataacatgcggagcaagcgaaaacatatacggagcactcaactggtaccaacaaaaacccggaaaagcaccaaaactactaatctacggcgcaacaaacctagcagacggcgttccatccagattctcaggatcaggatcaggaacagacttcacattaacaatatcatcactacaaccagaagacttcgcaacatactactgccaaaacgtactaaacacaccactaacattcggacaaggaacaaaagtagaaataaaaagaaccgtcgcagccccatcagtattcatattcccaccatcagacgaacaactaaaatcaggaacagcctcagtagtatgcctactaaacaacttctacccaagagaagcaaaagtacaatggaaagtagacaacgcattacaatcaggaaactcacaagaatcagtaacagaacaagactccaaagactcaacatactcactatcatcaacactaacactatcaaaagcagactacgaaaaacacaaagtatacgcatgcgaagtaacacatcaaggcttaagttcaccagtaacaaaatccttcaacagaggagaatgc

SEQ ID NO: 46088 - RNA, 375 nt, synthetic construct
  misc_feature 1..375: note = derived and/or modified sequence opt6 from Efalizumab_HeavyChain
  source 1..375: mol_type = other RNA
gaagtacaattagtagaaagcggaggaggactagtacaaccaggaggaagtttaagattaagctgtgcagcaagcggatactcattcacaggacattggatgaactgggtaagacaagcaccaggaaaaggactagaatgggtaggaataatgatacacccaagcgatagcgaaacaagatacaatcaaaaattcaaagacataagatttacaataagcgtagacaaaagtaaaaacacactatatctacaaatgaatagcttaagagcagaagatacagcagtatattactgtgcaagaataggaatatatttctatggaacaacatatttcgattacatatggggacaaggaacattagtaacagtatcaagc

SEQ ID NO: 46089 - RNA, 324 nt, synthetic construct
  misc_feature 1..324: note = derived and/or modified sequence opt6 from Efalizumab_LightChain
  source 1..324: mol_type = other RNA
gacatacaaatgacacaatcaccatcatcactatcagcatcagtaggagacagagtaacaataacatgcagagcatcaaaaacaatatcaaaatacctagcatggtaccaacaaaaaccaggaaaagcaccaaaactactaatatactcaggatcaacactacaatcaggagtaccatcaagattctcaggatcaggatcaggaacagacttcacactaacaatatcatcactacaaccagaagacttcgcaacatactactgccaacaacacaacgaatacccactaacattcggacaaggaacaaaagtagaaataaaacga

SEQ ID NO: 46090 - RNA, 768 nt, synthetic construct
  misc_feature 1..768: note = derived and/or modified sequence opt6 from Efungumab_SingleChain_variable_fragment
  source 1..768: mol_type = other RNA
atggcagaagtacaactagtagaaagtggagcagaagtaaaaaaaccaggagaaagtctaagaataagttgtaaaggaagcggatgcataatatcaagctattggataagttgggtcaggcaaatgccaggaaaaggacttgaatggatgggaaaaatagatccaggagattcatatataaattatagtccaagttttcaaggacacgtaacaataagtgcagataaaagtataaatacagcatatttacaatggaatagtttaaaagcaagcgacacagcaatgtattattgtgccagaggaggacgagatttcggagatagttttgattattggggacaaggaactctagtaacagtaagttcaggaggaggaggaagtgggggaggaggctcaggaggaggaggaagcgatgtagtaatgacacaatcaccatcatttttaagtgcatttgtaggagatagaataacaataacatgtagagcaagtagtggaataagtagatatttagcatggtatcaacaagcacctggaaaagcaccaaaattattgatatatgcagcaagtacattacaaacaggagtaccaagtagatttagtggatcaggatcaggaacagaatttacattaacaataaattcattacaaccagaagactttgcaacatactattgtcaacatttaaacagctatccattaacatttggaggaggaacaaaagttgatataaaaagagcagctgcactagaacatcatcatcatcatcat

SEQ ID NO: 46091 - RNA, 1362 nt, synthetic construct
  misc_feature 1..1362: note = derived and/or modified sequence opt6 from Eldelumab_HeavyChain1
  source 1..1362: mol_type = other RNA
caaatgcaattagtagaatcaggaggtggagtcgtgcaaccaggaagatcattacgattaagttgtactgctagtggattcactttctcaaataacggaatgcactgggtaagacaagctccaggaaaagggcttgaatgggtagcagtaatctggttcgatggaatgaacaaattctacgttgacagtgtaaaaggaagatttacaataagcagagacaatagtaaaaacacactatacctagaaatgaatagtttaagagcagaagacacagctatatattattgtgctcgagaaggggacggatcaggaatatattactactatggaatggatgtctggggacaaggaacaacagtaactgtctcatctgcatctacaaaaggaccatcagtctttccactagcaccatcatccaaatcaacatcaggaggaacagcagcacttggatgcctagtcaaagattattttccagaaccagtaacagtatcatggaattcaggagcattaacaagcggagtacacacatttccagcagtattacaatctagtggattatactcactatcatcagtagttacagtaccctcatcatcattaggaacacaaacttatatatgcaatgtaaatcataaaccatcaaatacaaaagtagacaaaagagttgaaccaaaatcatgcgataaaacacacacatgcccaccatgccccgcaccagaattactaggaggcccaagcgtatttttatttccccctaaaccaaaagacaccttaatgatttcaagaacaccagaagtaacatgtgtagtagtagatgtatcacatgaagaccccgaagtgaaatttaattggtatgtagacggagtagaagttcataacgcaaaaacaaaaccaagagaagaacaatacaacagtacatacagagttgtaagtgtattaacagtactacaccaagattggctaaacggaaaagaatataaatgtaaagtatcaaataaagccttaccagccccaatagaaaaaacaataagcaaagcaaaaggtcaaccacgagaaccacaagtatatacattaccaccttctagagaagaaatgacaaaaaatcaagtaagtttaacatgcttagtaaaaggattctacccatccgacattgcggtagaatgggaatccaatggacaaccagaaaataactataaaacaacaccaccagtacttgatagtgatggatcatttttcctatacagcaaactaacagtcgataaatcaagatggcaacaaggtaatgtcttcagctgctcagtaatgcatgaagctctacacaaccactatacacaaaaatcactgtcattatcaccaggaaaa

SEQ ID NO: 46092 - RNA, 648 nt, synthetic construct
  misc_feature 1..648: note = derived and/or modified sequence opt6 from Eldelumab_LightChain1
  source 1..648: mol_type = other RNA
gaaatagtacttacacaatcacccggaacactatcactatcaccaggagaaagagcaacactatcatgcagagcatcacaatcagtatcatcatcatacttagcatggtaccaacaaaaaccaggacaagcaccaagattactaatatacggagcatcaagtagagcaacaggtatacccgacagattttcaggatccggatcaggaaccgacttcacactaacaatatcaagattagaaccagaagacttcgcagtatactactgccaacaatacggatcatccccaatattcacattcggaccaggaaccaaagtagatataaaacgaacagtagcagcaccatcagtattcatattcccaccatcagacgaacaactaaaatcaggaacagcctcagtagtatgcttactaaataacttctatccaagagaagcaaaagtacaatggaaagtagacaacgcactacaatcaggaaactcacaagaatcagttactgaacaagactcaaaagactcaacatattcattatcatcaaccttaacactatcaaaagccgactacgaaaaacacaaagtatacgcatgcgaagtaacacaccaaggactatcctcacccgtaacaaaatcattcaaccgaggagaatgc

SEQ ID NO: 46093 - RNA, 1341 nt, synthetic construct
  misc_feature 1..1341: note = derived and/or modified sequence opt6 from Elgemtumab_HeavyChain1
  source 1..1341: mol_type = other RNA
gaagtacaactactagaatcaggaggaggattagtacaaccaggaggatcactacgactatcctgtgcagcatctggattcacattctcaagttacgcaatgtcatgggtaagacaagccccaggaaaaggattagaatgggtatcagcaataaactcacaaggtaaatcaacttactacgccgattcagtaaaaggaagatttacaatatcacgagataattcaaaaaatacactctatctacaaatgaacagtctaagagcagaagacactgctgtttactattgcgctagatggggagacgaaggctttgacatatggggacaagggacactcgtaacagtatcctcagcatcaactaaaggtccatcagtattcccactagcaccatcatcaaaatctaccagtggaggaacagcagcactaggatgtctagtaaaagactacttccccgaaccagtaacagtatcatggaactcaggcgcccttacatcaggagtacacacatttcccgctgtattacaaagttcaggcctatattccttatcatctgtagtaacagtaccatcatcttccctaggaacacaaacatatatatgtaacgtaaatcataaaccctcaaatactaaagtagacaaacgcgtagaacctaaaagttgcgacaaaacacacacatgtccaccttgtccagcacccgagttattaggaggaccatcagtctttctatttccaccaaaaccaaaagatacactcatgataagtagaacaccagaagtaacatgtgtcgtagtagatgtaagtcacgaagaccctgaagtaaaattcaactggtatgtcgacggcgtagaagtccacaacgccaaaacaaaaccccgtgaagaacaatataactcaacatatagagtagtatcagtcttaacagtattacaccaagattggttaaatggaaaagaatacaaatgcaaagtatcaaataaagccttaccagcaccaattgaaaagacaatatcaaaagcgaaaggacaaccaagagaaccacaagtatatacattacctccatccagagaagaaatgaccaaaaaccaagtatccttaacatgtctagtaaaaggtttctacccctccgatatcgcagtcgaatgggaatccaatggtcaacctgaaaataattacaaaacaacaccccccgtactcgattcagacggatcttttttcctatactcaaaactaacagtagataaatctagatggcaacaaggaaacgtattctcctgttctgtaatgcatgaagcattacacaatcactatacacaaaaaagcttatcattatctccaggaaaa

SEQ ID NO: 46094 - RNA, 642 nt, synthetic construct
  misc_feature 1..642: note = derived and/or modified sequence opt6 from Elgemtumab_LightChain1
  source 1..642: mol_type = other RNA
gacatacaaatgacacaatcaccctcatcactatcagcatcagtaggagaccgagtaacaataacatgcagagcatcacaaggcatatcaaactggctagcatggtaccaacaaaaacccggaaaagcccccaaactcctaatatacggagcatcatcactccaatcaggagtaccatcaagattctcaggttcaggctcaggaacagacttcacattaaccatatcatcactacaaccagaagacttcgcaacatactactgccaacaatattcatcattcccaaccacattcggacaaggaacaaaagtagaaataaaaagaacagtagcagcaccatccgtattcatattcccaccatcagacgaacaactaaaatcaggaacagcatcagtcgtatgcctactaaacaacttctacccaagagaagccaaagttcaatggaaagtagacaacgcactacaatcaggaaactcacaagaatctgtaacagaacaagactcaaaagactcaacatactccttatcatcaacattaacactttccaaagcagactacgaaaaacacaaagtatacgcatgcgaagtaacacaccaaggactatcatcaccagtcacaaaatcattcaacagaggagaatgc

SEQ ID NO: 46095 - RNA, 1347 nt, synthetic construct
  misc_feature 1..1347: note = derived and/or modified sequence opt6 from Elotuzumab_HeavyChain1
  source 1..1347: mol_type = other RNA
gaagtacaattagtagaatctggtggtggattagttcaaccaggaggttcactaagactatcttgtgcagcttcaggatttgatttctcacgatattggatgtcatgggttagacaagcaccaggaaaaggactcgaatggatcggagaaataaatccagattcctctactataaattatgcacctagcctaaaagataaatttataatatcaagagacaatgccaaaaattcattatatctacaaatgaattcactaagagcagaagatacagctgtatattactgcgcacgcccagacggaaattactggtactttgacgtatggggccaaggtaccttagtaacagtctcttcagcatcgaccaaaggaccatccgtcttcccactagcaccttcttcaaaatcaacctccggtggaacagcagcattaggatgtttagtcaaagactactttcccgaaccagtaacagtatcttggaattcaggagcactaacatctggcgtccatactttcccagccgtcctccaatcttcaggactatactccctatcatcagtagtaacagtaccatcctcctcactaggcacacaaacctatatatgtaacgtcaatcataaaccatctaacactaaagtagacaaaaaagtcgaaccaaaatcgtgtgataaaacccatacatgtccaccctgccccgcaccagaattattagggggaccatctgtcttcctgttccctccaaaaccaaaagacacattaatgatctcaagaaccccagaagttacatgcgtagtagtagatgtctctcatgaagaccccgaagtcaaatttaattggtatgtagacggtgttgaagtacacaatgcaaaaactaaaccaagagaagaacaatataactcaacatatcgagttgtatctgtattaacagtattacaccaagattggcttaacggtaaagaatacaaatgcaaagtatccaataaagcattaccagccccaatagaaaaaactatttccaaagcaaaaggacaaccaagagaaccacaagtatacacactaccaccatccagagacgaattaacaaaaaaccaagtaagccttacatgcctagtaaaaggattttacccatcagacatagcagtagaatgggaatcaaacggacaaccagaaaacaactataaaaccacaccaccagtcctagattcagatggatcatttttcctatattcaaaattaacagtagacaaaagccgttggcaacaaggaaacgtcttttcatgctcagtaatgcatgaagcattacataaccattatacacaaaaatcactctcactatcacccggcaaa

SEQ ID NO: 46096 - RNA, 642 nt, synthetic construct
  misc_feature 1..642: note = derived and/or modified sequence opt6 from Elotuzumab_LightChain1
  source 1..642: mol_type = other RNA
gacatacaaatgacacaatcaccatcatcactatctgcatcagtaggagacagagtaacaataacatgcaaagcttcacaagatgtaggaatagcagtagcatggtatcaacaaaaaccaggaaaagtaccaaaactccttatatactgggcatcaacaagacacacaggagtaccagacagattttcaggatcaggatcaggaacagacttcacattaacaatatcatcattacaaccagaagacgtagcaacatactactgccaacaatactcatcatacccatacacattcggacaaggaactaaagtagaaataaaaagaacagttgcagcaccatcagtattcatattccccccatcagacgaacaactaaaatcaggaacagcatcagtagtatgcctactaaacaacttctacccaagagaagcaaaagtacaatggaaagtagacaacgcactacaatcaggaaattcacaagaatcagtaacagaacaagactcaaaagactcaacatactcactaagctcaacattaacactatctaaagcagactacgaaaaacacaaagtatacgcatgtgaagtaacacaccaaggcttaagctcaccagtaacaaaatccttcaacagaggagaatgc

SEQ ID NO: 46097 - RNA, 1338 nt, synthetic construct
  misc_feature 1..1338: note = derived and/or modified sequence opt6 from Emactuzumab_HeavyChain1
  source 1..1338: mol_type = other RNA
caggttcaattagttcaatcaggagccgaagttaaaaaacccggagcatcagtaaaagtaagctgtaaagctagtggatacacattcacaagctatgacatctcatgggtaagacaagcaccaggacaaggactagaatggatgggtgtaatatggaccgatggaggaactaattacgcacaaaaattacaaggaagagtaacaatgacaacagatacatccacatcaacagcatacatggaactacgatcactaagatcagacgatacagcagtatattactgtgcacgtgaccaaagattatacttcgacgtatggggacagggaacaacagtaacagtatcatcagcaagtacaaaaggaccttcagtttttccacttgcaccttcatcaaaatcaacaagcggaggaacagcagcactaggatgcctagttaaagattatttccctgaaccagtaacagtttcatggaactcaggagctctaacctcaggcgttcataccttccctgcagtactccaatcatccggattatactcgctttcatcagttgtaacagtaccatcctcatcactaggcacacaaacatacatttgtaacgtaaaccataaaccatcaaacactaaagtcgataaaaaagttgaaccaaaatcatgcgacaaaactcacacatgtccaccatgcccagcacccgaactcctaggaggcccatcagtatttttattcccaccaaaaccaaaagacaccctcatgatatcccgaaccccagaagtaacatgtgtagtagtcgatgttagccatgaagacccagaagtaaaatttaactggtacgtggacggagtagaagtacacaatgccaaaacaaaaccaagagaagaacaatacaacagcacctaccgagtagtatcagtattaaccgttctacatcaagattggcttaacggaaaagaatacaaatgcaaagtcagcaataaagcactacccgcaccaatagaaaaaacaatatcaaaagcaaaaggccaacctagagaaccacaagtatatacactaccaccatcaagagatgaattaacaaaaaatcaagtaagcctaacatgcctagtaaaaggattctacccaagtgacattgcagttgaatgggaatcaaatggacaaccagaaaataattataaaacaacacctcccgtactcgactcagacggatcattctttttatactcaaaactaacagtcgacaaatcaagatggcaacaaggaaacgtattctcatgttccgtaatgcacgaggcactacacaaccattacacacaaaaatcattatcactatcaccaggaaaa

SEQ ID NO: 46098 - RNA, 639 nt, synthetic construct
  misc_feature 1..639: note = derived and/or modified sequence opt6 from Emactuzumab_LightChain1
  source 1..639: mol_type = other RNA
gacatacaaatgacacaatcaccatcatcattatcagcatcagtaggagacagagtaacaattacatgcagagcatcagaagacgtaaacacatacgtatcatggtaccaacaaaaaccaggaaaagcaccaaaactactaatatatgccgcatcaaacagatacacaggcgtaccctccagattctcaggatccggatctggaacagacttcacattaacaatatcatccctacaaccagaagacttcgcaacatactactgccaacaatctttctcatacccaacattcggacaaggaacaaaactcgaaataaaacgaacagtcgcagcaccatcagtattcatattcccaccatcagacgaacaactaaaatcaggcacagcatcagtagtatgtctactaaacaacttctacccaagagaagcaaaagtacaatggaaagtagacaacgcactacaatcaggaaactcacaagaatctgtcacagaacaagactcaaaagattcaacatactcactatcatcaacattaacactatcaaaagccgactacgaaaaacacaaagtatacgcatgcgaagtaacacaccaaggactatcatcacccgtaacaaaatcattcaacagaggcgaatgc

SEQ ID NO: 46099 - RNA, 1323 nt, synthetic construct
  misc_feature 1..1323: note = derived and/or modified sequence opt6 from Emibetuzumab_HeavyChain1
  source 1..1323: mol_type = other RNA
caagttcaattagtacaatcaggcgcagaagtaaaaaaaccaggagcatcagtaaaagtcagctgcaaagcatctggatacacatttacagactactatatgcactgggtaagacaagcaccaggtcaaggactagaatggatgggcagagtaaatccaaaccgacgaggaacaacctataaccaaaaatttgaaggaagagtcacaatgacaacagatacatcaacatccactgcatacatggaacttcgttcactacgatcagacgacacagcagtatactattgcgcacgagcaaattggcttgactactggggacaaggaacaaccgttacagtaagttcagcctcaacaaaaggaccaagtgtatttccactagctccttgctctagatcaacatcagaatctactgcagcattaggatgtcttgtaaaagattattttcccgaaccagtaacagtatcttggaactcaggagctctaacctcaggagttcatacattcccagcagtattacaatcctcaggcttgtactccctctcatcagtagtaacagtcccatcatcaagcttaggaacaaaaacctacacatgcaacgtcgaccacaaaccatcaaatacaaaagtagacaagagagtcgaatcaaaatatggtccgccatgtccaccatgtccagccccagaagccgcaggaggtccatctgttttcctattcccaccaaaacccaaagatacattaatgatctcaagaacaccagaagtaacatgcgtagtagtagatgtttcccaagaagaccccgaagtacaatttaactggtacgtagacggagtggaagtacacaacgcaaaaacaaaacccagagaagaacaattcaactcaacatacagagttgtatcagtacttactgtattacatcaagactggctaaatggaaaagaatataaatgtaaagtaagtaacaaaggattaccatcctccatagaaaaaaccatatcaaaagctaaaggacaacccagagaaccacaagtatacactctaccaccatcacaagaagaaatgactaaaaatcaagtatcactaacatgtctagtaaaaggattctatccatcagacatagcagttgaatgggagtctaatggacaaccagaaaataactacaaaacaactccacccgtactagactcagacggttcattctttctatattcaagactaacagtagacaaatccagatggcaagaaggaaatgtattctcatgttcagtaatgcatgaagcattacacaaccactacacacaaaaatcactaagtctatcattagga

SEQ ID NO: 46100 - RNA, 645 nt, synthetic construct
  misc_feature 1..645: note = derived and/or modified sequence opt6 from Emibetuzumab_LightChain1
  source 1..645: mol_type = other RNA
gacatacaaatgacccaatcaccatcatcactatcagcatcagtaggagacagagtaacaataacatgctcagtctcatcatccgtatcatcaatatacctacactggtaccaacaaaaaccaggaaaagcaccaaaactattaatatactcaacatcaaacctcgcatcaggagtaccctcaagattctcaggatcaggatcaggcacagacttcacactaacaatatcctcactacaaccagaagacttcgcaacatactactgccaagtatactctggatacccactaacattcggaggaggaacaaaagtagaaataaaaagaacagtagcagcaccatcagtattcatattcccaccatcagacgaacaactaaaatcaggaacagcctccgtagtatgcctattaaacaacttctaccctagagaagcaaaagtacaatggaaagtagacaacgcactacaatcaggaaactcccaagaatcagtaacagaacaagactcaaaagactcaacatactcactatcctcaacactaacactatcaaaagccgattacgaaaaacacaaagtatacgcatgcgaagtaacacaccaaggcctatcctcacccgtcacaaaatcattcaacagaggagaatgc

SEQ ID NO: 46101 - RNA, 1344 nt, synthetic construct
  misc_feature 1..1344: note = derived and/or modified sequence opt6 from Emicizumab_HeavyChain1
  source 1..1344: mol_type = other RNA
caagttcagttagttgaatcaggaggaggactagtccaaccaggaggatcattacgactatcctgcgcagcatcaggattcacattctcatattatgatatccaatgggtaagacaagcacctggaaaaggcttagaatgggtatcatcaatatcaccaagcggacaatcaacatattatcgaagagaagtaaaaggaaggtttacaataagtagagacaattcaaaaaacacattatatttacaaatgaactcactaagagcagaagacactgccgtatattactgtgctagacgaactggacgagaatacggaggaggatggtactttgattattggggacaaggcactctagtaacagtatcaagcgcatcaactaaaggaccaagcgtttttcccctagcaccatgtagtagatcaacatccgagagtacagccgcattaggatgcctcgttaaagattacttcccagaaccagtaacagtatcttggaatagtggtgctttaacctcaggagttcatactttcccagccgtactacaatcatcaggtttatattcactctcgtcagtagtaacagtaccatcttcaagcttaggaacccaaacatacacctgcaacgtagatcataaaccatcaaatacaaaagtagataaacgcgtagaatcaaaatatggacccccatgtccaccgtgcccagcaccagaatttttaggaggaccaagcgtctttctatttccacccaaacccaaagatactctaatgatatctcgcacacctgaagtaacttgcgttgtagtagatgtaagtcaagaagacccagaagtccaattcaactggtatgtagatggagtagaagttcacaacgcaaaaactaaaccccgagaagaacaatataatagtacatatagagtagtatcagtcctaacagtactacatcaagactggttaaacggaaaagaatataagtgcaaagtatcaaacaaaggattaccatcaagtatagaaaaaacaatatcaaaagctaaaggacaaccaagagaaccccaagtctacacactaccaccatcacaaaaagaaatgaccaaaaaccaagtatcactaacatgcttagtaaaaggattttacccaagtgacatagcagtagaatgggagtcaaatggacaaccagaaaataattataaaactacacccccagtattggactcagacggctctttcttcttatattctaaattaacagttgacaaatctagatggcaagaaggaaatgtattctcatgcagcgtaatgcacgaagcactacacaatagatatacacaaaaatcactctcactatcccca

SEQ ID NO: 46102 - RNA, 1332 nt, synthetic construct
  misc_feature 1..1332: note = derived and/or modified sequence opt6 from Emicizumab_HeavyChain2
  source 1..1332: mol_type = other RNA
caagtacaactagtacaatcaggaagcgaactaaaaaaaccaggagcatcagtaaaagtatcatgtaaagcatcaggatacacatttactgacaataacatggattgggtaagacaagcaccaggacaaggactagaatggatgggagatataaatacacgatccggtggatcaatatataacgaagaatttcaagatagagtaataatgacagtagataaatcaacagacactgcttatatggaactatcctcattaagatctgaagataccgcaacatatcactgcgcacgaagaaaatcatatggttactaccttgacgaatggggagaaggaacattagtcactgtatcaagtgcatcaacaaaaggaccttcagtatttccattagcaccatgctctagatctacatccgaatctacagcagcacttggatgtctagtcaaagactactttccagaacccgttacagtaagctggaacagtggagcacttacatcaggagtacatacatttccagctgtattacaatcatcaggtttatattcactatcatcagtcgtaacagtaccatcttcctcattaggaactcaaacctacacctgcaacgtagaccataaaccctcaaacacaaaagtagataaaagagtagaatcaaaatacggaccaccatgcccaccatgtccagccccagaattccttggtggaccatccgtatttctattcccaccaaaacccaaagataccttaatgatatcacgaacaccagaagtcacatgtgtcgtagtagatgtatctcaagaagatccagaagtccaatttaactggtatgtagacggtgtagaagtccataacgcaaaaacaaaaccacgagaagaacaatacaattcaacttacagagttgtatctgtactaaccgttctacaccaagactggttaaacggaaaagaatataaatgcaaagtatcaaataaaggtctaccatcatcaatagaaaaaacaatatcaaaagcaaaaggacaacctagagaaccacaagtatatacattacctccatcacaagaagaaatgaccaaaaatcaagtatcattaacatgcttagtaaaaggattctatccatccgacatcgccgttgaatgggaatcaaacggtcaacccgaaaataactataaaacaacaccaccagtactagattcagatggatcattctttctatattccaaactaacggtagataagtcaagatggcaagaaggaaacgtattctcatgctctgtaatgcacgaagctttacacaaccattacactcaagaatcactcagcttatcacca

SEQ ID NO: 46103 - RNA, 642 nt, synthetic construct
  misc_feature 1..642: note = derived and/or modified sequence opt6 from Emicizumab_LightChain1
  source 1..642: mol_type = other RNA
gacatacaaatgacacaatcaccttcatcattaagcgcctcagtaggagatagagtaacaataacatgtaaagcatcaagaaacatagaaagacaattagcatggtaccaacaaaaaccaggacaagcacctgaactactaatctatcaagcatccagaaaagaatcaggagtaccagacagattctcaggatcaagatacggaacagacttcacactaacaatatcctcattacaaccagaagacatagcaacatactactgccaacaatactcagacccaccactaacattcggaggaggaaccaaagtagaaataaaaagaactgtagcagcaccatcagtattcatattcccaccatcagacgaacaactaaaatcaggaacagcatcagtagtatgcctattaaacaacttctacccaagagaagcaaaagtacaatggaaagtagacaacgcacttcaatcaggaaactcacaagaatcagtaacagaacaagactcaaaagactcaacatactcattatcctcaacactaacactatcaaaagccgactacgaaaaacacaaagtatacgcatgtgaagtaacacaccaaggactatcatccccagtaacaaaatcattcaacagaggagaatgc

SEQ ID NO: 46104 - RNA, 1347 nt, synthetic construct
  misc_feature 1..1347: note = derived and/or modified sequence opt6 from Enavatuzumab_HeavyChain1
  source 1..1347: mol_type = other RNA
gaagtacaacttgtagaatcaggcggaggtcttgtacaaccaggaggatctctacgcttatcctgcgcagcatcaggattcacattcagctcatattggatgtcatgggtaagacaagccccaggaaaaggtctagaatgggtagcagaaattagactaaaatcagacaactacgcaacccactatgccgaatcagtaaaaggaagattcaccatatctagagacgactctaaaaattccttatatctccaaatgaactcgttacgagctgaagacacagcagtatattattgtacaggttattatgctgacgccatggactactggggacaaggaactctagtcacagtatcctcagcctccactaaaggaccttccgtttttccattagccccctcctccaaatctacctcaggaggaaccgcagcactaggctgtctagtaaaagattactttccagaacccgtcacagtttcatggaactccggagcattaactagcggagtacacacattcccagcagtattacaatcatcaggactatactcattatcatcagtagtaacagtaccttcctcttcactcggaacacaaacatatatatgtaacgtaaaccacaaaccatcaaacacaaaagtagacaaaaaagtcgaaccaaaatcatgcgacaaaacacatacatgcccaccatgcccagcacctgaactattaggaggaccatcagtattcctatttccaccaaaaccaaaagacacactcatgatatcaagaacacccgaagtaacctgcgtagttgtagacgtttcccacgaagacccagaagtaaaattcaactggtacgtcgacggagtagaagtacataatgcaaaaacaaaaccaagagaagaacaatacaactcaacatacagagtagtatccgttctaacagtattacatcaagactggctaaacggaaaagaatacaaatgcaaagtatctaacaaagcactacctgcacccatagaaaaaacaatttcaaaagctaaaggacaacccagagaaccacaagtatacacactaccaccatcaagagaagaaatgacaaaaaaccaagtctcattaacatgcttagtaaaaggtttctacccctcagacattgcagtagaatgggaatcaaacggacaacccgaaaacaactacaaaaccacaccaccagtactagactcagacggttcatttttcttatactcaaaactaactgtcgacaaatccagatggcaacaaggaaacgtattttcctgctcagtcatgcacgaagcactccataaccattacacacaaaaatcactatcactctcccctggtaaa

SEQ ID NO: 46105 - RNA, 654 nt, synthetic construct
  misc_feature 1..654: note = derived and/or modified sequence opt6 from Enavatuzumab_LightChain1
  source 1..654: mol_type = other RNA
gacatccaaatgacacaatcaccatcatcactaagtgcatcagtaggagacagagtaaccataacctgcagagcctcacaatcagtatcaacatcatcatactcatacatgcactggtaccaacaaaaaccaggcaaagcaccaaaactactaataaaatacgcatcaaacctagaatccggagtcccatcaagattctcaggatcaggctcaggaacagacttcacactaaccatatcatcactacaaccagaagacttcgcaacatactactgtcaacactcatgggaaatcccatacacattcggaggaggaacaaaagtagaaatcaaaagaacagtagcagccccatcagtattcatattcccaccatcagacgaacaattaaaatcaggcacagcatcagtagtatgcctattaaacaacttctacccacgcgaagccaaagtacaatggaaagtagacaatgcactccaatccggaaactcacaagaatcagtaacagaacaagactcaaaagactcaacctactcactatcatcaaccctaacactatcaaaagcagactacgaaaaacacaaagtatacgcatgcgaagtaacacaccaaggcctatcatcaccagtaacaaaatcatttaaccgaggagaatgc

SEQ ID NO: 46106 - RNA, 1341 nt, synthetic construct
  misc_feature 1..1341: note = derived and/or modified sequence opt6 from Enfortumab_HeavyChain
  source 1..1341: mol_type = other RNA
gaagtacaactagtagaatcaggaggtggattagtacaaccaggtggtagtcttagactcagttgcgcagcatcaggattcacatttagctcatacaatatgaactgggtaagacaagcaccaggaaaaggactagaatgggtctcttacatatcatcatcatcatctacaatatattatgccgactctgttaaaggaagatttacaatatcacgagataacgcaaaaaattcattatccttacaaatgaattctttaagagacgaagatacagccgtatattactgcgcacgtgcatattattatggcatggatgtatggggacaaggaacaacagtcaccgtttcatctgcatcaaccaaaggaccaagcgtatttccattagccccttcaagcaaatcaacatccggtggaaccgcagcattaggatgtctagttaaagattatttccccgaaccagtcacagtctcatggaattcaggagccctaacatcaggtgtacacaccttcccagcagtattacaatcaagcggtctatactcattatctagtgttgtaacagtaccctcatcatcattaggaacacaaacatacatatgcaacgtaaaccacaaaccatcaaatacaaaagtagacaaaagagtcgaaccaaaatcttgtgataaaacacatacatgccccccatgcccagctcccgaactattaggaggaccctccgtattcttattccccccaaaaccaaaagacacactcatgatatcaagaacacctgaagtaacatgtgtagtagtcgacgtatcacacgaagacccagaagtaaaatttaactggtatgtagatggagtagaagtacacaatgccaaaacaaaaccaagagaagaacaatacaattcaacttacagagtcgtatccgtacttacagttctacaccaagactggttaaatggaaaagaatacaaatgcaaagtctcaaataaagcattaccagcaccaatagaaaaaacaatttcaaaagcaaaaggtcaaccacgagaaccacaagtctacacactaccaccatccagagaagaaatgacaaaaaaccaagtatcactaacatgtttagtaaaaggattctacccctcagatatcgcagtagaatgggaatcaaatggtcaaccagaaaataattacaaaacaaccccacccgttttagattcagatggatcattcttcttatattctaaactcactgtagataaatcaagatggcaacaaggcaatgtcttcagctgttcagtcatgcacgaagcactacacaaccactacactcaaaaatcattatccctttctccaggtaaa

SEQ ID NO: 46107 - RNA, 642 nt, synthetic construct
  misc_feature 1..642: note = derived and/or modified sequence opt6 from Enfortumab_LightChain
  source 1..642: mol_type = other RNA
gacatacaaatgacacaatcaccatcaagtgtatcagcatcagtaggagaccgagtaacaataacatgtagagcatcacaaggaatatcaggatggctagcatggtaccaacaaaaaccaggaaaagcaccaaaattcttaatatacgcagcatcaacactacaatcaggagtaccatcaagattttcaggatcaggatcaggaacagatttcacattaacaatatcatcattacaaccagaagatttcgcaacatactactgccaacaagcaaactcattcccaccaacattcggaggaggaacaaaagtagaaatcaaacgaacagtcgcagcaccaagcgtatttatattcccaccatcagacgaacaactaaaatcaggaacagcatccgtagtatgcctattaaacaacttttacccaagagaagcaaaagtacaatggaaagtagacaacgcactacaatcaggaaactcacaagaatcagtaactgaacaagactcaaaagactcaacatactccctatcctcaacactaactttaagcaaagctgactacgaaaaacacaaagtatacgcatgcgaagtaacacaccaaggattaagctcaccagtaacaaaatcattcaatagaggagaatgc

SEQ ID NO: 46108 - RNA, 1341 nt, synthetic construct
  misc_feature 1..1341: note = derived and/or modified sequence opt6 from Enfortumab_vedotin_HeavyChain1
  source 1..1341: mol_type = other RNA
gaagtacaactagtagaatctggaggcggactcgtacaaccaggaggatcactaagattatcatgcgcagcctcaggttttacattctcctcatacaacatgaactgggttagacaagcacccggaaaaggactagaatgggtctcctacatatcatcaagtagctcaacaatatattacgccgattccgtaaaaggcagatttactatatcaagggacaatgcaaaaaacagcctatcattacaaatgaactcactaagagacgaagacacagctgtatactattgtgccagagcatactattacggcatggacgtatggggccaaggaacaacagttacagtatcatcagcttccactaaaggaccaagtgtattcccattagcaccaagtagtaaatctacatcaggcggcaccgccgcactaggatgtctagtaaaagactacttcccagaacccgttacagtatcatggaactctggcgcattaacatcaggagtacacacctttccagccgttctacaatcttcaggactatattcactaagttcagtagttacagtaccatcatcaagtctcggaactcaaacatatatctgcaatgtaaaccacaaaccatcaaacactaaagtagataaacgcgtagaacctaaatcatgcgataaaacacacacatgcccaccatgtccagctccagaattactaggaggcccaagtgtatttttatttcccccaaaaccaaaagacacattaatgatctcaagaacaccagaagtcacatgcgtcgtagtagacgtatcacacgaagacccagaagtcaaattcaattggtacgtagatggcgtagaagtacacaacgctaaaacaaaaccaagagaagaacaatacaattcaacttacagagtcgtatcagtattaaccgtacttcatcaagattggctcaatggtaaagaatataaatgcaaagtatctaacaaagctttaccagcaccaattgaaaaaaccatatctaaagcaaaaggccaacctagagaaccacaagtatacacattaccacctagcagagaagaaatgacaaaaaatcaagtatcccttacatgtctcgtaaaaggattttacccatcagacatcgcagtagaatgggaaagcaatggacaaccagaaaataactacaaaacaacccccccagttctagactcagacggatcattcttcctatattcaaaattaacagtagataaatcaagatggcaacaaggtaacgtattctcctgtagcgtaatgcacgaagcattacataaccactacacacaaaaatcattaagtttatcacctggaaaa

SEQ ID NO: 46109 - RNA, 642 nt, synthetic construct
  misc_feature 1..642: note = derived and/or modified sequence opt6 from Enfortumab_vedotin_LightChain1
  source 1..642: mol_type = other RNA
gacatacaaatgacacaatcaccatcatcagtaagcgcatcagtaggagacagagtaaccataacatgtagagcatcacaaggaatatcaggatggttagcatggtaccaacaaaaaccaggaaaagcacccaaattcctaatatatgcagcatcaacactacaaagcggagtaccaagcagattctcaggatcaggatcaggaacagactttacattaacaatatcatcattacaaccagaagacttcgccacatactactgccaacaagctaactcattcccaccaacattcggaggaggtacaaaagtagaaataaaaagaacagttgcagcaccatcagtattcatattcccaccatcagacgaacaattaaaatcaggaacagcatcagtagtatgcctactcaacaacttttacccaagagaagcaaaagtccaatggaaagtagacaacgcactacaaagcggaaactcacaagaatcagtaacagaacaagatagcaaagactcaacatacagtttaagctcaacactaaccttaagtaaagcagattacgaaaaacataaagtatacgcatgcgaagtaacacaccaaggcctatcatcaccagtaacaaaatcattcaacagaggcgaatgc

SEQ ID NO: 46110 - RNA, 1356 nt, synthetic construct
  misc_feature 1..1356: note = derived and/or modified sequence opt6 from Enoblituzumab_HeavyChain
  source 1..1356: mol_type = other RNA
gaagtacaattagtagaatcaggaggaggcttagtacaaccaggaggatcattaagactatcatgcgctgcatcaggattcactttcagtagtttcggtatgcactgggtgagacaagcaccaggtaaaggattggaatgggtagcctatatatcatcagattccagtgcaatctattacgctgatacagtaaaaggaagattcacaatatcacgcgataacgcaaaaaacagtctttatctacaaatgaactcattaagagacgaagacacagcagtatactattgcggaaggggaagagagaacatttactatggaagccgactagactactggggtcaaggtaccacagtaacagtatcttcagcttcaactaaaggaccatcagtatttccattagcaccctcctctaaatccacatcaggaggaacagcagcattaggctgtctagtcaaagattattttccagaaccagtaacagtttcatggaactcaggagcattaactagtggtgtacatacctttccagcagtattacaatcaagtggtctatattcattatcaagtgtagtaacagtaccatcctcctcactaggaactcaaacgtacatatgcaacgtaaaccataaacctagtaacacaaaagtagataaacgagtagaaccaaaatcatgtgacaaaacacatacctgtcccccatgcccagcacccgaactagtaggcggaccaagtgtattcctactaccacctaaacccaaagacacactaatgatatcaagaactccagaagtaacatgtgtagtagttgacgtttcacatgaagatcccgaagtaaaattcaattggtatgtagatggcgtcgaagttcacaacgcaaaaactaaaccaccagaagaacaatacaactcaacattaagagtagtatcagtattaacagttctacaccaagattggttaaacggaaaagaatataaatgcaaagtatccaacaaagcattaccagcacccatagaaaaaactatttcaaaagcaaaaggccaacctagggaaccacaagtatatacattaccaccatccagagaagaaatgacaaaaaaccaagtatctctaacatgtttggtaaaaggcttctatccatccgatatagcagtagaatgggaaagcaatggccaaccagaaaacaattacaaaacaacacccttagtattagactcagatggatcatttttcttatactcaaaattaacagttgacaaatcaagatggcaacaaggtaacgtctttagctgctcagtaatgcatgaagcactacataaccattatacacaaaaatcactatctctatcaccaggaaaa

SEQ ID NO: 46111 - RNA, 642 nt, synthetic construct
  misc_feature 1..642: note = derived and/or modified sequence opt6 from Enoblituzumab_LightChain
  source 1..642: mol_type = other RNA
gacatacaactcacacaatcaccctcatttttatcagcatcagtaggcgacagagtaacaataacatgcaaagcatcacaaaacgtagacacaaacgtagcatggtaccaacaaaaaccaggaaaagcacccaaagcactaatatactcagccagctacagatactcaggagtaccaagcagattctcaggatcaggatcaggaacagacttcaccctaacaatatcatcactccaacccgaagacttcgcaacatactactgccaacaatacaacaactacccattcacattcggacaaggaacaaaactagaaataaaacgaacagtagcagcaccatccgtattcatattcccaccatcagacgaacaactaaaatcaggcacagcatcagtcgtatgcctactaaacaacttctatccacgagaagcaaaagtacaatggaaagtagacaacgcactacaatcaggaaactcacaagaatccgtaacagaacaagactcaaaagactcaacatactcattaagctccacactaacactatcaaaagcagactatgaaaaacacaaagtatacgcatgcgaagtaacccaccaaggattatcatcaccagtaacaaaatcattcaacagaggagaatgc

SEQ ID NO: 46112 - RNA, 1356 nt, synthetic construct
  misc_feature 1..1356: note = derived and/or modified sequence opt6 from Enokizumab_HeavyChain1
  source 1..1356: mol_type = other RNA
caagtacaactagtgcaatcaggagcagaagtaaaaaaaccaggctcatccgtcaaagtgagttgtaaagcatcaggtggtacattctcatattactggatagaatgggtcagacaagcacccggacaaggactagaatggatgggagaaattctacccggatcaggaaccacaaacccaaacgaaaaatttaaaggacgagtaacaataacagcagacgaatcaacatccacagcatacatggaattatcctctctaaggtctgaagacacagcagtatattactgtgccagagcagactattacggatctgattatgtaaaatttgactactggggacaaggaacactagtaaccgtatcctcagcatcaaccaaaggaccatcagtatttccattagcaccatcatccaaatccacatctggaggtacggcagcattaggatgcttagtaaaagactactttccagaaccagtaaccgtatcgtggaactcaggagcactaacttccggagtacacacatttccagcagtactacaatcatccggtctatactccctaagttcagtagtcactgttccatcatcatctctaggaacacaaacatacatatgcaacgtaaaccataaaccatctaacacgaaagtagataaacgcgtagaaccaaaatcatgtgataaaacacacacatgcccaccatgcccagcaccagaattattaggaggaccatcagttttcctatttccaccaaaaccaaaagacactctaatgatttcaagaacaccagaagtaacatgtgtcgtagttgatgtatcacatgaagacccagaagtaaaattcaactggtacgtggatggggtagaagtacacaatgcaaaaacaaaaccaagagaagaacaatataacagcacttatagagtagtaagcgtactaacagtattacaccaagactggttaaacggtaaagaatacaaatgtaaagtaagtaataaagcactacccgccccaatcgaaaaaactatatctaaagccaaaggacaaccacgtgaaccacaagtctacacattacccccaagcagggaagaaatgactaaaaaccaagtaagtctaacatgcttagtaaaaggattctacccatccgatatagcagtagaatgggaatcaaacggccaaccagaaaataattataaaacaacacctccagtattagacagtgacggatcatttttcttatattcaaaattaacagtagataaatcaagatggcaacaaggaaacgtattctcatgttcagtaatgcacgaagcattacataatcactatactcaaaaatcattaagcttatcaccaggaaaa

SEQ ID NO: 46113 - RNA, 642 nt, synthetic construct
  misc_feature 1..642: note = derived and/or modified sequence opt6 from Enokizumab_LightChain1
  source 1..642: mol_type = other RNA
gatatacaaatgacacaatcaccatcatcactatcagcatcagtaggagatagagtaacaataacatgcaaagcatcacaacacgtaataacacatgtaacctggtaccaacaaaaaccaggaaaagcaccaaaactcttaatatacggaacatcatacagctactccggagtaccatccagattctcaggatcaggatcaggaacagacttcacactaacaatatcatccctacaaccagaagacttcgcaacatactactgccaacaattctacgaatacccactaacattcggaggaggaacaaaagtcgaaataaaaagaacagtagcagcaccatcagtattcatattcccaccctcagacgaacaattaaaatcaggaacagcctcagtagtatgcctactaaacaacttctacccaagagaagcaaaagtacaatggaaagtcgataacgcactacaatcaggaaactcacaagaaagcgtaacagaacaagactcaaaagactccacttacagcctatcatcaacactaacactatcaaaagcagactacgaaaaacacaaagtatatgcatgcgaagtcacacaccaaggactatcctccccagtaacaaaatcattcaacagaggcgaatgc

SEQ ID NO: 46114 - RNA, 612 nt, synthetic construct
  misc_feature 1..612: note = derived and/or modified sequence opt6 from Enokizumab_LightChain
  source 1..612: mol_type = other RNA
gacatacaaatgacacaatcaccatcatccctatccgcatcagtaggagacagagtaacaataacatgcaaagcatcacaacacgtaatcacacacgtaacctggtaccaacaaaaaccaggaaaagcaccaaaactactaatatacggcacatcatactcatactccggagtaccatcaagattctcaggatcaggatccggaacagacttcacattaacaataagcagcctacaaccagaagacttcgccacatactactgccaacaattctacgaatacccactaacattcggaggaggaacaaaagtagaaataaaacgaacagtagcagcaccatcagtattcatattcccaccatcagacgaacaactaaaatctggaacagcatcagtagtatgcctactaaataacttctacccaagagaagctaaagtacaatggaaagtagaatcagtcacagaacaagactcaaaagactcaacatactccctatcatcaacattaacattatcaaaagcagattacgaaaaacacaaagtatacgcatgcgaagtaacacaccaaggactatcatcaccagtaacaaaatcattcaacagaggagaatgc

SEQ ID NO: 46115 - RNA, 1356 nt, synthetic construct
  misc_feature 1..1356: note = derived and/or modified sequence opt6 from Enoticumab_HeavyChain1
  source 1..1356: mol_type = other RNA
caagtacaactagtcgaatctggaggaggagttgttcaaccaggaagatcattaagattatcatgtgcagcttctggcttcacattttcatcctacggaatgcactgggtcagacaagcaccaggaaaaggcttagaatgggtctcttttctatggtacgacggaactaacaaaaattacgtcgaatcagtaaaaggaagatttacaatatcaagagataattcaaaaaatatgttgtacttagaaatgaactcacttcgagcagaagacacagcagtttactactgcgcacgagaccatgacttcagatcaggatatgaaggatggttcgacccatggggacaaggaaccctagttaccgtctcctccgcatcaacaaaaggaccatctgtatttccattagcaccatcatctaaatctacaagcggcggaactgcagcactcggttgtctagtaaaagattacttcccagaaccagtcacagtatcctggaattcaggagcactaacatccggagtacatacattcccagcagtactacaatcatcaggactatattcattatcatctgtagtcaccgtaccatcatcatctcttggaacacaaacctatatatgcaacgttaaccataaaccaagtaacacaaaagtagacaaaaaagtagaaccaaaaagctgcgacaaaacacatacatgtccaccatgccccgccccagaattactaggaggtccatcagtctttttatttccgccaaaaccaaaagacacattaatgatatcaagaacaccagaagtaacatgcgttgtagtagacgtatcacacgaagaccctgaagtaaaatttaactggtatgtagatggtgtagaagtacataacgcaaaaaccaaaccaagagaagaacaatacaactcaacataccgagtagtatcagtactaacagtattacatcaagattggttaaatggtaaagaatataaatgcaaagtctcaaacaaagcactaccagcccccatagaaaaaacaatatcaaaagcaaaaggtcaaccaagagaacctcaagtatacacactacctccctcacgagatgaattaactaaaaatcaagtctccctaacatgcttagtaaaaggattttacccatcagatatagcagtagaatgggaatcaaacggccaaccagaaaataactacaaaactacacccccagtactagactcagacggatcattcttcctatacagcaaattaacagtagacaaaagcagatggcaacaaggcaacgtattctcttgctcagtaatgcacgaagcattacacaaccactacacccaaaaatcactatcattatcacccggt

SEQ ID NO: 46116 - RNA, 642 nt, synthetic construct
  misc_feature 1..642: note = derived and/or modified sequence opt6 from Enoticumab_LightChain1
  source 1..642: mol_type = other RNA
gaaatagtattaacacaatctccagcaacactatcactatcaccaggagaaagagcaacactatcctgcagagcatcacaatcagtctcatcttacctagcatggtaccaacaaaaaccaggacaagcaccaagactactaatatacgatgcatcaaacagagcaacaggaataccagcaagattctcaggctcaggctcaggaacagacttcaccttaacaataagctctttagaaccagaagactttgcagtatactactgccaacacagaagcaactggccaccaacattcggaggaggaacaaaagtagaaataaaacgtacagtcgcagcaccatcagtattcatattcccaccatcagacgaacaattaaaatcaggcacagcatcagtagtatgcttattaaacaacttttacccacgagaagcaaaagtacaatggaaagtagacaacgcactacaatcaggaaactcacaagaatcagtaacagaacaagactcaaaagactctacatactccttatcatcaacactaacactatcaaaagcagactatgaaaaacacaaagtatacgcatgcgaagtaacacaccaaggactatcatcaccagtaacaaaatcattcaacagaggagaatgc

SEQ ID NO: 46117 - RNA, 1329 nt, synthetic construct
  misc_feature 1..1329: note = derived and/or modified sequence opt6 from Ensituximab_HeavyChain1
  source 1..1329: mol_type = other RNA
caagtacaactcaaagaatccggaccagacctcgtagcaccatcacaatcattatcaataacatgtacagtatcaggcttctcattatcaaaattcggcgtaaattgggtaagacaaccaccaggaaaaggattagaatggttaggtgtaatatggggagacggatcaacctcatataattctggactaatatctcgactatcaataagtaaagaaaactcaaaatcacaagtattcctaaaacttaactcactacaagcagacgacacagccacatattattgtgtcaaaccaggaggagattattggggacacggaacttcagtaacagtatcatcagcatcaacaaaaggaccaagtgtcttccccctagcaccatcctcaaaatcaactagtggaggaactgcagccttaggatgccttgtaaaagattattttccagaaccagtaactgtttcttggaactcaggtgcattaacatccggagtccacacattcccagcagtactacaatcatccggaccatactcactatcatcagtagtaacagtaccctcatcatcattaggaacccaaacttatatatgcaatgtgaatcacaaaccaagcaacacaaaagtagacaaaaaagtcgaaccaaaatcatgcgataaaacacacacatgcccaccctgcccagcaccagaactattaggaggaccctctgtattcttattcccacccaaacccaaagacacacttatgatctcaagaacacccgaagtaacatgtgtagtcgtagacgtgtctcacgaagacccagaagtcaaattcaactggtacgtagacggagtcgaagtacacaacgcaaaaactaaaccaagagaagaacaatataattcaacataccgcgtagtatcagtactaacagtattacatcaagactggctaaatggaaaagaatataaatgtaaagtctctaacaaagccttaccagcacctatagaaaaaacaatatccaaagccaaaggacaaccacgagaaccccaagtatatacactacccccatcaagagatgaattaacaaaaaaccaagtatcattaacatgcttagtaaaaggcttctacccctcagacatagcagttgaatgggaatcaaatggacaaccagaaaacaactataaaacaatgccaccagtactagactcagacggctctttcttcctatattcaaaactaacagtcgataaatcccgatggcaacaaggaaatgtattctcatgctcagttatgcatgaagcattacacaaccattacacacaaaaaagtttatctctctcaccaggtaaa

SEQ ID NO: 46118 - RNA, 639 nt, synthetic construct
  misc_feature 1..639: note = derived and/or modified sequence opt6 from Ensituximab_LightChain1
  source 1..639: mol_type = other RNA
caagtagtactaacacaatcaccagtaatcatgtcagcatcaccaggagaaaaagtaacaatgacatgctcagcatcatcatcaatatcatacatgtattggtaccaacaaaaaccaggaacatcacccaaacgatggatatacgacacatcaaaactagcatccggagtaccagcaagattctcaggatccggatcaggaacatcctacagcctaacaatatcaaacatggaagcaggagacgcagcaacatactactgccaccaaagagactcatacccatggacattcggaggaggaacaaacttagaaatcaaaagaacagtcgcagcaccatcagtattcatatttccaccatcagacgaacaactaaaatccggaacagcatcagttgtatgcctattaaacaacttctacccaagagaagcaaaagtacaatggaaagtagacaacgcactacaatcaggaaactcacaagaatcagtaacagaacaagactcaaaagactccacatacagcctatcatccacactaacattatcaaaagccgactacgaaaaacacaaagtttacgcatgcgaagtcacacatcaaggactatcatcaccagtaacaaaaagcttcaacagaggagaatgc

SEQ ID NO: 46119 - RNA, 768 nt, synthetic construct
  misc_feature 1..768: note = derived and/or modified sequence opt6 from Ensituximab_SingleChain_variable_fragment
  source 1..768: mol_type = other RNA
atggcggaagtacaattagtagaaagcggagctgaagtaaaaaaaccaggagaaagcctaagaataagttgtaaaggatctggatgtataatatcaagttattggataagctgggttagacaaatgccaggaaaaggactagaatggatgggaaaaatagatccaggagattcatatataaattacagcccaagctttcaaggacatgtaacaataagtgcagacaaatcaataaatacagcatatcttcaatggaatagtttaaaagcaagtgatacagcaatgtattactgtgcaagaggagggagagattttggggatagttttgattattggggacaaggaacattagtaacagtaagttcaggaggaggaggatcaggaggtggaggaagcggaggaggcgggagtgatgtagtaatgacacaatcaccatcatttttaagtgcatttgtaggagatcgtataactataacatgtagagcatcaagtggaataagtagatatttagcatggtatcaacaagcaccaggaaaagcaccaaaattattaatatatgcagcaagcactctacaaacaggagtaccaagcagatttagtggatcaggaagtggaactgaatttacactaacaataaattcattacaaccagaagattttgcaacatattattgtcaacatctaaattcatacccattaacattcggtggaggaacaaaagtagatataaaaagagcagcagcactagaacatcaccatcatcatcat

SEQ ID NO: 46120 - RNA, 987 nt, synthetic construct
  misc_feature 1..987: note = derived and/or modified sequence opt6 from Entolimod_chain1
  source 1..987: mol_type = other RNA
atgagaggcagccaccaccaccaccaccacggaatggcaagtatgacaggaggacaacaaatgggaagagacctctacgacgatgacgacaaagacccaatggcacaagttataaacacaaactctctatcactactaacacaaaacaacttgaacaaaagccaatcatcattaagttcagcaatagaaagattaagctcaggactacgaataaactcagcaaaagacgacgcagcaggacaagcaatagcaaacagattcacatcaaatataaaaggattaacacaagcatcaagaaacgcaaatgacggaataagtatagcccaaacaacagaaggagcactaaatgaaataaacaataacctacaaagagtaagagaactctcagtccaagcaacaaacggaacaaacagtgactcagaccttaaatcaatacaagacgaaatacaacaaagactcgaagaaatagacagagtatcaaaccaaacccaatttaacggagttaaagtattaagccaagacaatcaaatgaaaatacaagtaggagcaaatgatggagaaaccataacaatagacttacaaaaaatagacgtaaaaagcttaggcctagacggattcaacgtaaactcaccaggaatatcaggaggaggaggaggaatattagattcgatgggaacactaataaacgaagacgccgcagcagcaaaaaaatcaacagcaaatccattagcatcaatagactccgcattaagtaaagtagacgcagtaagatcctcattaggagcaatacaaaacagattcgactcagcaatcacaaatttaggaaacacagtaacaaacttaaactcagcaagatcaagaatcgaagacgcagactacgcaacagaagtaagtaacatgtcaaaagcacaaatactacaacaagcagggacaagcgtattagcacaagcaaaccaagtaccacaaaatgtactatccttattaaga

SEQ ID NO: 46121 - RNA, 1338 nt, synthetic construct
  misc_feature 1..1338: note = derived and/or modified sequence opt6 from Epratuzumab_HeavyChain
  source 1..1338: mol_type = other RNA
caagtacaattagtacaatcaggagcagaagtaaaaaaaccaggctcatcagtaaaagtatcctgcaaagcctctggatacacatttacatcctactggttacattgggtccgacaagccccaggacaaggtcttgaatggataggctatatcaatccacgaaacgactatacagaatataaccaaaacttcaaagacaaagcaacaatcacagcagatgaatcaacaaacacagcatacatggaattaagctcactaagatccgaagacacagcattctatttttgcgcaagaagagacataacaacattttactggggacaaggcacattggtaacagtatcatcagcatctaccaaaggaccatcagtcttcccactagcaccctcaagcaaatccacaagcggaggaacagctgcactaggatgtctagtaaaagactacttcccagaaccagtcacagtctcatggaactcaggagcattaacctcaggcgtacacaccttcccagcagtactacaatcctcaggactatactcattatcaagtgttgtcacagttccctcatcatcactaggtacacaaacatacatatgcaacgtaaaccataaaccatcaaatacaaaagtagataaaaaagtagaaccaaaatcctgtgacaaaacacacacatgcccaccctgcccagcaccagaactattaggaggaccttctgtattcctttttccaccaaaacccaaagacaccctcatgatcagcagaacacccgaagtaacttgtgtagtcgtagacgtatcacatgaagatccagaagtaaaatttaactggtacgttgacggagtagaagtacataacgcaaaaacaaaaccacgagaagaacaatacaactctacatatagagtcgtatccgtactaacagtactccaccaagactggctaaacggaaaagaatacaaatgtaaagtatctaacaaagcattacctgcacccattgaaaaaaccatatctaaagcaaaaggacaaccaagagaaccacaagtatacacactaccaccatctcgcgatgaactaacaaaaaaccaagtatcactaacttgcttagtaaaaggattctacccaagcgatatagcagtggaatgggaatcaaatggacaaccagaaaacaactacaaaacaacacctccagtactagattcagacggatccttctttctatactctaaattaacagtagataaatcaagatggcaacaaggaaatgtcttctcatgctcagtaatgcacgaagcactacacaatcattatacacaaaaatcactctccctatcaccaggcaaa

SEQ ID NO: 46122 - RNA, 657 nt, synthetic construct
  misc_feature 1..657: note = derived and/or modified sequence opt6 from Epratuzumab_LightChain
  source 1..657: mol_type = other RNA
gacatacaactaacccaatcaccatcatccctatcagcatcagtaggagacagagtaacaatgtcttgcaaatcaagtcaatcagtactatactcagcaaaccacaaaaactatctagcatggtaccaacaaaaacccggcaaagcaccaaaactattaatatactgggcatcaacaagagaatcaggagtaccatcacgcttctcaggatcaggatcaggaacagacttcaccttcacaatatcatcattacaaccagaagacatagcaacatattactgccaccaatacttatcatcatggacatttggacaaggaacaaaagtagaaataaaaagaacagtagcagcaccatcagtattcatattcccaccatcagacgaacaactaaaatcaggcacagcctccgtagtatgcctactaaacaatttttacccaagagaagcaaaagtacaatggaaagtagacaacgcacttcaatcaggaaactcacaagaatccgtaaccgaacaagactcaaaagactcaacatactcattatcatccaccctaacactatcaaaagcagactacgaaaaacacaaagtatacgcatgcgaagtaacacaccaaggcctatcttcaccagtaaccaaatcattcaacagaggagaatgt

SEQ ID NO: 46123 - RNA, 762 nt, synthetic construct
  misc_feature 1..762: note = derived and/or modified sequence opt6 from Eptacog_beta_HeavyChain1
  source 1..762: mol_type = other RNA
atagtaggaggaaaagtatgtccaaaaggtgaatgcccatggcaagtactattactagtaaatggagcacaattatgtggaggaacattaataaacacaatatgggtagtatcagcagcacactgttttgataaaataaaaaattggagaaatttaatagcagtactaggagaacatgatctaagtgaacatgatggagatgaacaaagtcgacgagtagcacaagtaataataccatcaacatatgtaccaggaacaacaaatcatgacatagcactattaagattacaccaaccagtagtactaacagatcatgtagtaccattatgtttaccagaaagaacattttcagaaagaacattagcttttgtaagattctccctagtatcaggatggggacaactactagatagaggagcaacagcattagaattaatggtattaaatgtaccaagactaatgacacaagattgtttacaacaatcaagaaaagtaggagattcaccaaatattacagaatatatgttctgtgccggatattcagatggaagcaaagatagttgtaaaggagacagtggaggaccacatgcaacacattatagaggaacatggtatttaacaggaatagtatcatggggacaaggatgtgctacagtaggacattttggagtttatacaagagtaagtcaatatatagaatggctacaaaaattaatgagatcagaaccaagaccaggagtactactaagagcaccatttcca

SEQ ID NO: 46124 - RNA, 456 nt, synthetic construct
  misc_feature 1..456: note = derived and/or modified sequence opt6 from Eptacog_beta_LightChain1
  source 1..456: mol_type = other RNA
gcaaacgcattcttagaagaactaagaccaggaagcctagaaagagaatgtaaagaagaacaatgctcattcgaagaagcaagagaaatatttaaagacgcagaaagaacaaaattattctggatatcatactcagacggagaccaatgcgcaagcagtccatgtcaaaatggaggaagctgtaaagaccaattacaaagttacatatgcttttgcctaccagcattcgaaggaagaaactgtgaaacacacaaagacgaccaattaatatgcgtaaatgaaaatggaggatgcgaacaatactgctcagaccatacaggaacaaaaagatcatgcagatgccatgaaggatactcattactagcagacggagtaagctgtacaccaacagtagaatatccatgcggaaaaataccaatattagaaaaaagaaatgcatcaaaaccacaaggaaga

SEQ ID NO: 46125 - RNA, 708 nt, synthetic construct
  misc_feature 1..708: note = derived and/or modified sequence opt6 from Erlizuab_HeavyChain1
  source 1..708: mol_type = other RNA
gaagtacaattagtagaatcaggaggaggactagtacaaccaggaggatcactaagattatcatgcgcaacaagcggatacacattcacagaatatacacattggagacaagcaccaggaaaaggactcgaatgggtagcaggaataaatccaaaaaacggaggaacatcacataaccaaagatttgacagattcacaatatcagtagacaaaagcacatcaacagcttaccaaaactcattaagagcagaagacacagcagtatactattgtgcaagatggagaggattaaactacggattcgacgttagatactttgacgtatggggacaaggaacactagtaacagtatcatccgcatcaacaaaaggaccatcagtattcccattagcaccatcatcaaaaagtacatcaggaggaacagctgcattaggatgtctagttaaagactacttcccagaaccagtaacagtatcatggaactctggagcattaacaagcggagtacacacatttcctgcagtattacaaagcagcggactatattcattatcaagtgtagtaacagtaccaagctcatcattaggaacacaaacatacatatgcaacgtaaaccataaaccatcaaatacaaaagtagataaaaaagtagaacctaaatcatgtgataaaacacacacatgtcccccatgcccagcaccagaatta

SEQ ID NO: 46126 - RNA, 639 nt, synthetic construct
  misc_feature 1..639: note = derived and/or modified sequence opt6 from Erlizuab_LightChain1
  source 1..639: mol_type = other RNA
gacatacaaacacaatcaccctcatcactatccgcatccgtaggagaccgagtaacaataacatgcagagcctcacaagacataaacaactacctaaactggtaccaacaaaaaccaggaaaagcaccaaaattactaatctactacacatcaacactacactcaggagtcccatcaagattctcaggatcaggctcaggaacagactacacactaacaatatcatcactacaaccagaagacttcgcaacctactactgccaacaaggaaacacactaccaccaacattcggacaaggaacaaaagtagaaataaaacgaaccgtagcagccccatccgtattcatattcccaccatcagacgaacaactaaaatcaggaacagcatcagtagtatgcctactaaacaacttctacccacgagaagcaaaagtacaatggaaagtagacaacgcactccaatcaggaaactcacaagaatcagtaacagaacaagactcaaaagactcaacatactccttatcatcaacactaaccctatcaaaagcagattacgaaaaacataaagtatacgcatgcgaagtaacacaccaaggactatcatctccagtaacaaaatcattcaacagaggagaatgc

SEQ ID NO: 46127 - RNA, 1341 nt, synthetic construct
  misc_feature 1..1341: note = derived and/or modified sequence opt6 from Etaracizumab_HeavyChain1
  source 1..1341: mol_type = other RNA
caagtccaattagtcgaatcgggcggtggagtagtccaaccaggaagatcactaagattatcgtgtgcagcatccggattcactttctcctcatacgatatgtcatgggtccgccaagcacccggaaaaggattagaatgggtagctaaagtatcatccggtggaggatctacatattatttagacaccgttcaaggaagattcacaatatcaagagacaactcaaaaaatactctttatctccaaatgaactcactacgcgccgaagacactgcagtctactactgcgcacgtcacctccatggctcattcgcatcatggggccaaggaacaactgtaacagtctcatcagcatcaactaaaggaccatctgtattccccttagcaccatcaagcaaatcaacatcaggtggaactgcagcactaggctgtctagttaaagattacttccctgaaccagttacagtatcatggaatagtggcgcattaacttcaggtgtacacacattcccagcagtactacaatcatccggattatattctttatcatcagttgtcacagtcccatcctcctcattaggaacacaaacctatatatgtaacgtaaaccacaaaccaagcaatacaaaagtagataaaagagtagaaccaaaatcatgcgataaaacacacacatgccccccttgcccagcacctgaattattaggaggaccctcagtatttctatttccccccaaaccaaaagacacactaatgatatcaagaacaccagaagttacatgcgtagtagtagacgtatcccatgaagatccagaggtcaaatttaactggtatgttgatggcgtggaagtacacaatgctaaaacaaaaccaagagaagaacaatacaactcaacataccgagtagtatcagttctcacagttttacaccaagactggttaaatggaaaagaatacaaatgtaaagtatcaaataaagctctaccagcaccaatagaaaaaacaataagcaaagcaaaaggacaacccagagaaccacaagtctatacattacccccatctagagaagaaatgacaaaaaaccaagtatcattaacatgtttagtaaaaggattctacccatcagacatcgcagtagaatgggaatccaacggtcaaccagaaaataactacaaaacaacacctcccgttttagattctgacggatcattcttcctttactcaaaattaacagtagacaaatcccgatggcaacaaggaaacgtattcagttgttcagtaatgcatgaagcacttcacaatcattacacacaaaaatccttatctttatctccaggcaaa

SEQ ID NO: 46128 - RNA, 642 nt, synthetic construct
  misc_feature 1..642: note = derived and/or modified sequence opt6 from Etaracizumab_LightChain1
  source 1..642: mol_type = other RNA
gaaatagtattaacacaatcaccagccacactatcactatccccaggagaacgagcaacactatcctgccaagcatcacaatcaatatcaaacttcctacactggtaccaacaaagaccaggacaagcaccaagactactaataagatacagatcacaatcaatatcaggaataccagcaagattctcaggatcaggatcaggaacagacttcaccctaacaatatcatcactcgaaccagaagacttcgcagtctactactgccaacaatcaggctcatggccattaacattcggaggcggaacaaaagttgaaataaaaagaacagtagcagccccatcagtattcatattccccccatcagacgaacaattaaaatcaggaacagcatcagtagtatgcctactaaacaacttctacccaagagaagcaaaagtacaatggaaagtagacaacgcattacaatccggaaactcacaagaatcagtaaccgaacaagactcaaaagactcaacatactcactatcatcaacactaaccctatccaaagccgactacgaaaaacacaaagtatacgcatgcgaagtaacacaccaaggactatcatcaccagtaactaaatccttcaacagaggcgaatgc

SEQ ID NO: 46129 - RNA, 1326 nt, synthetic construct
  misc_feature 1..1326: note = derived and/or modified sequence opt6 from Etrolizuab_HeavyChain1
  source 1..1326: mol_type = other RNA
gaagtacaattagtagaatcaggaggtggattagtacaaccaggtggatctcttagactttcatgcgcagcatcaggctttttcataacaaataattactggggctgggttagacaagcacccggaaaaggactagaatgggtaggctacatatcttactcaggatcaacctcatacaatccatcacttaaatcacgattcacaatatcaagagacacatccaaaaacacattttatctacaaaactcactaagagcagaagatacagccgtatactactgtgccaggacaggatcatcaggatactttgacttctggggacaaggaacactagtaacagtatcttcagcctcaacaaaaggaccatctgtttttccattagcaccatcatctaaatctacctcaggaggcacagccgccttaggatgcctagttaaagattacttcccagaaccagtaaccgtttcttggaactcaggagcactaacttcaggcgtacacactttcccagcagtactacaatcctcaggcctatattcactctcaagcgtagtaacagttccatcatcatccctaggcacacaaacctacatatgcaatgtaaaccataaaccatcaaacaccaaagtagacaaaaaagttgaaccgaaatcatgcgacaaaactcacacatgtccaccttgtccagcacccgaactactaggtggaccatcggtattcctattcccaccaaaacctaaagatacactaatatctagaaccccagaagtcacatgtgttgtagttgacgtatcacacgaagatccagaagtcaaattcaactggtatgtcgatggagtagaagtacacaatgccaaaacaaaaccaagagaagaacaatataactcaacctacagagtagtatcagtactaacagtattacatcaggactggttaaacggaaaagaatacaaatgcaaagtatctaacaaagccctaccagccccaattgaaaaaacaatatcaaaagcaaaaggacaaccaagagaaccacaagtatatacactccccccaagtagagaagaaacaaaaaaccaagtatcacttacatgcttagtaaaaggattctatccatcagacatagcagttgaatgggaatccaacggacaaccagaaaataactataaaactacccctccagttttagattcagatggatccttcttcctctactccaaattaacagtagacaaatcaagatggcaacaaggaaatgtattctcatgttcagtacacgaagcactacacaatcactatacacaaaaatcattatccctctccccaggt

SEQ ID NO: 46130 - RNA, 1326 nt, synthetic construct
  misc_feature 1..1326: note = derived and/or modified sequence opt6 from Etrolizuab_HeavyChain2
  source 1..1326: mol_type = other RNA
gaagtacaattagtcgaaagcggaggaggtctagtacaaccaggaggctcattacgactatcatgcgcagcatcaggctttttcataacaaacaattactggggttgggtcagacaagcaccaggcaaaggattagaatgggtcggctacataagttattctggatccacatcttataatccatcaaaactatctagatttacaatatcaagagatacttcaaaaaacaccttctacttacaaaactccctaagagcagaagacacagcagtatactactgcgcacgtactggatcctccggatatttcgacttctggggacaaggaacattagtaacagtatcatcagcatcaactaaaggaccctcagtattccctcttgcaccctcatccaaatccactagcggaggcacagcagcactaggatgcttagtaaaagactacttccctgaacccgttactgtatcttggaactcaggagcactaacatcaggagtacatacattcccagcagtactccaatcatctggcttatactcactatcttcagttgtcactgtaccatcttcatcactcggaacacaaacatacatatgcaatgtaaatcacaaaccatccaacactaaagttgacaaaaaagtagaacccaaatcttgcgataaaacacacacatgcccaccttgcccagcaccagaactattaggaggaccctcagtatttttatttccaccaaaaccaaaagacaccctaatatctagaacaccagaagtcacatgcgtcgtagtagacgtatctcacgaagacccagaagtaaaatttaactggtacgtagacggagtagaagtacacaacgcaaaaacaaaaccaagagaagaacaatataactcaacatacagagtagtatcagtattaacagtactccatcaagactggttaaacggcaaagaatacaaatgcaaagtatcaaacaaagcattaccagcaccaatagaaaaaacaatctctaaagcaaaaggacaaccaagagaaccacaagtttacacactaccaccatcacgtgaagaaacaaaaaaccaagtttcattaacatgtttagtcaaaggattctatccttcagatatagctgtagaatgggaatcaaatggccaaccagaaaacaattacaaaactacaccaccagtactagattcagatggctccttcttcctctactctaaactcacagtagataaatccaggtggcaacaaggaaatgtattttcatgctcagtacacgaagcactacacaaccactatacacaaaaatctctatcattatccccaggt

SEQ ID NO: 46131 - RNA, 639 nt, synthetic construct
  misc_feature 1..639: note = derived and/or modified sequence opt6 from Etrolizuab_LightChain1
  source 1..639: mol_type = other RNA
gacatacaaacacaatcaccatcaagcttatcagcatcagtaggagacagagtaaccataacctgcagagcaagcgaatcagtagacgatctcttacactggtaccaacaaaaaccaggaaaagcaccaaaattactaataaaatacgcatcacaatcaataagcggagtaccatcacgattctccggatcaggctcaggaacagacttcacactaacaatatcatcactacaaccagaagacttcgcaacatattactgccaacaaggaaactcattaccaaacacattcggacaaggcacaaaagtagaaataaaaagaacagtcgcagcaccatcagtattcatattcccaccctcagacgaacaattaaaatcaggaacagcatcagtagtatgcttactcaacaacttctacccaagagaagcaaaagtacaatggaaagtagacaatgcactacaatccggaaactcacaagaatcagtaacagaacaagactcaaaagactccacctactccttatcatcaacactaacattaagcaaagccgactacgaaaaacacaaagtatacgcatgcgaagtcacacaccaaggactatcatcaccagtaacaaaatcattcaacagaggagaatgc

SEQ ID NO: 46132 - RNA, 1338 nt, synthetic construct
  misc_feature 1..1338: note = derived and/or modified sequence opt6 from Etrolizumab_HeavyChain1
  source 1..1338: mol_type = other RNA
gaagtacaattagtagaatctggaggaggcctggtccaaccaggaggatcactaagactctcctgtgcagcatcaggattttttattacaaacaactactggggctgggtcagacaagcacccggaaaaggtcttgaatgggtaggatacatttcatactcaggctctacctcttataatccttctttaaaatctagatttacaatatcaagagacacatcaaaaaacacattctatctccaaatgaactcactaagagcagaagacacagctgtttattattgtgcacgaaccggatcctctggttacttcgatttttggggacaaggaacactagtaacagtatcctcagcaagtacaaaaggcccaagcgtttttccactagccccatcctcaaaatccacttctggaggaacagcagcactaggatgtttagtcaaagactacttcccagaaccagtaacagtatcatggaactctggggcactaacctcaggagtccacacctttcccgcagtactacaatcttccggactttactcattatcctcagtagtaacagtaccatcctcaagtctaggaacacaaacatacatatgcaacgtaaaccacaaaccatcaaacactaaagtagataaaaaagtagaaccaaaatcatgtgataaaactcacacatgtccaccatgcccagcaccagaactactaggaggaccatcagtattcttattcccaccaaaaccaaaagatacattaatgatctcacgcacaccagaagtcacatgtgtagtagtagacgtatcccacgaagacccagaagtcaaattcaactggtacgtcgatggagtcgaagtacataacgcaaaaacaaaacccagagaagaacaatataactcaacttacagagtcgtaagtgtactaacagtactacaccaagattggttaaacggaaaagaatacaaatgcaaagtttccaacaaagcattacctgcaccaatagaaaaaacaatatcaaaagcaaaaggacaaccacgcgaaccacaagtatacacattaccaccatcacgagaagaaatgacaaaaaaccaagtatcactaacatgccttgtaaaaggcttttacccatcagatattgcagtcgaatgggaatcaaacggtcaacctgaaaataactacaaaacaacaccacccgtattagactcagacggaagctttttcttatactcaaaactaacagtagacaaatcaagatggcaacaaggaaatgttttctcctgctcagtaatgcacgaagccttacacaaccactacacacaaaaatcattatcattatcaccagga

SEQ ID NO: 46133 - RNA, 642 nt, synthetic construct
  misc_feature 1..642: note = derived and/or modified sequence opt6 from Etrolizumab_LightChain1
  source 1..642: mol_type = other RNA
gacatacaaatgacacaatcaccatcatctctatcagcatctgtaggagatagagtaacaataacctgcagagcatccgaaagcgtagacgacctactacactggtaccaacaaaaaccaggaaaagcaccaaaattactaataaaatacgcatcacaatccataagcggagtcccatcaagattctcaggatcaggatcaggaacagacttcaccctaacaataagctcactacaacccgaagactttgcaacttactactgccaacaaggaaactccctcccaaacacattcggacaaggaaccaaagtagaaataaaaagaacagtagcagcaccatcagtattcatattcccaccctcagacgaacaactaaaatcaggaacagcctcagtagtatgcttactaaacaacttctacccaagagaagcaaaagtacaatggaaagtagacaacgcactccaatccggaaactcacaagaatcagtaacagaacaagactcaaaagactcaacatactcactatcatcaacattaacactaagcaaagccgactacgaaaaacacaaagtatacgcatgcgaagtaacacatcaaggactatcatcaccagtaaccaaatcattcaacagaggagaatgc

SEQ ID NO: 46134 - RNA, 1359 nt, synthetic construct
  misc_feature 1..1359: note = derived and/or modified sequence opt6 from Evinacumab_HeavyChain1
  source 1..1359: mol_type = other RNA
gaagttcaactagttgaatcaggaggcggagtaatccaaccaggaggttcactacgattatcatgtgctgcaagtggattcacatttgacgactacgcaatgaattgggtaagacagggaccaggcaaaggacttgaatgggtatcagcaatttcgggcgatggaggcagcacatattatgctgattcagtaaaaggaaggttcacaatcagtagagataacagtaaaaattcattatacttacaaatgaactcattaagagcagaagacacagcattcttctattgcgcaaaagatttaagaaatacaatatttggagtagtaataccagatgcctttgatatttggggtcaaggaacaatggtaaccgtcagttcagcatcaactaaaggaccaagtgtatttccattagcaccatgttccagaagcacatcagaaagtaccgcagctttaggatgcttagtaaaagactacttcccagaaccagtaactgtaagttggaactcaggagcactaacatcaggtgtacatacatttccagcagtcctacaatcatcaggattgtattcactatcatccgtcgtcacagtaccatcctcatcattaggaacaaaaacttacacctgtaatgtagaccataaaccatcaaatacaaaagtagacaaaagagtagaaagcaaatacggaccgccatgtccaccatgcccagcacctgaattcttaggaggaccatccgtttttttattcccaccaaaaccaaaagatacactaatgatatctagaacaccagaagtaacatgtgtagtagtagacgtatcacaagaagatccagaagttcagttcaactggtacgtcgacggagttgaagttcacaatgccaaaacaaaaccaagagaagaacaatttaattctacctatagagtagtatcagtattaacagttttacatcaagattggttaaatggaaaagaatacaaatgtaaagtatccaacaaaggattaccaagcagcatagaaaaaaccatatctaaagctaaaggccaaccaagagaacctcaagtttatacactcccaccaagccaagaagaaatgaccaaaaaccaagtctcattaacatgtctagtcaaaggattttatccaagtgacattgcagtagaatgggaatcaaacggccaaccagaaaataattataaaacaacccctccagtactagattcagacggatcattttttctatattctagattaacagtagacaaaagtagatggcaagaaggaaacgtattctcatgttctgtcatgcatgaagcactacacaaccactacacacaaaaatcattatctctatccctaggaaaa

SEQ ID NO: 46135 - RNA, 642 nt, synthetic construct
  misc_feature 1..642: note = derived and/or modified sequence opt6 from Evinacumab_LightChain1
  source 1..642: mol_type = other RNA
gacatacaaatgacacaatcaccatcaaccctatcagcatcagtaggagacagagtaacaataacctgcagagcaagccaatcaataagatcatggctagcctggtatcaacaaaaacccggaaaagcaccaaaactattaatatacaaagcatcatcactagaatcaggagtcccatcaagattctctggatcaggatcaggaacagaattcaccttaactatatcctcactccaacccgacgacttcgccacatactattgccaacaatacaactcatactcatacacattcggacaaggaaccaaactagaaataaaaagaacagtcgcagcaccatcagttttcatcttcccaccatcagacgaacaactaaaatcaggaacagcctcagtagtatgcttacttaacaacttttacccaagagaagcaaaagtacaatggaaagtagacaacgcactccaatccggaaactcacaagaatcagtaacagaacaagactcaaaagactcaacatactcactatcatcaacactaacattatcaaaagccgactacgaaaaacacaaagtatacgcatgcgaagtaacacaccaaggattatcatcaccagtaacaaaatcattcaacagaggcgaatgc

SEQ ID NO: 46136 - RNA, 1323 nt, synthetic construct
  misc_feature 1..1323: note = derived and/or modified sequence opt6 from Evolocumab_HeavyChain1
  source 1..1323: mol_type = other RNA
gaagtacaactagtacaatcaggagcagaagtaaaaaaaccaggagcaagtgtaaaagttagctgtaaagcatcaggttatacattaacatcatatggtatatcatgggtaagacaagcaccaggacaaggactagaatggatgggatgggtaagtttctataatggaaatacaaattacgcacaaaaattacaaggaagaggaactatgacaactgatccatcaacaagcacagcatatatggaactacgatcacttaggtcagacgatacagcagtatattactgtgcaaggggatacggaatggacgtatggggtcaaggaacaacagtaacagtctcatcagcatcaacaaaaggaccatcagtctttccactcgccccatgttcaagaagtaccagtgaatctacagctgcactaggatgcctagtaaaagactactttccagaaccagtaacagtatcatggaactcaggcgcattaacctcaggagtacacacctttccagcagtgttacaatctagtggattatattcattatcaagtgtagtaacagtaccatctagtaatttcggaacacaaacatacacatgcaacgtagatcataaaccaagtaatactaaagtagacaaaacagtagaaagaaaatgctgtgtagaatgcccaccatgtccagcaccacccgtcgcaggacctagcgtattcttattcccacctaaaccaaaagacactctaatgatttcaagaacacccgaagtcacatgcgtagtagtagatgtaagccatgaagatccagaagtacagttcaattggtacgtagatggagtagaagtacacaacgcaaaaacaaaaccacgtgaagaacagtttaacagcacattccgagtagtatcagtattaacagtagtacatcaagactggttaaatggaaaagaatataaatgcaaagtaagtaataaaggccttccagcaccaatagagaaaacaataagtaaaacaaaaggacaaccaagagaaccccaagtctacaccctaccaccatcaagagaagaaatgacaaaaaatcaagtaagtttaacctgtctcgtaaaaggattttatccaagcgacatagctgtagaatgggaatcaaatggacaacctgaaaataattacaaaacaacacctcctatgctagactcagatggatcatttttcttatactcaaaactaacagtagataaatcaagatggcaacaaggaaatgtattttcatgctcagtaatgcatgaagctttacataatcactacactcaaaaatcattatcactatcaccaggaaaa

SEQ ID NO: 46137 - RNA, 645 nt, synthetic construct
  misc_feature 1..645: note = derived and/or modified sequence opt6 from Evolocumab_LightChain1
  source 1..645: mol_type = other RNA
gaatcagcactaacacaaccagcatcagtatcaggatcacccggacaatcaataacaatatcatgcacaggaacatcatcagacgtaggcggatacaattcagtatcatggtaccaacaacacccaggaaaagcaccaaaattaatgatatacgaagtatcaaacagaccttcaggagtatccaacagattctcaggctcaaaatcaggaaacacagcatcactaacaatatcaggactacaagccgaagacgaagcagactactactgcaactcatacacatcaacctcaatggtattcggaggaggcactaaactaactgtactaggacaacccaaagcagcaccctcagtaacactattcccaccatcatcagaagaactacaagccaacaaagcaacactagtatgcctcatatcagacttctacccaggcgcagtaacagtagcatggaaagcagactcatcaccagtaaaagcaggcgtagaaaccacaacaccatcaaaacaatcaaacaataaatacgcagcatcatcatacttatcactaacaccagaacaatggaaatcccacagatcatactcatgccaagtaacacacgaaggatcaacagtagaaaaaacagtagcacctacagaatgctca

SEQ ID NO: 46138 - RNA, 1353 nt, synthetic construct
  misc_feature 1..1353: note = derived and/or modified sequence opt6 from Exbivirumab_HeavyChain1
  source 1..1353: mol_type = other RNA
caagtacaattagtagaatcaggtggtggagttgtccaaccaggaggctcactaagactatcatgtgcaccatcaggattcgtcttcagatcatatggaatgcattgggttagacaaactcccggtaaaggtctcgaatgggtatcattaatatggcacgacggatcaaatagattctacgcagattcagtcaaaggacgattcaccatatcacgagacaattcaaaaaacacactttacctacaaatgaattcactaagagcagaagacacagccatgtacttctgtgccagagaaagattaatcgcagcaccagcagcattcgacctatggggacaaggtacacttgtaaccgtatcatccgcatccacaaaaggaccatccgtattcccactcgcaccttcatcaaaatcaacatctggaggaaccgctgcactaggatgccttgtaaaagactactttccagaaccggtaactgtatcatggaactcaggagccttaacttcaggagtacatacattcccagcagtattacaatcttcaggcctctactcactatcttcagttgtaacagtaccatcaagttcactaggaacccaaacttacatctgcaacgtaaaccacaaaccatccaacactaaagtagacaaaagagtagaaccaaaatcatgcgacaaaacacatacctgcccaccatgccccgcaccagaactattaggaggaccatcagtatttttattcccaccaaaacccaaagacacattaatgatatctcgaacacccgaagtaacatgcgtagttgttgacgtatcacatgaagacccagaagtaaaatttaattggtacgtagatggagtagaagtacacaacgccaaaacaaaaccacgagaagaacaatataactcaacatatagagttgtaagtgtcttaacagtattacatcaagactggctaaacggcaaagaatacaaatgcaaagtatctaataaagcattaccagcacctatagaaaaaacaatatccaaagccaaaggacaaccaagagaaccacaagtatacacattaccaccatcacgtgaagaaatgaccaaaaatcaagtctcattaacctgtttagtcaaaggattctatccatcagacatcgccgtagaatgggaatccaacggacaaccagaaaataattacaaaaccacaccaccagtactagactcagatggatccttctttttatattccaaactcacagtagacaaatcaagatggcaacaaggcaatgtattctcatgttcagtaatgcacgaagctctccataatcattacactcaaaaaagcctatccttatcaccaggtaaa

SEQ ID NO: 46139 - RNA, 642 nt, synthetic construct
  misc_feature 1..642: note = derived and/or modified sequence opt6 from Exbivirumab_LightChain1
  source 1..642: mol_type = other RNA
tcatacgtactaacacaaccaccatcagtatcagtagcaccaggaaaaacggctagaatatcatgcggtggaaacaacataggaacaaaaaacgtacactggtaccaacaaaaaccaggacaagcaccagtactagtagtatacgcagactcagatagaccatcaggaataccagaacgattcagcggatcaaactcaggaaacacagcaacactcacaatctcaagagtagaagcaggagacgaagcagactattactgccaagtatgggactcagtatcataccatgtagtattcggaggaggaacaacactaacagtattaggacaaccaaaagcagcaccaagtgtaacactatttccaccatcatcagaagaactccaagcaaacaaagccacactagtatgcctaatatccgatttttacccaggagcagtaacagtagcctggaaagcagactcctcaccagtaaaagcaggagtagaaacaacaacaccatcaaaacaaagtaacaacaaatacgcagcatcatcatacctatcactaacaccagaacaatggaaatcacacagatcatactcatgccaagtaacacacgaaggatcaacagtagaaaaaacagtagcaccaacagaatgctca

SEQ ID NO: 46140 - RNA, 1347 nt, synthetic construct
  misc_feature 1..1347: note = derived and/or modified sequence opt6 from Farletuzumab_HeavyChain1
  source 1..1347: mol_type = other RNA
gaagtacagttagtagaatccggaggtggagtagtacaacccggaagatcactaagactctcatgctcagcctcaggatttacattttcaggatacggattatcatgggtaagacaagcaccaggaaaaggactagaatgggtagcaatgatatcatcaggaggatcttatacatattatgccgactctgtaaaaggaagatttgcaatatcacgtgacaatgcaaaaaatacattgttcttacaaatggactccctcagaccagaagacactggcgtatacttctgcgctaggcatggagacgatccagcatggttcgcttattggggacaaggaactcctgttactgtaagctctgcaagcacaaaaggcccttcagtatttcctttagcaccctcgtccaaaagcacctcaggaggtactgctgcattaggatgtctcgtaaaagactattttcctgaaccagttactgtctcatggaattcaggagcactaacttcaggagtacacacattcccagcagtactacaaagttctggactatactcattatcatcagttgtaacagtaccaagttcaagcctaggaacccaaacttatatatgtaacgtcaaccataaaccatcaaacacaaaagtagacaaaaaagtagaaccaaaaagttgcgataaaacacatacttgcccaccatgcccagcaccagaactattaggaggaccaagtgtatttttattcccacctaaaccaaaggacacattaatgataagtaggacaccagaagtaacatgtgtcgtagttgatgtttcacatgaagatccagaagtaaaatttaattggtatgtagatggagtagaagttcataatgcaaaaacaaaacctcgagaagaacaatacaactctacttatcgagtagtatccgttttaacagtacttcatcaagattggttaaacggaaaagaatataaatgtaaagtatcaaataaagcattacccgccccaatagaaaaaacaatatcaaaagctaaaggacaaccaagagaaccacaagtatacacactaccaccttcaagagacgaactaaccaaaaatcaagtaagtttaacctgtctagtaaaaggcttttatccaagcgatatagcagtagaatgggaatcaaatggacaaccagaaaataattataaaactacaccaccagtactagattctgacggctcatttttcctatattctaaattaacagttgacaaatcaagatggcaacaaggaaatgtattttcatgctctgttatgcacgaagcattacataaccattatacacaaaaatcattatcattatcacccggtaaa

SEQ ID NO: 46141 - RNA, 651 nt, synthetic construct
  misc_feature 1..651: note = derived and/or modified sequence opt6 from Farletuzumab_LightChain1
  source 1..651: mol_type = other RNA
gacatacaactaacacaatcaccatcatcattatcagcatcagtaggagacagagtaacaataacatgctcagtatcatcctccatatcatcaaacaatctacactggtaccaacaaaaacccggaaaagcaccaaaaccatggatatacggaacatcaaacctagcatcaggagtaccatcaagattctcaggctcaggctcaggaacagactacaccttcacaatatcatcactacaaccagaagacatagcaacatactactgccaacaatggtcatcatacccatacatgtacacattcggacaaggaacaaaagtagaaataaaacgaacagtagcagcaccatctgtattcatcttcccaccatcagacgaacaactcaaatccggaacagcatcagtagtatgcctactaaacaacttctacccaagagaagcaaaagtacaatggaaagtagacaacgcactacaatcaggaaactcacaagaatcagtaacagaacaagactcaaaagactcaacatactcactatcctcaacactaacactatcaaaagcagactacgaaaaacacaaagtatacgcatgcgaagtaacacaccaaggactatcatcacccgtaacaaaatcattcaacagaggagaatgc

SEQ ID NO: 46142 - RNA, 1338 nt, synthetic construct
  misc_feature 1..1338: note = derived and/or modified sequence opt6 from Fasinumab_HeavyChain1
  source 1..1338: mol_type = other RNA
caagtccaattagtacaatcaggtgcagaagtaaaaaaaccaggagcatcagttaaagttagttgtaaagtatcaggtttcacattgacagaactatccatccattgggtacgacaagcaccaggtaaaggcctcgaatggatgggaggattcgatccagaagatggtgaaacaatatacgcacaaaaatttcaaggaagagtcacaatgacagaagatacatcaaccgacactgcatacatggaattaacatcccttagatcagaagatactgcagtatattactgttccacaatatttggagtagtaaccaattttgacaattggggacaaggaacgttagtcaccgtcagctcagcttctacaaaaggaccatcagtatttccactagcaccatgctctagatccacatcagaaagcacagcagcattaggatgtctagtaaaagactactttccagaaccagttaccgtatcatggaactctggagcacttacatccggtgtacatacctttccagcagtactccaatcaagcggactatatagtctaagctcagtagtaacagttccatcatcatctttaggtacaaaaacatacacctgtaacgtcgatcataaaccatcaaacacaaaagttgacaaaagagtagaatccaaatacggaccaccatgcccaccatgtccagctccagaattcttaggaggaccatcagtatttttatttccaccaaaacccaaagacactttaatgatttcaagaacaccagaagtcacatgtgtagtagtcgatgtctcacaagaagaccctgaagttcaatttaactggtacgtagacggagttgaagtacataatgcaaaaacaaaacctagagaagaacaattcaattcaacatatagagtagtatcagtattaactgtactacatcaagactggctcaatggaaaagaatataaatgtaaagtatcaaataaaggtctaccatcatcaatagaaaagacaatatcaaaagcaaaaggccaacccagagagccacaagtatataccttaccaccttcacaagaagaaatgactaaaaaccaagtctcattaacatgtctagtaaaaggattttatccatccgacatagcagtagaatgggaatctaatggacaaccagaaaacaactataaaacaacacctccagtactagattcagatggatcattttttctatattcacgactaactgtagataaatcaagatggcaagaaggaaatgtcttctcttgttcagtaatgcatgaagcactacacaatcattacacacaaaaaagtttatccctaagcctcggcaaa

SEQ ID NO: 46143 - RNA, 642 nt, synthetic construct
  misc_feature 1..642: note = derived and/or modified sequence opt6 from Fasinumab_LightChain1
  source 1..642: mol_type = other RNA
gatatacaaatgacacaatcaccatcatcactatcagcatcagcaggagacagagtaacaataacctgcagagcaagccaagcaataagaaacgacttaggatggtaccaacaaaaaccaggcaaagcacccaaaagactaatctatgcagcattcaacctacaatcaggagtaccatcaagattttcaggctcaggatcaggaacagaattcacattaacaatatcatcactacaaccagaagacctagcatcatactactgccaacaatacaacagatacccatggacattcggacaaggaaccaaagtagaaataaaaagaacagtcgcagcaccatcagtattcatattcccaccatccgacgaacaattaaaatccggaacagcatcagtagtatgcttactaaacaacttctacccaagagaagcaaaagtacaatggaaagtagacaacgcattacaatcaggaaactcacaagaatccgtaaccgaacaagactcaaaagactcaacatactcattatcatcaacattaacattatcaaaagcagactacgaaaaacacaaagtatacgcatgcgaagttacacaccaaggactaagctcaccagtaacaaaatcattcaacagaggagaatgc

SEQ ID NO: 46144 - RNA, 1350 nt, synthetic construct
  misc_feature 1..1350: note = derived and/or modified sequence opt6 from Fezakinumab_HeavyChain1
  source 1..1350: mol_type = other RNA
caagtccaactagtacaatcaggagcagaagtcaaaaaaccaggagcctccgtaaaagtatcttgcaaagcaagcggatacactttcacaaactattacatgcactgggtaagacaagcacccggacaaggtttagaatgggtcggctggataaacccatacactggatctgcattctatgcacaaaaattccgaggaagagtcacaatgacacgcgatacatctatatcaacagcatatatggaattaagtcgactaagatcagacgatactgctgtctattactgtgcaagagaaccagaaaaattcgactccgacgacagcgatgtatggggaagaggaacactagtaacagtaagctccgcctctacaaaaggaccaagcgtatttccactagcaccttcttcaaaatctacctccggaggaacagcagcattaggctgcttagtcaaagactacttcccggaaccagtaaccgtatcctggaattctggcgcactaacatcaggagttcacacttttccagctgttttacaatcaagtggactatactcattatcatcagtagtcacagtaccatcatcaagccttggaacacaaacatacatatgtaatgtaaaccataaaccatccaacacaaaagtagataaaaaagtagaacccaaatcctgtgataaaacccacacatgcccaccatgtccagcccccgaactactaggaggcccatctgtattcttattcccaccaaaaccaaaagacaccctaatgatttcaagaacaccagaagtaacatgcgtagtagtagatgtctcgcacgaagacccagaagtaaaatttaattggtatgtagacggagtcgaagtacacaatgccaaaacaaaaccacgagaagaacaatataattcaacatacagagtagtatctgtattaacagttctccaccaagactggctaaacggaaaagaatataaatgcaaagtatcaaataaagcactaccagccccaatagaaaaaaccatatcaaaagcaaaaggccagccaagagaaccacaagtatatacactaccaccatcacgagaagaaatgacaaaaaaccaagtatccctaacatgcctagtaaaaggattctacccctctgacatagcagtagaatgggaatcaaatggacaaccagaaaacaactataaaacaacaccaccagtcttagattcagatggatcattctttttatactcaaaattaactgtagacaaatcaagatggcaacaaggaaatgtattttcttgctctgtaatgcacgaagcattacacaatcattatactcaaaaatcactatcactctcaccagga

SEQ ID NO: 46145 - RNA, 651 nt, synthetic construct
  misc_feature 1..651: note = derived and/or modified sequence opt6 from Fezakinumab_LightChain1
  source 1..651: mol_type = other RNA
caagcagtattaacccaaccaccatcagtatcaggagccccaggacaacgagtaacaatatcatgcacaggatcatcatcaaacatcggagcaggatacggagtacactggtaccaacaattaccaggaaccgcaccaaaactattaatatacggagattcaaacagaccatcaggagtaccagaccgattctcaggatccaaatcaggaacctcagcatcactagcaataacaggactacaagcagaagacgaagccgactactactgccaatcatacgataactccttatcaggatacgtcttcggaggaggaacacaactaacagtattaggacaaccaaaagcagcaccatcagtaaccttattcccaccatcatcagaagaactacaagcaaacaaagctacactagtatgcctaatatcagacttctatccaggagcagtaacagtagcatggaaagctgattcatcaccagtaaaagcaggagtagaaacaaccacaccatcaaaacaatcaaataacaaatacgcagcatcatcatacctctcactcacacctgaacaatggaaatcacacagatcatactcctgccaagtaactcacgaaggatcaacagtcgaaaaaaccgtagccccaacagaatgctca

SEQ ID NO: 46146 - RNA, 1347 nt, synthetic construct
  misc_feature 1..1347: note = derived and/or modified sequence opt6 from FG-3019_HeavyChain1
  source 1..1347: mol_type = other RNA
gaaggacaattagttcaatcaggaggtggattagtacatccaggaggaagtttaagattatcatgcgcaggatcaggattcactttctccagttacggaatgcactgggttagacaagcaccaggaaaaggacttgaatgggtatcaggtatcggaacaggaggtggaacatattcaacagattcagtaaaaggacgatttacaatatccagagataacgccaaaaactcactatatttacaaatgaacagtttaagagcagaagacatggcagtatattactgcgcaagaggcgattattacggctcaggctcctttttcgattgttggggtcaaggtacattagtaactgtatcatcagcatcaacaaaaggaccttctgtatttccattagcaccatcaagtaaaagtacttccggtggaaccgcagcacttggatgcctagttaaagattactttccagaacctgtaactgtatcatggaactcaggagcactaacatcaggtgttcacacatttccagcagtattacaatcatcaggcttatatagcctaagttcagtagtaacagtaccatcatcatcactaggaacacaaacatacatatgtaacgttaatcataaaccatcaaatacaaaagtcgataaacgagtagaaccaaaatcatgtgacaaaacacatacctgtccaccatgcccagcaccagaacttttagggggaccaagcgtattcctattcccaccaaaaccaaaagacacactaatgatatccagaacaccagaagtgacatgtgttgtagtagacgttagccacgaggatccagaagtaaaatttaattggtacgtagacggcgtagaagtacataatgcaaaaacaaaaccaagagaagaacaatataactcaacatatagagtcgtatcagtcttaacagttttacaccaagattggttaaacggaaaagagtacaaatgcaaagtatcaaacaaagcattaccagcaccaatagaaaaaaccattagcaaagcaaagggacaaccaagagaaccacaagtatacacattaccaccatcaagagaagaaatgacaaaaaatcaagtgtcattaacatgcctagtcaaaggattctatccaagcgatatagccgtcgaatgggaatcaaatggtcaacctgaaaataattataaaacaactccaccagtactagactcagacggatcatttttcttatattctaaattaacagtagacaaatccagatggcaacaaggaaacgtcttctcatgttcagtaatgcacgaagcactacacaatcactatactcaaaaatctctatcactatctcctgga

SEQ ID NO: 46147 - RNA, 642 nt, synthetic construct
  misc_feature 1..642: note = derived and/or modified sequence opt6 from FG-3019_LightChain1
  source 1..642: mol_type = other RNA
gacatacaaatgacacaatcaccttcatcactatcagcatccgtaggagacagagtaacaataacatgccgagcatcacaaggaatatcctcatggttagcatggtaccaacaaaaaccagaaaaagcaccaaaatcactaatatacgcagcatcatcattacaatcaggagtaccaagcagattctcaggctcaggatcaggaacagacttcacactaaccatatcctcactacaaccagaagacttcgccacatactactgccaacaatacaactcatacccacccacattcggacaaggaacaaaactagaaataaaacgaacagtagcagcaccatcagtattcatattcccaccttcagacgaacaattaaaatcaggaacagcatcagttgtatgcctactaaataacttctacccaagagaagcaaaagtacaatggaaagtagacaacgcactacaatccggaaactcacaagaatcagtaacagaacaagactccaaagactcaacatattccttatcatctacattaacattatcaaaagcagattacgaaaaacacaaagtatacgcctgcgaagtaacccatcaaggactatcatcacccgtaacaaaatcattcaacagaggagaatgc

SEQ ID NO: 46148 - RNA, 1344 nt, synthetic construct
  misc_feature 1..1344: note = derived and/or modified sequence opt6 from Fibatuzumab_HeavyChain1
  source 1..1344: mol_type = other RNA
caagtacagttagtccaatcaggagccgaagtcaaaaaaccaggagcaagcgtaaaagtttcatgtaaagcaagcggatacacattcacaggctattggatgaactgggtaagacaagcaccaggtcaaggactagaatggatgggagatatatacccaggaagcggaaacacaaactatgacgaaaaatttcaaggaagagtaacaatgacaagagacacatcaatttcaaccgcatacatggaattaagtagattaagatcagatgatacagcagtatactactgtgcaagaggcggatactatgaagatttcgatagctggggacaaggaactacagtaacagtatcatcggcatcaacaaaaggacccagtgtattcccactagcgccatcatcaaaaagtacatccggaggcaccgcagcactaggctgcttagtcaaagactattttccagaaccagtaactgtttcctggaatagcggagcactaacatcaggagtacacactttcccagccgtactacaaagttctggcttgtactcactatcttcagtagtaacagtcccttcttcaagcttaggtacacaaacatatatttgcaatgtaaatcacaaaccttcaaataccaaagttgacaaacgagtggaaccaaaatcatgtgacaaaacacacacatgtccaccgtgcccagctccagaactcttaggaggcccatctgtctttctattcccacctaaacctaaagatacattaatgatatcaagaacaccagaagtaacatgtgtagtagttgatgtctcacacgaagatccagaagtaaaatttaattggtacgtagatggagtagaagtacacaacgctaaaacaaaaccgcgagaagaacaatataattcaacatacagagtagtaagcgtactaacagtactacaccaagactggctaaacggaaaagaatacaaatgtaaagtaagcaataaagcactcccagcacctatagaaaaaaccatatcaaaagcaaaaggacaaccaagagaaccacaagtatatacactaccaccaagtagagaagagatgacaaaaaatcaagttagcctaacctgtctagtaaaaggattctatccttctgatatagcagtagaatgggaatctaatggacaaccagaaaataactacaaaacaacaccaccagtactagacagtgatggatctttcttcctatactcaaaactaacagtagataaatcaagatggcaacaaggaaatgtattttcctgttcagtgatgcacgaagcattacataaccactatacacaaaaaagcttaagtttatcaccaggaaaa

SEQ ID NO: 46149 - RNA, 642 nt, synthetic construct
  misc_feature 1..642: note = derived and/or modified sequence opt6 from Fibatuzumab_LightChain1
  source 1..642: mol_type = other RNA
gacatacaaatgacacaatccccatctttcctatcagcatcagtaggcgaccgagtaacaataacatgcagagcatcccaaggaataatttcatacctagcatggtaccaacaaaaaccagaaaaagcaccaaaaagactaatatacgctgcatcctcattacaatcaggagtaccatcacgattctcaggatcaggatcaggaacagaattcacactaacaatatcatcactacaaccagaagacttcgccacatattactgcggacaatacgcaaactacccatacacattcggacaaggaacaaaactcgaaataaaacgcacagtagcagcaccatcagtattcatattcccaccatcagacgaacaactaaaatcaggcacagcatcagtcgtatgtctactaaataacttctacccccgcgaagcaaaagtacaatggaaagtcgacaacgcactacaatcaggaaactcacaagaatcagtaacagaacaagactcaaaagactcaacatactcactatcatcaacattaacactatccaaagcagactacgaaaaacacaaagtatacgcctgcgaagtaacacaccaaggactatcctcaccagtaacaaaatcattcaacagaggagaatgc

SEQ ID NO: 46150 - RNA, 1344 nt, synthetic construct
  misc_feature 1..1344: note = derived and/or modified sequence opt6 from Ficlatuzumab_HeavyChain1
  source 1..1344: mol_type = other RNA
caagttcaattagtccaaccaggagcagaagttaaaaaaccaggaacatctgtaaaactaagttgcaaagcatctggatatacatttacgacatactggatgcactgggtaagacaagcaccaggacaaggtctagaatggataggagaaattaacccaacaaacggacacaccaattacaaccaaaaatttcaaggaagagcaacattaacagtcgataaatcaacatcaacagcttacatggaattaagttccctaagaagtgaagatacagcagtatactactgcgctcgaaactatgtaggatcaatattcgactattggggacaaggaacactactaacagtctcctcagcatccacaaaaggtccatctgttttccctctcgcaccatcatccaaatcaacaagcggaggaacagcagcattaggttgtttagtaaaagattacttcccagaaccagtaacagtaagctggaactcaggagcattaacatcaggagtacacacttttccagcagtattacaatcatcaggattatactcattatcatcagtagttaccgtcccatcatcatcattaggaacacaaacatatatatgcaatgtcaaccacaaaccaagcaacacaaaagtagataaacgagtagaaccaaaatcatgcgataaaacacatacatgccctccatgcccagcaccagaattattaggaggaccatctgtattcctcttccctccaaaaccaaaagatacattaatgataagccgaaccccagaagttacatgtgtagtagtagacgtatcacacgaagatccagaagtgaaattcaactggtacgtcgatggtgtagaagtacacaacgcaaaaaccaaacccagagaagaacaatacaactcaacatatagagtcgtatccgtactaacagtcctacatcaagactggctaaatggtaaagaatacaaatgcaaagtatcaaataaagcactaccagcaccaattgaaaaaacaatatcaaaagccaaaggacaaccaagagaaccacaggtctacaccctaccaccttccagagaagaaatgacaaaaaaccaagtatcactaacatgtctcgtaaaaggcttctatccatcagacattgctgtcgaatgggaatcaaacggacaacccgaaaataactacaaaacaactcccccagttctcgattctgatggatcattcttcctatactcaaaactcacagttgacaaatcccgctggcaacaaggaaatgttttctcatgttctgtaatgcacgaagcactccacaaccactacacacaaaaatcactatctctatcccccggaaaa

SEQ ID NO: 46151 - RNA, 1341 nt, synthetic construct
  misc_feature 1..1341: note = derived and/or modified sequence opt6 from Ficlatuzumab_HeavyChain
  source 1..1341: mol_type = other RNA
gtacaactagtccaacccggagcagaagtaaaaaaacctggaacatcagtaaaattatcctgcaaagcatccggatacacattcacaacatactggatgcactgggtaagacaagcaccaggacaagggctagaatggataggtgaaataaaccccaccaacggacacacaaactacaatcaaaaatttcaaggaagagcaactctaacagtagacaaatctacatcaacagcatacatggaattatcttcactaagatccgaagacacagcagtctactattgtgcaaggaactacgttggatcaatattcgactattggggacaaggaacgctactaactgtatcttcagcctcaaccaaaggacccagtgtatttccactagcaccatcatcaaagtctacatccggaggaaccgcagcattaggctgccttgttaaagactatttccccgaacccgtaacagtaagctggaactcaggcgccctaacttcaggagtacacacatttccagcagtactacaatcatcaggtctatattcactctcaagcgtagtaacagtcccatcctcatcactaggaactcaaacctacatatgcaacgttaatcataaaccaagtaacactaaagttgataaacgagttgaacctaaatcatgtgataaaactcatacatgcccaccatgcccagcacctgaactactaggaggcccttcagtatttctattccctccaaaaccaaaagacacactaatgatatctagaacccctgaagtcacatgcgtagtcgtcgatgtatcacacgaagacccagaagttaaatttaattggtatgtagacggagtagaagtacacaatgcaaaaactaaacccagagaagaacaatataactcaacatatagagtcgtctcagtattaactgtattacaccaagattggttaaacggaaaagagtacaaatgcaaagtatcaaataaagcactaccagcacccatagaaaaaacaatttcaaaagcaaaaggtcaaccaagagaaccacaagtatacactctaccaccatcaagagaagaaatgacaaaaaaccaagtatcactaacatgcttagtaaaaggattctacccaagcgacatagccgtagaatgggaatccaacggacaaccagaaaacaattacaaaacaaccccaccagtattagactcagacggatcattcttcttatatagtaaactaacagtagataaatcacgatggcaacaaggaaatgtattcagttgctccgtaatgcacgaagcactacacaatcactacacacaaaaatcactctcattatcaccaggcaaa

SEQ ID NO: 46152 - RNA, 642 nt, synthetic construct
  misc_feature 1..642: note = derived and/or modified sequence opt6 from Ficlatuzumab_LightChain1
  source 1..642: mol_type = other RNA
gacatagtaatgacacaatctccagacagcctagccatgtcactaggagaaagagtaacactaaactgtaaagcatcagaaaacgtagtatcatacgtatcatggtatcaacaaaaaccaggacaatcacccaaactactaatatacggagcatccaacagagaatcaggagtaccagacagattttctggctcaggatcagcaacagatttcactctaacaatatcatcagtacaagcagaagacgtagcagactaccactgcggacaatcatacaactacccatacacattcggacaaggaacaaaactagaaataaaaagaacagtagctgcaccatcagtattcatattcccaccatcagacgaacaactaaaatcaggaacagcctcagtagtatgcttattaaacaacttctacccaagagaagcaaaagtccaatggaaagtagacaacgcactacaatcaggaaactcacaagaatcagtcacagaacaagactcaaaagactcaacatactcactatcatcaacactaacactatcaaaagcagactacgaaaaacacaaagtctacgcatgtgaagtaactcaccaaggactatcatcaccagtaacaaaatccttcaacagaggagaatgc

SEQ ID NO: 46153 - RNA, 1350 nt, synthetic construct
  misc_feature 1..1350: note = derived and/or modified sequence opt6 from Figitumumab_HeavyChain1
  source 1..1350: mol_type = other RNA
gaagtacaattattagaatcaggaggaggacttgttcaacctggaggaagcctacgtttatcatgtactgcttcaggattcacattttcaagctatgcaatgaactgggttagacaagcaccaggaaaaggactagaatgggtatccgctatatcaggatcaggcggaacaactttctatgccgattccgtaaaaggaagatttaccataagtagagacaactcaagaacaacattatacttacaaatgaattcattaagagcagaagacacagcagtatattactgcgcaaaagacttaggctggtcagattcatattactattactacggaatggatgtctggggacaaggaaccacagtaacagtctcttcagcatcaacaaagggcccatcagtctttcccttagcaccatgttcaagatcaacctccgaatcaacagcagccttaggatgcctagtaaaagattactttccagaaccagttacagtatcatggaactcaggagcattaacatcaggagtccatacatttcctgccgtcctacaatcatccggtctatacagcttatcatcagtagttacggtaccatcaagtaatttcggcacacaaacatacacatgcaacgtagatcacaaaccaagcaacacaaaagtagataaaaccgtagaaagaaaatgctgtgtcgaatgtccaccctgcccagcaccaccagtagctggcccatcagtattcctatttcctcccaaacccaaagatacattaatgataagcagaacaccagaagtaacatgcgttgtagtagatgtatcacacgaagaccctgaagttcaattcaattggtatgtagatggtgtagaagtccataacgcaaaaacaaaaccaagagaagaacaatttaattccaccttccgagtagtatcagtattaacagtcgttcatcaagactggttaaacggtaaagaatacaaatgcaaagtatctaacaaaggtttaccagcacccatagaaaaaacaatatcaaaaacaaaaggacaaccaagagaaccacaagtatatacattaccaccatcacgcgaagaaatgaccaaaaaccaagtatcattaacttgtctagtaaaaggattctacccatccgatattgcagtagaatgggaatcaaatggtcaacccgaaaataattacaaaacaacacccccaatgttagactccgacggatcattcttcctctattcaaaactaacagtagacaaatcacgatggcaacaaggaaatgtattttcttgctcagtaatgcatgaagcattacacaaccactatacccaaaaatcattatcactatcacccgga

SEQ ID NO: 46154 - RNA, 642 nt, synthetic construct
  misc_feature 1..642: note = derived and/or modified sequence opt6 from Figitumumab_LightChain1
  source 1..642: mol_type = other RNA
gacatacaaatgacacaattcccatcatccttatcagcatcagtaggcgacagagtcacaatcacctgcagagcatcacaaggaatacgaaacgacttaggatggtaccaacaaaaacccggaaaagcaccaaaacgattaatatacgcagcatctagattacatcgaggagtaccatcaagattctcaggatcaggctcaggaacagaattcacactaacaatatcatcactacaacctgaagacttcgcaacatactactgcctacaacacaactcctacccatgctcattcggacaaggaacaaaactcgaaatcaaaagaacagtcgcagcaccttcagtattcatattcccaccatcagacgaacaattaaaatcaggaacagcatcagtagtatgcctactaaacaacttttacccacgagaagcaaaagtacaatggaaagtagataacgcactacaatccggaaactcacaagaatcagtaacagaacaagactccaaagactcaacatactcattaagctcaaccctaacattatccaaagcagactatgaaaaacacaaagtatacgcatgcgaagtaacacaccaaggactatcctcaccagtcaccaaatcattcaacagaggagaatgt

SEQ ID NO: 46155 - RNA, 1359 nt, synthetic construct
  misc_feature 1..1359: note = derived and/or modified sequence opt6 from Firivumab_HeavyChain1
  source 1..1359: mol_type = other RNA
caagtacaactagtacaaagtggagcagaagtaaaaatgccaggttcctctgtaaaagtatcatgtaaaacctcaggagtatttttttcatcacacgcaatatcatgggtacgacaagcacccggacaaggtctcgaatggatgggtggaatatcacctatgttcggtacaactcattacgcccaaaaattccaaggcagagtaacaattacagctgaccaatcaacaacaactgcatatatggaattaacatccctaacatctgaagatacagccgtttactactgtgcaagagacggagcaggcagttactacccattaaactggttcgacccatggggacaaggaaccctcgtaacagtatcaagtgcatcaacaaaaggaccatctgtatttccactagccccatcatccaaatcaacatctggaggaacagctgcactcggatgcctcgtaaaagattatttcccagaaccagtaactgtctcatggaactcaggagcactaacaagtggagtacacacatttcctgcagtactacaatcatctggactctactctctatcatccgttgtaactgtaccctcctcatcactaggaacccaaacatatatatgcaacgtcaaccacaaaccctcaaatacaaaagtagataaacgtgtagaacccaaatcttgcgataaaacccatacatgcccaccatgcccagcaccagaactattaggaggcccatctgtatttctatttccacctaaaccaaaagacaccttaatgatatcacgaacccccgaagtaacatgtgtagtagtagatgtctcacacgaagacccagaagtaaaattcaactggtatgtggacggtgtagaagtacacaacgcaaaaactaaacctagagaagaacaatataactctacatacagagtagtctcagtactcactgtcttacatcaagactggctaaatggaaaagaatataaatgtaaagtatcaaataaagctctaccagcaccaattgaaaaaactatatccaaagcaaaaggacaaccaagagaaccacaagtttacactttaccaccctcacgtgacgagctaacaaaaaaccaagtatctctaacatgcctagtaaaaggcttctacccatcagacatagcagtcgaatgggaatccaatggacaaccagaaaacaactataaaaccacaccaccagtacttgattcagacggatctttcttcctatatagcaaattaaccgtagacaaatcaagatggcaacaaggaaacgtcttttcctgttcagtaatgcacgaaggcctgcataaccactatacacaaaaatcattatctttatcaccaggaaaa

SEQ ID NO: 46156 - RNA, 642 nt, synthetic construct
  misc_feature 1..642: note = derived and/or modified sequence opt6 from Firivumab_LightChain1
  source 1..642: mol_type = other RNA
gaaatagtactaacacaatcaccagcaacactatccctaagccccggagaaagagcaacactatcatgcagagcatcagaaaacatatggaacaacctagcatggtaccaacaaaaacccggacaagcacccagactactaatctcaggagcatcaacaggcgcaacaggagtaccatcacgattcagaggctcaggatcaagaacagaattcacactaacaatatccagcttacaatccgaagatttcgcaatatacttctgccaacaatacaactcatggccaagaacattcggaccaggtacaaaagtagaaataaaacgaacagtagcagcaccatcagtattcatcttcccaccatcagacgaacaactaaaatcaggtacagcatcagtagtatgcctattaaacaacttctacccaagagaagcaaaagtacaatggaaagtagacaacgcattacaatcaggaaactcacaagaatcagtaacagaacaagactcaaaagactcaacatactcactatcatcaacactaacactatcaaaagcagattacgaaaaacataaagtatacgcatgcgaagtaacacaccaaggactctcatcaccagtaacaaaatcattcaacagaggagaatgc

SEQ ID NO: 46157 - RNA, 1347 nt, synthetic construct
  misc_feature 1..1347: note = derived and/or modified sequence opt6 from Flanvotumab_HeavyChain1
  source 1..1347: mol_type = other RNA
caagtacaactcgtacaatccggatccgaactaaaaaaacctggagcatccgttaaaatatcatgcaaagcatcaggatatacatttacatcatatgcaatgaactgggtcagacaagcaccaggacaaggactagaatcaatgggctggataaacacaaacacaggaaacccaacatatgcacaaggattcactggacgattcgtattctccatggacacatcagtatcaacagcatatctacaaatatcctcactaaaagcagaagacactgcaatatactactgcgcaccaagatatagctcatcctggtacctcgattattggggacaaggaacactagtaacagtatcttcagcaagtacaaaaggcccctcagtctttccactagcacccagttccaaatctacctcaggcggaacagcagcattaggatgtttagtaaaagactattttccagaaccagtcacagtctcatggaactctggtgcattaacatcaggcgtacacacattcccagcagtactacaaagttcaggtttatattcactcagctcagtagtaacagtaccctcttcctccttaggtacccaaacctatatatgcaatgttaaccataaaccatccaacacaaaagtagacaaaagagttgaaccaaaaagctgcgataaaacccacacatgtcccccatgcccagcaccagaattattaggaggaccatcagtattcctctttccacccaaaccaaaagatacactaatgatatcaagaacaccagaagttacatgtgtagttgtcgacgtttcacacgaagatccagaagtaaaattcaattggtacgtagatggagtagaagtccacaacgctaaaacaaaaccacgtgaagaacaatacaactctacttatagagtagtatcagtactaacagttctccaccaagattggctcaatggaaaagaatacaaatgcaaagtctcaaataaagcactcccagcacctatagaaaaaacaatctcaaaagcaaaaggccaaccacgcgaaccccaagtatatacactacccccttcaagagaagaaatgaccaaaaaccaagtttcactcacatgcctagtcaaaggcttttacccatcagacatcgccgtagaatgggaatcaaatggacaaccagaaaataactataaaacaacaccccccgtcctagactctgatggcagcttcttcttatacagcaaactaacagtagacaaatcaagatggcaacaaggtaatgtattctcatgctctgtaatgcacgaagcattacataatcactacacacaaaaaagtctatcattatcaccaggcaaa

SEQ ID NO: 46158 - RNA, 645 nt, synthetic construct
  misc_feature 1..645: note = derived and/or modified sequence opt6 from Flanvotumab_LightChain1
  source 1..645: mol_type = other RNA
gaaatagtactaacacaatccccagcaacactatccctatcaccaggagaaagagcaacactatcatgccgagcatcacaatctgtatcatcatacctagcatggtaccaacaaaaaccaggacaagcaccaagactactaatatatgacgcatcaaacagagcaacaggcataccagcaagattctcaggatcaggatcaggaacagattttacactaacaatatcatcattagaaccagaagacttcgcagtatactactgccaacaaagatcaaactggctaatgtacacattcggacaaggaacaaaactagaaataaaaagaacagtagcagcaccatcagtatttatattcccaccatcagacgaacaactaaaatcaggaacagcatcagtagtatgcctattaaataacttttacccaagagaagcaaaagtacaatggaaagtagacaacgcactacaatcaggaaactcacaagaatcagtaacagaacaagactcaaaagactccacatactccctatcatccacattaaccctatcaaaagcagactacgaaaaacacaaagtatacgcatgtgaagtaacacaccaaggattatcatcaccagtaacaaaatcctttaacagaggagaatgt

SEQ ID NO: 46159 - RNA, 1362 nt, synthetic construct
  misc_feature 1..1362: note = derived and/or modified sequence opt6 from Fletikumab_HeavyChain1
  source 1..1362: mol_type = other RNA
caagtccaactagtacaatcaggagcagaagtaaaaagaccaggagcctcagttaaagtatcatgtaaagcctctggatacacattcaccaacgacataattcattgggtcagacaagcaccaggacagagactagaatggatgggttggataaacgcaggatatggaaatacccaatacagccaaaacttccaagatagagtatcaatcacaagagacacttcagcatcaacagcatacatggaattaatatcactcagatctgaagataccgccgtttattactgtgctagagaacccctatggttcggtgaatcatctccacatgactattacggaatggacgtttggggccaaggtacaacagtaacagtatcctcagcatctactaaaggtccatccgtattcccacttgcaccatgctcacgatccacatctgaatcaactgcagcactaggatgtctagttaaagattactttccagaaccagtcacagtcagttggaatagcggagcattaacatcaggagtacacacatttccagcagtattacaatcatcaggactatactccttatcatcagtcgtaactgtaccatcaagctcattaggcacaaaaacatacacatgcaacgtagaccataaaccctctaatacaaaagtagacaaaagagtagaatcaaaatacggaccaccttgccctccatgtcccgcaccagaattcctaggaggaccatcagtatttctatttccgcctaaaccaaaagatacattaatgatatcaagaacacctgaagtaacatgtgtagtagtagatgtctcacaagaagacccagaagtccaattcaattggtacgttgatggagtagaagtacataatgcaaaaacaaaaccaagagaagaacaatttaattcaacctacagagtagtgtcagtattaaccgtacttcaccaagactggttaaatgggaaagaatataaatgtaaagtatctaataaaggtctaccatcatctatagaaaaaaccatatctaaagcaaaaggacaacccagagaaccgcaagtatatacattaccaccatctcaagaagaaatgacaaaaaatcaagtatcattaacatgtttagtaaaaggtttttacccatcagacatagctgtagaatgggaatcaaatggacaaccagaaaataactacaaaacaacaccacccgtattagactctgacggatcattttttctatactcacgactaacagtagacaaatcaagatggcaagaaggaaacgtattctcttgctcagtaatgcatgaagcactacataaccactacacacaaaaatcattatccctttcactcggaaaa

SEQ ID NO: 46160 - RNA, 642 nt, synthetic construct
  misc_feature 1..642: note = derived and/or modified sequence opt6 from Fletikumab_LightChain1
  source 1..642: mol_type = other RNA
gcaatacaactaacacaatcaccatcatccctttccgcatcagtaggagacagagtaactataacatgccgagcatcccaaggaatatcatcagcactagcatggtaccaacaaaaaccaggaaaagcacccaaactactaatatacgacgcatcatcactagaatcaggagtcccatctagattctccggatcaggatcaggaactgactttacactaacaatatcctccctacaacccgaagacttcgcaacatactactgccaacaattcaactcatacccattaacattcggaggaggaacaaaagtagaaataaaaagaacagtcgcagccccatccgtattcatattcccaccatcagacgaacaactaaaatcaggaacagcatcagtcgtatgcctactcaacaacttctacccaagagaagcaaaagtacaatggaaagtcgataacgcactacaatcaggtaactcacaagaatcagtaacagaacaagactcaaaagactcaacatactcactatcatcaaccctaaccttatcaaaagcagactacgaaaaacataaagtatacgcatgcgaagtaacacaccaaggattatcatcaccagtaaccaaatcattcaacagaggtgaatgc

SEQ ID NO: 46161 - RNA, 1341 nt, synthetic construct
  misc_feature 1..1341: note = derived and/or modified sequence opt6 from Fontolizumab_HeavyChain1
  source 1..1341: mol_type = other RNA
caagtacaattagtacaatctggagcagaactaaaaaaacccggatcatctgtaaaagtatcatgcaaagcctcgggatacatattcacatcatcctggataaactgggtcaaacaagcaccaggccaaggactagaatggataggaagaatagatccatccgacggcgaagtacattacaaccaagactttaaagataaagctacactaacagtagataaatcaacaaacaccgcatatatggaattatcttcactaagatctgaagatacagccgtatactactgcgcaagaggattcctcccctggtttgctgattggggtcaaggaacattagtaacagtttcctcagctagcaccaaaggtccatcagtattcccactagctccaagttctaaatcaacatcaggaggaacagcagccctaggctgccttgtaaaagactacttcccagaaccagtcaccgtttcctggaactcaggcgcactaacatcaggagtacacacatttcccgcagtactacaatcctcaggactctactcattatcctccgtagtaactgttccatcatcatctttaggaacccaaacatacatatgcaacgtaaaccacaaaccttcaaacactaaagtagataaaaaagtagaaccaaaatcatgcgacaaaacacatacatgcccaccatgcccagcaccagaactactaggcggaccatctgtattcttatttccacctaaacctaaagacacactaatgatatctagaacacctgaagtaacatgtgtagtagtagacgtatcacacgaagatcccgaagtaaaattcaattggtacgtagacggagtcgaagtacataacgctaaaacaaaaccaagagaagaacaatacaactcaacatacagggtcgtatctgtactcacagtcctacatcaagattggctaaacggaaaagaatacaaatgtaaagtctcaaataaagctcttccagctcccatagaaaaaactatatccaaagccaaaggacaacctagagaaccacaagtatacacattaccaccctcaagagatgaactaacaaaaaaccaagtaagcttaacatgcttagtaaaaggattctacccttcagacatagcagtagaatgggaatccaacgggcaaccagaaaataattataaaaccacaccaccagtcttagactcagatggaagcttctttctatactcaaaactaacagttgacaaaagccgatggcaacaaggaaacgtattctcatgctctgtaatgcacgaagccctacacaatcactatactcaaaaatcactctcactatcaccaggtaaa

SEQ ID NO: 46162 - RNA, 642 nt, synthetic construct
  misc_feature 1..642: note = derived and/or modified sequence opt6 from Fontolizumab_LightChain1
  source 1..642: mol_type = other RNA
gatatacaaatgacacaatcaccatcaacactatcagcatcagtaggagacagagtaacaataacatgtaaagcatcagaaaacgtcgacacatacgtatcctggtaccaacaaaaaccaggaaaagcaccaaaattactaatatacggagcatcaaacagatacacaggagtaccatcaagattctcaggatcaggctcaggaacagactttacactaaccatatcatcactacaaccagacgactttgccacatattactgcggacaatcctacaattacccattcacattcggacaaggaacaaaagtagaagtaaaaagaacagtagcagcaccatcagtattcatattcccaccctcagacgaacaactaaaatcaggaaccgcatcagtagtatgcttactaaacaacttctacccaagagaagcaaaagtccaatggaaagtagacaacgcattacaatcaggaaactcacaagaatctgtaacagaacaagattctaaagactcaacatacagcttatcatctaccttaacattatcaaaagcagactatgaaaaacacaaagtatacgcatgcgaagtcacacaccaaggactatcatcaccagtaacaaaatcattcaacagaggagaatgc

SEQ ID NO: 46163 - RNA, 1344 nt, synthetic construct
  misc_feature 1..1344: note = derived and/or modified sequence opt6 from Foralumab_HeavyChain1
  source 1..1344: mol_type = other RNA
caggtacaactagtagaaagtggtggaggtgtagtacaacctggaagatctttaagactgagttgtgctgcatcaggattcaaattctcaggatacggaatgcattgggtaagacaagcaccaggaaaaggcttagaatgggtagcagtaatatggtacgatggaagcaaaaaatactatgtagactcagttaaaggaagattcacaatatcccgagataactcaaaaaatactctatatctacaaatgaatagcttaagagcagaggataccgcagtatattattgtgcacgccaaatgggatactggcatttcgatttatggggaagaggaacactagtaacagtatcaagcgcaagtaccaaaggaccaagtgtattcccactagcaccatcttcaaaatcaacatcaggaggtacagccgcattaggatgtttagtaaaagattatttccccgaaccagtaacagtatcttggaactcaggagcactaacctcaggagtacatacattcccagcagtcctacaaagttcaggactatactcactaagtagcgtagttactgtccctagctcatctttaggcacacaaacatatatatgtaatgtaaatcataaaccatctaacactaaagtagacaaaagagttgaaccaaaatcttgtgataaaactcatacctgtccaccatgtccagcaccagaagcagaaggaggtccatcagtatttctatttccaccaaaaccaaaagatactctaatgattagcagaacaccagaagtaacatgtgtagtagtagatgtaagccacgaagacccagaagtaaaatttaattggtacgttgatggagtagaagtacataacgcaaaaactaaaccaagagaagaacaatacaactcaacttatagagtagtatcagtattaactgtcttacatcaagattggctaaatggaaaagaatataaatgtaaagtttcaaataaagcactacctgcaccaattgaaaaaactataagtaaagcaaaaggacaacccagagaaccacaagtatatacactcccaccaagtagagaagaaatgacaaaaaaccaagtatccttaacttgtctagtaaaaggtttttatccatcagacattgcggtagaatgggaatcaaacggacaaccagaaaacaattacaaaactacccccccagtccttgacagtgacggaagtttttttctatatagcaaactaacagtagataaatccagatggcaacaaggtaatgtattttcatgcagcgtaatgcatgaagcactacacaaccactatacacaaaaaagtctaagcctttcaccaggaaaa

SEQ ID NO: 46164 - RNA, 645 nt, synthetic construct
  misc_feature 1..645: note = derived and/or modified sequence opt6 from Foralumab_LightChain1
  source 1..645: mol_type = other RNA
gaaatagtactaacacaatcacccgcaacactatcactatcaccaggagaaagagcaacactatcatgcagagcatcacaatcagtatcctcatacctagcatggtatcaacaaaaaccaggacaagcaccaagattactaatatacgacgcatcaaacagagcaacaggaataccagcaagattctcaggatcaggatcaggaacagacttcacactaacaatatcatcactagaaccagaagacttcgcagtctactattgccaacaacgatcaaactggccaccactaacattcggaggaggaacaaaagtagaaataaaaagaacagtagcagccccatcagtattcatatttccaccatcagacgaacaactcaaatcaggaacagcatcagtagtatgcctactaaacaacttctacccaagagaagccaaagtccaatggaaagtagacaacgcattacaatcaggaaactcacaagaatctgtaaccgaacaagactccaaagactccacatactcattatcatccacattaacattatcaaaagccgattacgaaaaacacaaagtatacgcatgcgaagtaacacaccaaggactatcctcaccagtaacaaaatcatttaacagaggagaatgc

SEQ ID NO: 46165 - RNA, 1344 nt, synthetic construct
  misc_feature 1..1344: note = derived and/or modified sequence opt6 from Foravirumab_HeavyChain1
  source 1..1344: mol_type = other RNA
caagtacaactagtagaatcaggaggaggagcagttcaaccaggaagatcattacgattatcctgcgccgcctcaggattcacattctcttcctatggaatgcactgggtaagacaagcaccaggcaaaggattagaatgggtagccgttatcctatatgacggatcagataaattctatgcagactcagtaaaaggacgatttacaataagccgtgacaacagcaaaaacaccctatatctacaaatgaattcactaagagcagaagatacagcagtatattactgcgcaaaagtagcagtagcaggcacacactttgattattggggacaaggtaccctagtaacagtatcaagtgcatctacaaaaggaccctctgtatttccactcgcaccatcatctaaatcaacatcgggtggaaccgccgccctcggatgcctagtcaaagactattttcccgagcccgtaacagtatcctggaattcaggagcactaacatcaggagtacacacattcccagcagtactacaatcatcaggattatactcattatcatctgttgtaacagtaccaagttcttcattaggaacacaaacatacatatgtaatgtaaaccacaaaccatcaaacaccaaagtcgacaaaagagtagaaccaaaatcatgcgacaaaacccacacctgcccaccatgtccagcaccagaactattaggtggaccctcagtctttctattcccacccaaaccaaaagacacattaatgatctcacgaacaccagaagtcacctgcgtagtagtagacgtatcccatgaagaccccgaagtaaaattcaattggtacgtagatggagtagaagtacataacgctaaaacaaaaccacgagaagaacaatataactcaacatatcgagtagtctccgtactaacagtattacatcaagactggctaaacggaaaagaatacaaatgtaaagtttcaaacaaagcattaccagctcctattgaaaaaacaatttcaaaagctaaaggacaaccaagagaaccccaagtatacaccctaccacccagcagagaagaaatgacaaaaaaccaagtctcattaacatgcctagtaaaaggattctacccatcagacatagcagtagaatgggaaagtaacggacaaccagaaaacaactataaaacaacaccaccagtcctagactcagacggctcattcttcttatattccaaattaaccgtagataaatcaagatggcaacaaggaaacgttttctcatgttccgtaatgcacgaagctctacacaaccactacacacaaaaaagcctatcattatcaccagga

SEQ ID NO: 46166 - RNA, 1344 nt, synthetic construct
  misc_feature 1..1344: note = derived and/or modified sequence opt6 from Foravirumab_HeavyChain
  source 1..1344: mol_type = other RNA
gaagtacaactcgtagaatcaggaggaggagccgtacaacctggaagatctttaaggctatcatgtgcagcctcaggattcacattctcatcatatggaatgcactgggtacgacaagctcctggaaaaggactagaatgggtagcagttatcttatatgacggatcagataaattttacgccgactctgtaaaaggaagattcaccatatctagagataactcaaaaaacacattatacttacaaatgaactccttacgagcagaagacacagcagtatattactgcgctaaagtagcagtcgcaggcacacatttcgactactggggccaaggtacattagtaacagttagttcagcctctacaaaaggaccttcagtattcccactagccccatcttcaaaatcaacatcaggaggaactgcagcactaggatgcttagtaaaagactattttcccgaaccagtaacagtctcatggaatagcggcgcattaacatccggagtacatacatttccggcagtattacaatcttcaggattatattctttatcttcagtagtaacagtaccaagctcaagcctaggaacacaaacatacatatgcaatgtaaaccacaaaccatcaaacacaaaagtagacaaacgagttgaaccaaaatcctgcgataaaactcacacctgcccaccctgtccagctccagaattattaggaggcccaagtgtattcctatttccacctaaaccaaaagacacattaatgataagcagaacaccagaagtaacttgtgtagttgtagacgtatcacacgaagacccagaagtgaaatttaactggtacgtagacggagtagaagtacataatgcaaaaactaaacctagagaagaacaatacaatagcacatacagagttgtaagcgtactaacagtattacaccaagactggttaaacggaaaagaatacaaatgtaaagtatctaataaagccctcccagcaccaatagaaaaaacaatatcaaaagcaaaaggacaaccaagagaaccacaagtatacacgctacctccaagtagagaagaaatgacaaaaaatcaagtatcactaacttgtctagtcaaaggattctatccatctgacatcgcagtagaatgggaaagcaacggacaacccgaaaataattacaaaactactccaccagtactagattcagatggatcattctttctatactcaaaattaacagtagataaatcacgatggcaacaaggaaatgtattttcctgttcagtcatgcatgaagcattacataatcattatacacaaaaatcattaagcttaagtcctgga

SEQ ID NO: 46167 - RNA, 642 nt, synthetic construct
  misc_feature 1..642: note = derived and/or modified sequence opt6 from Foravirumab_LightChain1
  source 1..642: mol_type = other RNA
gacatccaaatgacacaatcaccatcatcattatcagcatcagtaggagatcgagtaacaataacatgcagagcatcacaaggaataagaaacgacctaggatggtaccaacaaaaacccggaaaagccccaaaactattaatatacgcagcatcctcacttcaatcaggagtaccatcaagattttcaggatcaggatcaggaaccgacttcacattaactatatcatcactacaaccagaagacttcgcaacatattactgccaacaattaaactcatacccaccaacattcggaggaggaacaaaagtcgaaataaaaagaacagtagctgccccatcagtattcatatttccaccatcagacgaacaactaaaatcaggtacagcctcagtcgtatgcttactaaacaacttctacccacgagaagcaaaagtccaatggaaagtagacaacgcattacaatcaggaaactcacaagaatcagtaacagaacaagactcaaaagactcaacatactcactatcatcaacattaaccctatcaaaagcagactatgaaaaacacaaagtatacgcatgcgaagtaacacaccaaggattatcatcaccagtaacaaaatcatttaacagaggagaatgc

SEQ ID NO: 46168 - RNA, 1341 nt, synthetic construct
  misc_feature 1..1341: note = derived and/or modified sequence opt6 from Fresolimumab_HeavyChain1
  source 1..1341: mol_type = other RNA
caagttcaattagtacaaagtggcgcagaagtaaaaaaaccaggatcaagtgtcaaagtatcctgcaaagcatccggatatactttttcatcaaacgtaatatcatgggtcagacaagcaccaggacaaggattagaatggatgggaggagtaataccaatagtagatatcgcaaactatgcacaacgattcaaaggccgtgtaacaataacagcagatgaatctacatcaacaacctacatggaactatctagtctacgatctgaagatacagcagtatattactgcgcctcaacacttggattagtcctagacgcaatggattactggggacaaggaacattagtaactgtttcatcagcatcaacaaaaggaccatcagtattccctttagccccatgctctagatccacctctgaaagcacagctgcactaggatgcttagtaaaagattacttcccagaaccagtcacagtatcttggaactccggcgcattaacatccggcgtacacacatttccagcagtactccaaagttccggattatactcattatcatcagtagttacggtaccatcttcatcactaggaacaaaaacatatacatgtaatgtagaccataaaccatcaaatacaaaagtggacaaacgagtcgaatcaaaatacggacccccatgtccatcatgccctgccccagaattcctaggaggaccttcagtatttttattcccaccaaaaccaaaagacacattaatgataagtagaacaccagaagtaacatgcgtagtagttgacgtatctcaagaagacccagaagttcaattcaattggtacgttgatggagttgaagtccacaatgcaaaaacaaaaccacgagaagaacaattcaattcaacatatagagtagtatcagtattaacagtacttcaccaagactggttaaatggaaaagaatataaatgcaaagtatcaaacaaaggactaccttcatcaatagaaaaaacaataagtaaagccaaaggacaacctagagagccacaagtatacacattaccaccatcccaagaggaaatgacaaaaaatcaagtatcacttacttgtctagttaaaggattctatccatcagacatagcagttgaatgggaaagcaacggacaaccagaaaacaactataaaactacacctccagtcctagattcagatggatccttctttctatactcaagactaacagtagacaaatctagatggcaagaaggaaatgtattctcctgctcagttatgcacgaagcattacacaatcactatacacaaaaatctttatcactatcattaggaaaa

SEQ ID NO: 46169 - RNA, 645 nt, synthetic construct
  misc_feature 1..645: note = derived and/or modified sequence opt6 from Fresolimumab_LightChain1
  source 1..645: mol_type = other RNA
gaaacagtactaacccaatcacccggaacattatccctctcaccaggagaaagagcaacactatcatgcagagcatcacaatcattaggatcatcatacctagcatggtatcaacaaaaaccaggacaagcaccaagactactaatatacggagcatcatcaagagcaccaggaataccagacagattctcaggatcaggatcaggaacagacttcacactaacaatatcaagactagaacccgaagacttcgcagtatactactgccaacaatacgcagactcacccatcacattcggacaaggaacaagactagaaataaaaagaaccgtagccgcaccatcagtattcatattcccaccatcagatgaacaactcaaatcaggaacagcatcagtagtatgcctactaaacaacttctacccaagagaagctaaagtacaatggaaagtagacaacgcattacaatccggaaactcacaagaatcagtaacagaacaagactcaaaagactcaacatactcactatcatcaacactaacattatcaaaagcagactacgaaaaacacaaagtatacgcttgcgaagtaacacaccaaggactatcatcaccagtaacaaaatcattcaaccgaggagaatgc

SEQ ID NO: 46170 - RNA, 1347 nt, synthetic construct
  misc_feature 1..1347: note = derived and/or modified sequence opt6 from Fulranumab_HeavyChain1
  source 1..1347: mol_type = other RNA
gaagtacaattagtagaatccggtggaggattagtacaacccggcggatcactacgattatcatgcgctgcatcaggatttacactaaggtcatattcaatgaattgggtcagacaagcaccaggaaaaggattagaatgggtatcatatatcagcaggtcttcacatacaatattctatgcagactctgtaaaaggaagatttacaatatcccgagacaatgcaaaaaactcattatatttacaaatggattcattaagagatgaagataccgcaatgtattattgtgccagagtatactcttcaggatggcacgtatcagattactttgattattggggtcagggtatcctagttacagtatcaagtgcatcaactaaaggtccctcagtttttccactagcaccatgcagcagatctacctcagaatcaacagctgccttaggatgtttagtaaaagattactttccagaaccagtaactgtttcctggaattcaggagcactcacttctggagtacatacatttccagcagttctacaatcctcaggactatactccctatcatcagtagtaaccgtaccctcctccaacttcggaacacaaacatatacatgtaatgtagaccacaaaccatcaaacaccaaagtagacaaaacagtagaaagaaaatgttgtgtagaatgcccaccatgtccagctccaccagtagccggaccctcagtttttctattcccgccaaaaccgaaagacacattaatgatatcaagaacaccagaagtgacatgcgttgtcgttgacgtctctcatgaagatccagaagttcaattcaactggtatgtcgacggtgtagaagtacataatgcaaaaacaaaacctagagaagaacaattcaactcaacattccgagtagtatcagtcttaacagtagtacatcaagattggttaaatggtaaagaatacaaatgtaaagtatcaaacaaaggactaccagctccaatcgaaaaaacaatatcaaaaacaaaaggacaacctagagaaccacaagtatacacactccccccttcccgagaagaaatgacaaaaaatcaagtatcactaacatgcttagtaaaaggattttatccgtcagatatagcagtagaatgggaatcaaatggacaaccagaaaacaactataaaacaacaccaccaatgctagactctgacggatctttttttttatactctaaactaacagtagataaatcaagatggcaacagggaaacgtattctcttgttccgtcatgcacgaagcattacataatcactacacacaaaaatcactatcactttcaccaggaaaa

SEQ ID NO: 46171 - RNA, 642 nt, synthetic construct
  misc_feature 1..642: note = derived and/or modified sequence opt6 from Fulranumab_LightChain1
  source 1..642: mol_type = other RNA
gcaatacaactaacacaatcaccctcatcactatcagcatcagtaggagacagagtaaccataacctgcagagcatcacaaggcatatcatcagcactagcatggtatcaacaaaaaccaggaaaagcaccaaaactactaatatacgacgcatcctcattagaatcaggcgtaccttcaagattctcaggctcaggatcaggaacagacttcacattaacaatatcttcattacaaccagaagacttcgccacatactactgccaacaattcaactcatacccactaacattcggaggaggaacaaaagtagaaataaaaagaacagtagcagccccatcagtattcatattccccccatcagacgaacaattaaaatcaggaacagcatcagtcgtctgtctactaaacaacttctacccacgcgaagcaaaagtacaatggaaagtagacaacgcactacaatcaggaaattcacaagaatcagtaacagaacaagactcaaaagactcaacatactcactatcatcaactttaacattatcaaaagcagactacgaaaaacacaaagtatacgcatgcgaagtaacacaccaaggactatcatcacccgtaaccaaatcattcaacagaggagaatgc

SEQ ID NO: 46172 - RNA, 1356 nt, synthetic construct
  misc_feature 1..1356: note = derived and/or modified sequence opt6 from Futuximab_HeavyChain1
  source 1..1356: mol_type = other RNA
gaagtacaactccaacaacccgggtccgaacttgtaagaccaggagcatctgttaaactatcatgtaaagcctcaggatacacatttacatcctactggatgcactgggtaaaacaaagacccggacaaggattagaatggatcggaaatatatacccaggatcaagaagtacaaattatgatgaaaaatttaaatctaaagccacactaacagtcgacacatcatcctccaccgcatatatgcaactatcatcactaacaagcgaagattcagcagtctattattgtacaagaaacggcgactactatgtttcatcaggcgatgcaatggactattggggacaaggcacatcagtcacagtatcatcagcttcaacaaaaggaccatctgtcttcccattggcaccttcatccaaatcaacatctgggggaacagccgcactcggatgccttgttaaagattactttccagaacctgtaacagtatcttggaattcaggcgcactaacatctggagtccacacatttccagccgtattacaatcatcaggcctatacagcttatcctccgtagtaacagtaccatcatcttcactcggcacacaaacatatatttgtaacgttaatcacaaaccttccaacacaaaagttgataaaagagtcgaacccaaatcatgcgataaaacacacacatgccccccatgcccagcaccagaattattaggaggcccctcagtattcttattcccaccaaaacccaaagataccttaatgatttctcgaacccccgaagttacatgtgtagtagtagatgtctctcatgaagacccagaagtaaaattcaactggtacgtagatggagttgaagtacacaatgcaaaaacaaaaccaagagaagaacaatacaattccacatacagagtcgtctcagtactaacagtattacaccaagactggctaaacggaaaagaatacaaatgcaaagtaagcaacaaagcattaccagccccaatagaaaaaacaatatcaaaagcaaaaggacaaccaagagaaccacaagtatacacattaccaccttctagagaagaaatgactaaaaaccaagtaagtttaacatgccttgtaaaaggattctatcccagcgacatagcagtagaatgggaatcaaacggacaaccagaaaacaattacaaaaccacaccacccgtactagactccgacggatcatttttcctatattcaaaactaacagtagacaaatctagatggcaacaaggaaacgtattctcatgctcagtaatgcacgaagcactacacaaccactatacacaaaaatcactatccctatcaccagga

SEQ ID NO: 46173 - RNA, 642 nt, synthetic construct
  misc_feature 1..642: note = derived and/or modified sequence opt6 from Futuximab_LightChain1
  source 1..642: mol_type = other RNA
gacatacaaatgacacaaacaacctcatcactatcagcaagcctaggagacagagtcactatatcatgccgaacaagccaagacataggcaactacctaaactggtaccaacaaaaaccagatggcacagtaaaattactaatatactacacatcaagattacactcaggagtaccaagcagattctcaggctcaggatcaggaacagacttctcactaacaataaacaacgtagaacaagaagacgtagcaacatacttctgccaacactacaacacagtaccacctacattcggaggaggaacaaaactagaaataaaacgaacagtcgcagcaccatcagtattcatattcccaccatcagacgaacaactaaaatcaggaacagcctcagtagtatgcctactcaacaacttctacccaagagaagcaaaagtacaatggaaagtagacaacgcactacaaagcggaaattcacaagaatcagtaacagaacaagacagcaaagactcaacatattcactaagctcaacactaacactatcaaaagcagattacgaaaaacacaaagtatatgcatgtgaagtaacacaccaaggactctcatcaccagtaacaaaaagcttcaatagaggcgaatgc

SEQ ID NO: 46174 - RNA, 1335 nt, synthetic construct
  misc_feature 1..1335: note = derived and/or modified sequence opt6 from Galcanezumab_HeavyChain1
  source 1..1335: mol_type = other RNA
caagttcaactagtacaaagtggagcagaagttaaaaaaccaggatcttcagtaaaagtatcctgtaaagcctccggctacacctttggaaactattggatgcaatgggtaagacaagcaccaggtcaaggtctagaatggatgggagcaatatacgaaggaacaggaaaaacagtatatatacaaaaatttgcagatagagttacaataacagcagacaaatcaacctcaacagcatacatggaactaagctctctcagaagtgaagatacagcagtatactattgtgcccgattaagtgactatgtctcaggattcggatattggggccaaggcacaacagtaacagtatcctcagcatccacaaaaggaccatcagtttttccattagcaccatgttcaagaagcacatcagaaagtaccgctgcactaggatgcctagtcaaagattactttcctgaacctgtaacagtatcttggaactctggagcactaacctcaggagtacacacattcccagcagtattacaaagttccggactgtatagtctatcaagtgtagttacagttccatcgtcctcactaggaacaaaaacatacacatgcaatgtagaccataaaccaagtaataccaaagtcgataaaagagtagaatcaaaatacggaccgccatgccccccttgcccagcaccagaagccgcaggaggaccaagcgtattcttatttccacctaaaccaaaagatacactaatgatatcacgtaccccagaagtcacctgtgtagtagtagatgtatcacaagaagacccagaagtccaatttaactggtatgtagacggagtagaagtacataatgcaaaaacaaaaccaagagaagaacaattcaattcaacatatcgagtagtatctgtactaaccgtattacaccaagattggctgaatggaaaagaatataaatgtaaagtatcaaataaaggcctaccatcaagtatagaaaaaacaattagtaaagcaaaaggacaaccacgagaaccccaagtttatacattaccaccatcacaagaagaaatgaccaaaaaccaagtttccctaacatgcctagttaaaggattctatccaagtgacatagcagtagaatgggaaagcaacggacaaccagaaaacaattataaaacaacacccccagttttagattcagacggttcattttttttatattcaagactaacagtagacaaatcaagatggcaagaaggtaatgtatttagctgctccgtcatgcacgaagcattacataaccactatactcaaaaatcattatcactatcattagga

SEQ ID NO: 46175 - RNA, 642 nt, synthetic construct
  misc_feature 1..642: note = derived and/or modified sequence opt6 from Galcanezumab_LightChain1
  source 1..642: mol_type = other RNA
gacatacaaatgacacaatcaccatcaagtctatcagcatcagtaggagacagagtcaccataacatgcagagcaagcaaagacatatcaaaatacttaaactggtaccaacaaaaaccaggaaaagcaccaaaattactaatatactacacctcaggataccactcaggcgtaccatcaagattctcaggatcaggatcaggaacagacttcacactaacaatatcatcactacaaccagaagactttgccacatactactgccaacaaggcgacgcactaccaccaacattcggaggaggaacaaaagtcgaaataaaaagaacagtagcagcaccatcagtattcatattcccaccatcagacgaacaactaaaatcaggaacagcatcagtagtatgcctactaaacaacttctacccacgagaagccaaagtccaatggaaagtagacaacgcactacaatcaggaaactcacaagaatcagtaaccgaacaagactcaaaagattcaacatactcactatcatcaacactaacactatcaaaagcagactacgaaaaacacaaagtatacgcctgcgaagtaacacaccaaggtttatcatcaccagtaacaaaatcattcaacagaggagaatgc

SEQ ID NO: 46176 - RNA, 1371 nt, synthetic construct
  misc_feature 1..1371: note = derived and/or modified sequence opt6 from Galiximab_HeavyChain1
  source 1..1371: mol_type = other RNA
caagtccaactccaagaatccggaccaggcctcgtaaaaccatccgaaaccttatcactcacatgtgcagtatccggcggatcaatttcaggaggctatggctggggatggataagacaacctcccggaaaaggattagaatggatcggatccttttattcctcatcaggtaacacatattacaatccaagcctaaaatcccaagtaacaatttcaacagacacctctaaaaatcaattctccttaaaactaaactccatgacagcagcagatactgcagtctattattgcgtaagagatcgattattctcagtcgtcggaatggtctataacaactggtttgacgtatggggtccaggagttttagttacagtttcatccgcatccacaaaaggaccttcagtattcccattagcccccagctcaaaatcaacatccggaggaaccgcagccttaggttgcctagtaaaagattactttcctgaaccagtaaccgtatcatggaattccggtgccctcacttcaggagttcacacattccccgcagtactacaatcttccggactatattccttatcctccgttgtaacagtaccatcatccagccttggcacacaaacatacatatgcaacgtaaaccacaaaccatcaaacacaaaagtagacaaaaaagcagaacccaaatcatgcgacaaaacccacacatgcccaccatgcccagctccagaattactcggaggaccatcagtattcctttttccacccaaaccaaaagacacactaatgatatcaagaacaccagaagttacctgcgtagtagtagatgtatcacatgaagatcccgaagtaaaattcaattggtacgtagacggagtagaagtacacaacgccaaaacaaaaccacgagaagaacaatacaacagtacatacagagtagtctctgtactcacagttctacaccaagactggttaaacggaaaagaatacaaatgtaaagtttcaaacaaagcactaccagcaccaatagaaaaaaccatatcgaaagccaaaggacaaccccgagaaccacaagtatatacacttccaccatccagagacgaattaacaaaaaatcaagtatccctcacatgcctagtaaaaggtttttacccatcagacatagctgtagaatgggaatccaacggacaaccagaaaacaactataaaactacaccaccagtccttgattcagacggaagctttttcctatacagtaaactaacagtagataaatctagatggcaacaaggaaacgtattctcatgctctgtcatgcacgaagcattacacaaccactatacacaaaaatctttatctctatcacctggaaaa

SEQ ID NO: 46177 - RNA, 648 nt, synthetic construct
  misc_feature 1..648: note = derived and/or modified sequence opt6 from Galiximab_LightChain1
  source 1..648: mol_type = other RNA
gaatcagcactaacacaaccaccatcagtctcaggagcaccaggacaaaaagtaacaatatcatgcacaggatcaacatcaaatataggaggatacgacttacactggtaccaacaattacccggaacagcaccaaaactactaatatacgacataaacaaaagaccttcaggaatatcagacagattctcaggaagcaaatcaggaacagcagcatctctagcaataacaggattacaaacagaagacgaagcagactattactgccaatcatacgactcatcactaaacgcacaagtattcggaggaggaacaagactaacagtactaggacaacccaaagcagcaccaacagtaaccttattcccaccaagctcagaagaactacaagcaaacaaagcaacactagtatgcctaatatcagatttctacccaggagcagtaaccgtagcatggaaagccgattcatcaccagtaaaagcaggagtagaaacaacaacaccatctaaacaatcaaacaacaaatacgcagcatcaagttacctaagtctaacaccagaacaatggaaatcacacagatcctactcatgtcaagtaacacacgaaggatcaacagtcgaaaaaacagtagcaccaaccgaatgctca

SEQ ID NO: 46178 - RNA, 1347 nt, synthetic construct
  misc_feature 1..1347: note = derived and/or modified sequence opt6 from Ganitumab_HeavyChain1
  source 1..1347: mol_type = other RNA
caagttcaactacaagaatcaggacccggtttagttaaaccctctggtacactgtctttaacatgcgcagtatcaggcggttctatatcctcatcaaattggtggtcatgggtacgccaaccaccaggaaaaggattagaatggattggcgaaatctaccactctggatcaactaactataacccatcactcaaatccagagtaacaatatcagtagacaaatccaaaaaccaattctcactaaaattaagctcagtaaccgcagcagacacggcagtatattattgcgcacgttggacaggacgcacagacgcttttgatatttggggacaaggcacaatggtaacagtatcatcagcatccacaaaaggaccatcagtctttcccttagcaccttcatccaagtctacaagtggaggcacagcagcactaggatgtttagtaaaagattattttccagaacccgtaacagtatcctggaactcaggagcattaacatcaggcgtacacacatttccagccgtattacaatcctcaggattatattccctctcaagtgtcgtaacagtaccatcatcatcactaggaacacaaacctacatatgcaatgtaaaccataaaccctcaaatacaaaagtagataaaaaagtagagcctaaatcatgcgacaaaacccatacatgcccaccctgcccagcaccagaattactcggcggcccttcagttttcttattccctccaaagccaaaagacacactaatgatatcaagaacaccagaagtcacatgtgtcgtagtagacgtatcccacgaagacccagaagtaaaatttaattggtatgtagacggagtagaagtacacaacgcaaaaacaaaaccaagagaagaacaatacaactccacttatagagtagtaagtgtactaacagtcctacaccaagactggttaaacggtaaagaatataaatgcaaagtctcaaacaaagcattaccagctccaatcgaaaaaacaatctcaaaagctaaaggacaaccaagagaacctcaagtttacacattacctccttccagagacgaattaaccaaaaatcaagtatcactaacatgtttagtaaaaggattttacccttcagatatagcagtcgaatgggaatccaacggacaaccagaaaacaactataaaacaacaccacccgtcctagattcagacggttcatttttcctttatagcaaactaaccgtagacaaatcaagatggcaacagggtaacgtattctcatgctcagtaatgcacgaagcactacataatcattacacccaaaaatccttatctctctcaccaggcaaa

SEQ ID NO: 46179 - RNA, 657 nt, synthetic construct
  misc_feature 1..657: note = derived and/or modified sequence opt6 from Ganitumab_LightChain1
  source 1..657: mol_type = other RNA
gacgtagtaatgacacaatcaccactatcactaccagtaacaccaggagaaccagcatcaatatcatgcagatcatctcaatcactactacactcaaacggatacaactacctagactggtacttacaaaaaccaggacaatcaccacaattactaatatacctaggaagtaacagagcaagcggagtaccagacagattctcaggatcaggctcaggaacagactttacactaaaaatatccagagtagaagcagaagacgtaggagtatattactgcatgcaaggaacacactggccactaacattcggacaaggaacaaaagtagaaataaaaagaacagtagccgcaccatcagtattcatattcccaccatcagacgaacaactaaaatcaggaaccgcatcagtagtttgcttattaaacaacttctacccaagagaagcaaaagtacaatggaaagtagacaacgcactccaatcaggaaactcacaagaatcagtaacagaacaagacagcaaagactcaacatactcactatcatcaacactaacactatcaaaagcagactatgaaaaacacaaagtatacgcatgcgaagtaacacaccaaggactaagttcaccagtaactaaaagcttcaaccgaggagaatgc

SEQ ID NO: 46180 - RNA, 1368 nt, synthetic construct
  misc_feature 1..1368: note = derived and/or modified sequence opt6 from Gantenerumab_HeavyChain1
  source 1..1368: mol_type = other RNA
caagtagaattagtagaaagtggaggaggattagtacaaccaggaggaagccttcgtctaagttgtgcagcatcaggattcacattttcctcatatgcaatgagctgggtcagacaagcacctggaaaaggactcgaatgggtatcagcaatcaatgcatctggaacccgcacatactatgctgattcagtaaaaggcagatttacaatctcaagagacaatagtaaaaacaccctatatttacaaatgaattcattaagagcagaagacacagcagtatactactgtgcacgaggaaaaggaaatacccataaaccttatggatacgtaagatactttgatgtatggggacaaggcaccctagtcacagtctcatcagccagtacaaaaggtccatcagtatttccactagctccatcatcaaaaagtacaagcggaggaacagcagctctaggttgcctagttaaagattacttccctgaaccggtaacagtatcctggaatagcggagccctaacctcaggagtacacacatttccagccgtactacaatcatcaggcttatactcactatcatcagtcgtaacagtaccaagctccagtctcggaacacaaacatatatatgtaatgtaaatcacaaaccttcaaataccaaagtggataaaaaagtagaacctaaatcatgcgataaaacacacacatgccctccatgtccagcacccgaattgctaggcggtccaagcgtattcctatttccaccaaaacctaaagacacattaatgatatcaagaacaccagaagtaacatgcgtagtagtagatgtatcacatgaagacccagaagttaaatttaattggtacgtagatggagtagaagtacacaatgctaaaacgaaaccaagagaagaacaatacaacagcacatacagagtagtaagcgtgctcacagtactacatcaagactggctaaacggcaaagaatacaaatgtaaagtaagtaataaagctttaccagcaccaatcgaaaaaacaatatcaaaagctaaaggtcaaccaagagaaccacaagtatatacattaccaccatccagagacgaattaacaaaaaatcaagtaagcctaacctgtttagtaaaaggtttctatccatcagatatagcagtagaatgggaatcaaacggacaacctgaaaataattataaaacaacaccaccagtactagacagcgacggatcattcttcctatactcaaaactaacagtcgacaaatcacgttggcaacaaggcaatgtcttttcctgttcagtaatgcatgaagccctacataaccattacacacaaaaatcactaagcctttcaccaggtaaa

SEQ ID NO: 46181 - RNA, 645 nt, synthetic construct
  misc_feature 1..645: note = derived and/or modified sequence opt6 from Gantenerumab_LightChain1
  source 1..645: mol_type = other RNA
gacatagtactaacacaatcaccagcaacactatcactctcaccaggagaaagagcaacactatcatgcagagcctcacaatcagtctcatcatcatacttagcatggtaccaacaaaaaccaggacaagccccaagactactaatatacggagcatcatcacgagctacaggagtacccgcaagattctcaggatcaggatcaggaacagacttcacactaacaatatcatcattagaaccagaagacttcgcaacatactactgcctacaaatatacaacatgcccataactttcggacaaggaacaaaagtagaaatcaaaagaacagtagcagcaccatcagtattcatattcccaccatcagacgaacaactaaaatcaggaacagcatcagtagtatgcctattaaataacttctacccaagagaagcaaaagtacaatggaaagtagacaacgcattacaatcaggaaactcccaagaatcagtaacagaacaagactcaaaagactcaacatactcattatcatcaacactaacattatcaaaagcagactacgaaaaacacaaagtatacgcctgcgaagtaacacaccaaggattatcatcaccagtaacaaaatcattcaaccgcggtgaatgc

SEQ ID NO: 46182 - RNA, 348 nt, synthetic construct
  misc_feature 1..348: note = derived and/or modified sequence opt6 from Gemtuzumab_HeavyChain1
  source 1..348: mol_type = other RNA
caagtacaattacaacaaagcggagcagaactagcaaaaccaggagcaagcgtaaaaatgagctgtaaagcaagcggatacacattcacaagctatagaatgcactgggtaaaacaaagaccaggacaaggactagaatggataggatatataaatccatcaacaggatacacagaatataaccaaaaatttaaagataaagcaacattaacagcagacaaaagctcaagcacagcatatatgcaactatcaagcttaacatttgaagatagtgcagtatattactgtgcaagaggaggaggagtattcgattactggggacaaggaacaacattaacagtaagctca

SEQ ID NO: 46183 - RNA, 351 nt, synthetic construct
  misc_feature 1..351: note = derived and/or modified sequence opt6 from Gemtuzumab_HeavyChain2
  source 1..351: mol_type = other RNA
caagtacaactagtacaaagtggagcagaagtaaaaaaaccaggaagtagtgtaaaagtaagttgtaaagcaagtggaggaacatttagtagaagtgcaataatatgggtaagacaagcaccaggacaaggattagaatggatgggaggaatagtaccaatgtttggaccaccaaattatgcacaaaaatttcaaggaagagtaacaataacagcagatgaaagtacaaatacagcatatatggaattaagtagtttaagaagtgaagatacagcattttatttttgtgcaggaggatatggaatatatagtccagaagaatataatggaggattagtaacagtaagtagt

SEQ ID NO: 46184 - RNA, 321 nt, synthetic construct
  misc_feature 1..321: note = derived and/or modified sequence opt6 from Gemtuzumab_LightChain2
  source 1..321: mol_type = other RNA
gacatacaaatgacacaatcaccatcaacactatcagcatcagtaggagacagagtaacaataacatgcagagcatcacaatcaataaacacatggctagcatggtaccaacaaaaaccaggaaaagcaccaaaactactaatgtacaaagcatcatcactagaatcaggagtaccatcaagattcataggatcaggatcaggaacagaattcacactaacaatatcatcactacaaccagacgacttcgcaacatactactgccaacaatacaactcagactcaaaaatgttcggacaaggaacaaaagtagaagtaaaa

SEQ ID NO: 46185 - RNA, 318 nt, synthetic construct
  misc_feature 1..318: note = derived and/or modified sequence opt6 from Gemtuzumab_ozogamicin_LightChain1
  source 1..318: mol_type = other RNA
caaatagtactaacacaatcaccagcaataatgtcagcatcaccaggagaaaaagtaacaataacatgctcagcatcatcatcaatatcatacatgcactggttccaacaaaaaccaggaacatcaccaaaactatggatatacacaacatcaaacctagcatcaggagtaccagcaagattctcaggatcaggatcaggaacatcatactcactaacaatatcaagaatggaagcagaagacgcagccacatactactgccaccaaagatcaacatacccactaacattcggatcaggaacaaaactagaactaaaa

SEQ ID NO: 46186 - RNA, 1335 nt, synthetic construct
  misc_feature 1..1335: note = derived and/or modified sequence opt6 from Gevokizumab_HeavyChain1
  source 1..1335: mol_type = other RNA
caagttcaactacaggaatcaggaccaggtctagtaaaaccatcccaaaccctatcactaacatgttcattttcaggatttagcctatcaacaagtggaatgggcgtcggatggataagacaaccatccggtaaaggactagaatggcttgcacacatatggtgggatggtgacgaaagctataacccatcccttaaatcaagactaacaatatcaaaagacacatcaaagaaccaagtctcactcaaaataacaagtgtaacagctgcagacacagcagtatatttctgtgcaagaaaccgatacgatccaccatggtttgtagactggggacaaggaacattagtaacagtatcatcagcatcaacaaaaggaccatccgtctttcccctagcaccatgctcaagatcaacatcagaatcaacagcagcattaggttgcttagttaaagactattttcctgaaccagtaacagtatcatggaattcaggagcactaacatctggagtccatacatttcccgcagttttacaatcaagcggactctacagcctatcctcagtagtcaccgtaacatcatcaaacttcggaacacaaacctacacatgcaacgtggaccataaaccaagcaataccaaagttgataaaactgtagaacgaaaatgctgtgtagaatgtccaccatgtcccgcaccccctgtagcaggtccatcagtatttctttttccaccaaaacccaaagacacactaatgatatcacgaacaccagaagtaacatgtgtagtagtagatgttagtcacgaagacccagaagtacaatttaactggtatgtagacggtatggaagttcacaacgcaaaaaccaaaccccgagaagaacaattcaattcaacatttagagtagtttctgtcctaacagtagtacaccaagattggctaaatggaaaagaatacaaatgtaaagtatcaaacaaaggactacccgcaccaatagaaaaaaccataagcaaaacaaaaggccaacccagggaacctcaagtatacaccctaccaccatcacgagaagaaatgactaaaaatcaagtttccctaacatgcctcgtaaaaggattttatccatcagatatagcagtagaatgggaatcaaatggacaacctgaaaacaattataaaacaacaccacccatgttagatagtgatggaagctttttcctatactcaaaattaacagtagacaaaagcagatggcaacaaggaaacgtcttctcatgcagcgtcatgcacgaagcattacacaaccattatacacaaaaatcactctcattatctccagga

SEQ ID NO: 46187 - RNA, 642 nt, synthetic construct
  misc_feature 1..642: note = derived and/or modified sequence opt6 from Gevokizumab_LightChain1
  source 1..642: mol_type = other RNA
gacatacaaatgacacaatcaacatcaagcctaagcgcaagcgtaggagacagagtaacaataacatgcagagcaagccaagacatttcaaattacctaagctggtaccaacaaaaacccggaaaagcagtaaaattactaatatactacacaagcaaactccacagcggagtaccaagcagattctcaggatcaggatcaggaacagactacacactaacaataagctcactacaacaagaagacttcgcaacatacttctgcttacaaggaaaaatgctaccatggacattcggacaaggaacaaaactagaaataaaaagaacagtcgcagcaccaagcgtattcatattcccaccatcagacgaacaactaaaatcaggaacagcatcagtagtatgcttactcaacaatttctacccaagagaagcaaaagtacaatggaaagtagataacgcactacaaagtggaaactcacaagaatcagtaacagaacaagacagcaaagactcaacatacagcttaagctcaacattaactttatcaaaagcagactacgaaaaacacaaagtatacgcatgcgaagtaacacaccaaggactaagctctcccgtaacaaaatccttcaaccgaggagaatgc

SEQ ID NO: 46188 - RNA, 1347 nt, synthetic construct
  misc_feature 1..1347: note = derived and/or modified sequence opt6 from Girentuximab_HeavyChain1
  source 1..1347: mol_type = other RNA
gatgtaaaactcgtagaatcaggaggaggtttagtcaaattaggaggatcactaaaattatcatgtgcagcatccggattcacattttccaactactacatgtcatgggtaagacaaacaccagaaaaacgactagaactagtcgcagcaataaactcagacggcggaataacatactatttagacacagtaaaaggaagatttactatatcgagagataacgcaaaaaacacattatacctacaaatgtcatcattaaaatctgaagacacagccctattctattgtgcacgtcatagatcaggatactttagcatggattactggggccaaggtacctccgtaacagtatcaagcgcatccacaaaaggcccatcagtctttccattagctccatcatcaaaatcaacttcaggaggaacagcagccttaggatgcctcgtcaaagactactttcccgaaccagtaactgtatcatggaattcaggagccctaacctccggcgtacacacattcccagcagtacttcaatcatcaggactatactcattatcatctgtagtaacagtcccatcctcaagtctaggaacacaaacttatatatgtaacgtcaaccacaaaccatccaatacaaaagtagacaaaaaagttgaaccaaaatcatgcgacaaaacacacacatgtcctccatgccccgcgccagaactactaggaggaccctcagtatttctattcccaccaaaaccaaaagacaccctaatgatatcaagaacaccagaagtaacatgcgtagttgtagatgtaagtcacgaagacccagaagtaaaatttaactggtacgtagacggagtcgaagtacacaatgcaaaaacaaaacctagagaagaacaatataacagtacatatcgagtcgtatcagtattaacagtattacatcaagactggctaaatggaaaagaatacaaatgcaaagtatcaaacaaagcactaccagcccccatcgaaaaaacaataagcaaagcaaaaggacaaccacgtgaaccacaagtatacacattaccaccctctagagatgaactaacaaaaaatcaagtatcattaacatgcctagtaaaaggattttatccatcagacatagccgtagaatgggaatcaaacggccaaccagaaaacaactacaaaacaacaccaccagtactagactcagatggatcatttttcttatacagcaaactaaccgttgacaaatcaagatggcaacagggaaatgtattttcatgttcagtaatgcacgaagccctacacaaccactatacccaaaaatctctatcattatctccaggaaaa

SEQ ID NO: 46189 - RNA, 642 nt, synthetic construct
  misc_feature 1..642: note = derived and/or modified sequence opt6 from Girentuximab_LightChain1
  source 1..642: mol_type = other RNA
gatatagtaatgacacaatcacaaagattcatgtcaacaaccgtaggagatagagtaagcataacatgcaaagcatcacaaaacgtagtatcagcagtagcatggtaccaacaaaaaccaggacaatcaccaaaattattaatatatagcgcaagcaatagatacacaggagtaccagacagattcacaggatctggatcaggaacagactttacactaacaataagcaacatgcaatcagaagacttagcagatttcttttgccaacaatatagcaattacccatggacattcggaggaggaacaaaactagaaataaaacgaacggtagcagcaccaagcgtattcatatttccaccatcagacgaacaattaaaatctggaacagcatcagtagtatgcttactaaataacttttacccaagagaagcaaaagtccaatggaaagtagataatgcactacaaagcggaaactcacaagaaagcgttacagaacaagatagcaaagactcaacatatagcttaagctcaacacttacactatcaaaagcagattacgaaaaacacaaagtctacgcatgcgaagtaacacaccaaggattatcctcaccagtaacaaaaagctttaacagaggagaatgc

SEQ ID NO: 46190 - RNA, 1335 nt, synthetic construct
  misc_feature 1..1335: note = derived and/or modified sequence opt6 from Glembatumumab_HeavyChain1
  source 1..1335: mol_type = other RNA
caagtccaactacaagaatctggacccggcctcgtaaaaccatcacaaacattatctttaacatgtacagtctcaggtggatcaatatcatcatttaactattactggtcatggataagacaccatccaggaaaaggactcgaatggataggctacatctactactcaggatctacatacagtaacccatcattaaaatctcgagtaacaataagtgtagacacctcaaaaaaccaattttcactaacactatcatcagtaaccgcagcagatacagcagtatactactgcgcaagaggatacaactggaactacttcgactactggggacaaggcaccttagtaactgtatcctcagcatccacaaaaggaccatctgtcttcccactagccccctgttccagatccacatcagaatcaacagcagcactaggctgcctcgtaaaagactacttccccgaaccagtcacagtatcatggaactcaggagcactcacatcaggagtccatacattccccgctgtcttacaatcatccggcttatattcactatcatcagtagttaccgtcccatcaagtaacttcggaacacaaacatatacatgcaatgtcgatcataaaccttcaaacaccaaagtagataaaactgttgaaagaaaatgctgcgtcgaatgtccaccatgcccagcacctccagttgcaggaccatcagtcttcctatttccaccaaaacccaaagatacattaatgatatcgagaacacccgaagtaacatgcgttgtagtagacgtttcccatgaagacccagaagtacaatttaactggtacgtagacggcgtagaagtacacaatgctaaaacaaaaccccgtgaagaacaatttaactcaacattcagagtagtatcagttctaacagtcgtacaccaagactggttaaatggaaaagagtacaaatgtaaagtatcaaacaaaggactacccgcccccatagaaaaaacaatatcaaaaacaaaaggacaaccaagagaaccacaagtttatacattaccaccatcaagagaagaaatgaccaaaaaccaagtctcactaacctgtttagtaaaaggattctacccatcagacatagcagtagaatgggaatcaaacggacaacccgaaaacaattacaaaacaaccccaccaatgctagactcagatggatcattttttttatactcaaaactaacagtagataaatcaagatggcaacaaggaaacgtattctcatgctcagtaatgcacgaagcactacacaaccactacactcaaaaatccctatctctttctcccggaaaa

SEQ ID NO: 46191 - RNA, 645 nt, synthetic construct
  misc_feature 1..645: note = derived and/or modified sequence opt6 from Glembatumumab_LightChain1
  source 1..645: mol_type = other RNA
gaaatagtaatgacccaatcacccgcaacactatcagtatcaccaggagaaagagcaacactatcatgcagagcctcacaatccgtagacaacaacctagtatggtaccaacaaaaacccggacaagcaccaagactactaatatacggagcatctacaagagcaacaggaataccagcaagattttcaggatcaggaagcggaacagaattcacactaacaatatcatcactacaatcagaagacttcgcagtatactactgccaacaatacaacaactggccaccctggacattcggacaaggaacaaaagtagaaataaaaagaacagtagcagcaccatcagtattcatattcccaccatcagacgaacaattaaaatccggaaccgcatcagtcgtatgcctactaaacaacttctacccacgagaagcaaaagtccaatggaaagttgacaacgcactacaatcaggtaactcacaagaatcagtaacagaacaagactcaaaagactcaacatactcactatcatcaacactaacattatccaaagcagactatgaaaaacacaaagtatacgcatgcgaagtaacacaccaaggactatcatccccagtaactaaatcatttaacagaggagaatgc

SEQ ID NO: 46192 - RNA, 1332 nt, synthetic construct
  misc_feature 1..1332: note = derived and/or modified sequence opt6 from Goilixiab_HeavyChain1
  source 1..1332: mol_type = other RNA
gaagtccaattagttgaatccggaggaggattagcaaaaccaggaggatcactacgactctcatgcgcagcctctggattcagattcacattcaataactactatgattgggtacgacaagctcccggacaaggattagaatgggtatcaagaattagctcatccggagatccaacttggtacgcagattctgtcaaaggccgatttaccatatctagagaaaacgcaaaaaataccctattcctccaaaattcactacgagctgaagacaccgcagtatattactgcgcttcactgacaactggttctgattcatggggacaaggagtacttgtaacagtatcttcagcttcaacaaaaggaccctctgtatttcccctagcaccttcctcaaaatcaacttccggcggcacagcagcactaggatgtttagttaaagactactttccagaaccagtaacagtctcatggaattcaggagctttaacatctggagtccacacattccctgccgtactacaatcttcaggattatattcattatcaagtgttgtaactgtaccctcatcatctttaggaacacaaacatacatctgtaatgtaaaccataaaccttcaaacacaaaagtagacaaaaaagttgaaccaaaatcatgtgacaaaacacacacatgccctccctgtccagccccagaattactaggtggcccatcagtattcctattccctcccaaaccaaaagacactctaatatcaagaacaccagaagtaacatgtgtagtagtagacgtatcacacgaagatccagaagttaaattcaactggtatgtcgacggagtagaagtacataacgcaaaaaccaaaccaagagaagaacaatataactcaacatacagagtagtttcagtactaacagttttacaccaagattggttaaacggaaaagaatataaatgcaaagtttctaataaagcattaccagcacctatagaaaaaacaatatcaaaagcaaaaggacaaccaagagaaccccaagtatacacccttccaccctcaagagacgaattaaccaaaaatcaagtaagtctaacctgcctagtcaaaggtttctacccatcagacattgcagtagaatgggaatcaaacggtcaacccgaaaataactataaaacaacaccaccagtactagactcagatggatccttcttcttatattcaaaattaacagtagataaatcaagatggcaacaaggaaatgtcttctcctgttcagtacacgaagcactacacaatcactacacacaaaaatctcttagcttatcaccaggcaaa

SEQ ID NO: 46193 - RNA, 639 nt, synthetic construct
  misc_feature 1..639: note = derived and/or modified sequence opt6 from Goilixiab_LightChain1
  source 1..639: mol_type = other RNA
gacatacaaacacaatcaccatcatcattatccgcatcagtaggagatagagtcaccataacctgccgagcatcacaagacataagatactacctaaactggtaccaacaaaaacccggaaaagcaccaaaactactaatatatgtcgcatcatcactccaatcaggagtcccatcaagattctcaggatccggatcaggaacagaattcacattaacagtaagctcattacaacccgaagacttcgcaacatactactgcctacaagtctactcaacaccaagaacattcggacaaggaaccaaagtagaaataaaaagaacagtcgcagcaccatcagtattcatattcccaccatcagacgaacaactaaaatcaggaacagcatcagtagtatgcttactaaacaacttctacccaagagaagccaaagtacaatggaaagtagacaacgcactacaatccggaaactcacaagaatcagtaacagaacaagactcaaaagactcaacctactcactaagctcaaccttaacactatcaaaagcagactacgaaaaacacaaagtatacgcatgcgaagtcacacaccaaggtttatcatcaccagtaacaaaaagcttcaacagaggagaatgc

SEQ ID NO: 46194 - RNA, 1338 nt, synthetic construct
  misc_feature 1..1338: note = derived and/or modified sequence opt6 from Guselkumab_HeavyChain1
  source 1..1338: mol_type = other RNA
gaagtacaactagttcaatcaggtgctgaagtaaaaaaacccggtgaatcacttaaaatttcatgtaaaggatctggatacagcttctcaaactattggataggctgggtaagacaaatgcctggaaaaggcttagaatggatgggtatcatcgacccatcaaattcatacacacgatactcaccttcattccaaggacaagtaacaatatcagcagacaaatcaatatcaacagcatatcttcaatggtcatcacttaaagcatcagacaccgcaatgtactattgcgcacgatggtactacaaacccttcgatgtctggggacaaggaacactagttaccgtatcctcagcatcaacaaaaggtccatcagtattccccctagcaccatcatcaaaatcaacatcaggcggaacagctgctctaggctgcctcgtaaaagactatttcccagaaccagttacagtctcatggaattcaggtgcattaacatccggagttcatacattcccagcagtactacaatcatcaggactttactcactatcttcagtagtaacagtaccatcctcatcattaggaacccaaacctacatatgcaatgtaaaccacaaaccctcaaacacaaaagtagacaaaaaagtagaaccaaaatcatgcgataaaacacacacatgcccaccttgtcctgcaccagaactactaggcggaccatccgtattcctgtttcctccaaaaccaaaagacacactaatgatatctagaaccccagaagtaacatgtgtagtagtagatgtatcccatgaagacccggaagtcaaatttaactggtatgtagatggcgtagaagtacataacgcaaaaactaaaccaagagaagaacaatacaattccacatatagagtagtcagcgtcctcactgtattacaccaagactggctaaacggaaaagaatacaaatgcaaagtctcaaacaaagccttaccagccccaatcgaaaaaacaatatcaaaagctaaaggacaaccaagagaaccacaagtctatactttaccaccatctcgagacgaactgacaaaaaatcaagtatcccttacatgtctcgtcaaaggattctacccatctgatatcgcagtagaatgggaatcaaacggccaaccagaaaacaactataaaacaactccaccagtcctagactcagatggatcattcttcctatactcaaaattaacagtagataaaagtcgatggcaacaaggaaatgtattctcatgctcagttatgcatgaagcactacacaaccactacactcaaaaatcactatcactatcacctggt

SEQ ID NO: 46195 - RNA, 651 nt, synthetic construct
  misc_feature 1..651: note = derived and/or modified sequence opt6 from Guselkumab_LightChain1
  source 1..651: mol_type = other RNA
caatcagtactaacacaacccccctcagtatcaggagcacccggacaacgagtcacaatatcatgcacaggatcatcatctaacataggatcaggatacgacgtacactggtaccaacaactaccaggaacagcaccaaaactattaatatacggaaacagcaaacgaccatcaggagtaccagacagattctcaggatcaaaatcaggaacaagtgcaagtctagcaataacaggactacaatcagaagacgaagcagactattactgtgcatcatggaccgacggattaagcctagtagtattcggaggaggaacaaaactaacagtcctaggacaaccaaaagcagcaccctcagtaacattattcccaccatcatcagaagaattacaagcaaacaaagcaacactagtatgcctaatatcagacttctacccaggagcagtaaccgtagcatggaaagcagactcatcaccagtaaaagcaggagtagaaacaacaacaccatcaaaacaatcaaacaacaaatacgcagcatcatcatacctatcactaacaccagaacaatggaaatcacatcgatcatactcatgccaagtaacacacgaaggatctacagtagaaaaaacagtagcaccaacagaatgctca

SEQ ID NO: 46196 - RNA, 360 nt, synthetic construct
  misc_feature 1..360: note = derived and/or modified sequence opt6 from HuMab-001_HeavyChain_VDJ-Region
  source 1..360: mol_type = other RNA
caagtacaactacaacaatggggagcaggactactaaaaccatcagaaacactatcactaacatgcgcagtatacggcggatcattctcaggatattactggaactggataagacaaccaccaggaaaaggactagaatggataggagaaataaaccactcaggatcaacaaactacaacccatcactaaaatcaagagtaacaatatcagtagacacatcaaaaaaccaattctcactaaaattatcatcagtaacagcagccgacacagcagtatactactgcgcaagaggaaactacggatcaggatactactacttcgacctatggggaagaggaacacaagtaacagtatcatca

SEQ ID NO: 46197 - RNA, 321 nt, synthetic construct
  misc_feature 1..321: note = derived and/or modified sequence opt6 from HuMab-001_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatattcgcagcatcatcactacaatcaggagtaccatcaagattctcaggatcaggatcaggaacagacttcacactaacaatatcatcattacaaccagaagacttcgcaacatactactgccaacaatacatatcattcccaataacattcggacaaggaacaagactagaaataaaa

SEQ ID NO: 46198 - RNA, 366 nt, synthetic construct
  misc_feature 1..366: note = derived and/or modified sequence opt6 from HuMab-005_HeavyChain_gamma-Chain_VDJ-Region
  source 1..366: mol_type = other RNA
gaagtacaattagtacaaagtggagcagaagtaaaaaaaccaggagaaagtttaaaaataagttgtaaagcaagtggatatagttttcatttttattggataggatgggtaagacaaatgccaggaaaaggattagaatggatgggaagtatatatccaggagatagtgatacaagatatagaccaagctttcaaggacaagtaacaataagtgcagataaaagtataagtacagcatatttacaatggacaagtttaaaagcaagtgatacagcaatatattactgtgcaagacaaagaggagattattattatttttatggaatggatgtatggggacaaggaacaacagtaacagtaagtagt

SEQ ID NO: 46199 - RNA, 321 nt, synthetic construct
  misc_feature 1..321: note = derived and/or modified sequence opt6 from HuMab-005_LightChain_VJ-Region
  source 1..321: mol_type = other RNA
gaaatagtactaacacaatcaccaggaacattaagcttaagcccaggagaaagagcaacattaagctgtagagcaagccaaagcgtaagctcaagctatctagcatggtatcaacaaaaaccaggacaagtaccaagattactaatatacggagcatcaagcagagcaacaggaataccagatagatttagcggaagcggaagcggaacagatttcacactaacaatatcaagattagaaccagaagatttcgcagtatattactgtcaacaatacggaagctcactaacattcggaggaggaacaaaagtagaaataaaa

SEQ ID NO: 46200 - RNA, 357 nt, synthetic construct
  misc_feature 1..357: note = derived and/or modified sequence opt6 from HuMab-006_HeavyChain_VDJ-Region
  source 1..357: mol_type = other RNA
gaagtacaattattagaatcaggaggaggattagtacaaccaggaggaagtttaagattaagttgtgcagcatcaggatttacatttagtaattatgcactaatatgggtaagacaagcaccaggaaaaggattagaatgggtaagtataataagaggaggggcaggaagcacatattatgcagatagcgtaaaaggaagatttacaataagtagagataatagtaaaaatacactatatttacaaatgaatagtttaagagcagaagatacagcagtatattattgtgcaaaagcaagaatatggggaccattatttgattattggggacaaggaacattagtaacagtaagtagt

SEQ ID NO: 46201 - RNA, 324 nt, synthetic construct
  misc_feature 1..324: note = derived and/or modified sequence opt6 from HuMab-006_LightChain_VJ-Region
  source 1..324: mol_type = other RNA
gaaatagtactaacacaatcaccagcaacattatcattaagtccaggagaaagagcaacattaagctgtagagcaagccaaagcgtaagctcatacttagcatggtaccaacaaaaaccaggacaagcaccaagactactaatatatgacgcaagcaatagagcaacaggaataccagcaagattctcaggatcaggatcaggaacagactttacattaacaataagctcactagaaccagaagactttgcagtatactattgccaacaaagaagcaattggccaccattaacatttggcggaggaacaaaagtagaaataaaa

SEQ ID NO: 46202 - RNA, 360 nt, synthetic construct
  misc_feature 1..360: note = derived and/or modified sequence opt6 from HuMab-019_HeavyChain_VDJ-Region
  source 1..360: mol_type = other RNA
caagtacaactacaacaatggggagcaggactactaaaaccatcagaaacactatcactaacatgcgcagtatacggaggatccttctcagactactactggaactggataagacaaccaccaggaaaaggattagaatggataggagaaatacaccacgtaggatcaacaaactacaacccatcactaaaatcaagagtaacaatatcagtagacacatcaaaatcacaattctcactaaaactatcatcagtaacagcagcagacacagcagtatactactgcgcaagaggatactacgactcaggagtatactacttcgactactgggcacaaggaacactagtaacagtatcatca

SEQ ID NO: 46203 - RNA, 360 nt, synthetic construct
  misc_feature 1..360: note = derived and/or modified sequence opt6 from HuMab-021_HeavyChain_VDJ-Region
  source 1..360: mol_type = other RNA
caagtacaactacaacaatggggagcaggactactaaaaccatcagaaacactatcactaacatgcgcagtatacggaggatcattctcagactactactggaactggataagacaaccaccaggaaaaggactagaatggataggagaaatacaccactcaggatcaacaaactacaacccatcactaaaatcaagagtaacaatatcagtagacacatcaaaaaaccaattctcactaaaactatcatcagtaacagcagcagacacagcagtatactactgcgcaagaggatactacgcatcaggagtatactacttcgactactggggacaaggaacactagtaacagtatcatca

SEQ ID NO: 46204 - RNA, 321 nt, synthetic construct
  misc_feature 1..321: note = derived and/or modified sequence opt6 from HuMab-021_LightChain_VJ-Region
  source 1..321: mol_type = other RNA
gacatacaaatgacacaatcaccatcatcactatcagcatcagtaggagacagagtaacaataacctgcagagcatcacaaggcatatcatcatggctagcatggtaccaacaaaaaccagaaaaagcaccaaaatcactaatatacgcagcatcatcactacaatcaggagtaccatccagattctcaggatcaggatcaggaacagacttcacactaacaatatcatcattacaaccagaagacttcgcaacatactactgccaacaatacaactcatacccaataacattcggacaaggaacaagactagaaataaaa

SEQ ID NO: 46205 - RNA, 360 nt, synthetic construct
  misc_feature 1..360: note = derived and/or modified sequence opt6 from HuMab-025_HeavyChain_VDJ-Region
  source 1..360: mol_type = other RNA
caagtacaactacaacaatggggagcaggactactaaaaccatcagaaacactatcattaacatgcgcagtatacggaggatcattctcagactactactggaactggataagacaaccaccaggaaaaggactcgaatggataggagaaatacaccactcaggatcaacaaactacaacccatcactaaaatcaagagtaacaatatcagtagacacatcaaaaaaccaattctcactaaaactatcatcagtaacagcagcagacacagcagtatactactgcgcaagaggatactacgactcaggagtatactacttcgactactgggcacaaggaacactagtaacagtatcatca

SEQ ID NO: 46206 - RNA, 321 nt, synthetic construct
  misc_feature 1..321: note = derived and/or modified sequence opt6 from HuMab-025_LightChain_VJ-Region
  source 1..321: mol_type = other RNA
gacatacaaatgacacaatcaccatcatcactatcagcatcagtaggagacagagtaacaataacatgcagagcatcacaaggaatatcaagatggctagcatggtaccaacaaaaaccagaaaaagcaccaaaatcactaatatacgcagcatcatcactaagatcaggagtaccatcaagattctcaggatcaggatcaggaacagacttcacactaacaatatcatcactacaaccagaagacttcgcaacatactactgccaacaatacaactcatacccaataacattcggacaaggaacaagactagaaataaaa

SEQ ID NO: 46207 - RNA, 360 nt, synthetic construct
  misc_feature 1..360: note = derived and/or modified sequence opt6 from HuMab-027_HeavyChain_VDJ-Region
  source 1..360: mol_type = other RNA
caagtacaactacaacaatggggagcaggactactaaaaccatcagaaacactatcactaacatgcgcagtatacggaggatcattctcagactacttctggaactggataagacaaccaccaggaaaaggactagaatggataggagaaatacaccactcaggatcaacaaactacaacccatcactaaaatcaagagtaacaatatcagtagacacatcaaaaaaccaattctcactaaacttatcatcagtaacagcagcagacacagcagtatactactgcgcaagaggactaataggatcaggatactactacttcgactactgggaccaaggaacattagtaacagtatcatca

SEQ ID NO: 46208 - RNA, 360 nt, synthetic construct
  misc_feature 1..360: note = derived and/or modified sequence opt6 from HuMab-032_HeavyChain_VDJ-Region
  source 1..360: mol_type = other RNA
caagtacaattacaacaatggggagcaggactactaaaaccatcagaaacactatcactaacatgcgcagtatacggaggatcattctcaggatactactggtcatggataagacaaccaccaggaaaaggactagaatggataggagaaataaaccactcaggagacacaaactacaacccatcactaacatcaagagtaacaatatcagtagacacatcaaaaaaccaattctcactaaaactatcatcagtaacagcagcagacacagcagtatactactgcgcaagattattctacggatcaggaatatactacttcgactactggggacaaggaacactagtaacagtaagctca

SEQ ID NO: 46209 - RNA, 321 nt, synthetic construct
  misc_feature 1..321: note = derived and/or modified sequence opt6 from HuMab-032_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcaacattcagactacaatcaggagtaccatcaagattctcaggatcaggatcaggaacagacttcacactaacaatatcatcactacaaccagaagacttcgcaacatactactgccaacaatacaactcattcccaccaacattcggacaaggaacaaaagtagaaataaaa

SEQ ID NO: 46210 - RNA, 363 nt, synthetic construct
  misc_feature 1..363: note = derived and/or modified sequence opt6 from HuMab-033_HeavyChain_VDJ-Region
  source 1..363: mol_type = other RNA
caagtacaattagtagaaagtggaggaggagtagtacaaacaggaagaagtttaagattaagttgtgcagcaagtggatttacatttagtagtcatgcaatgcattgggtaagacaagcaccaggaaaaggattagaatgggtagcagcaataagttatgatggaagtaataaatattatgcagatagtgtaaaaggaagatttacaataagtagagataatagtaaaaatacattatatttacaaatgaatagtttaagagcagaagatacagcagtatattattgtgcgagaggagattatataagtagtagtggagtatttgattattggggacaaggaacattagtaacagtaagtagt

SEQ ID NO: 46211 - RNA, 360 nt, synthetic construct
  misc_feature 1..360: note = derived and/or modified sequence opt6 from HuMab-035_HeavyChain_VDJ-Region
  source 1..360: mol_type = other RNA
caagtacaactacaacaatggggagcaggactactaaaaccatcagaaacactatcactaacatgcgcaatatacggaggatcattctcaggatattactggtcatggataagacaaccaccaggaaaaggactagaatggataggagaaataaaccactcaggagacacaaactacaacccatcactaacatcaagagtaacaatatcagtagacacatcaaaaaaccaattctcactaaaactatcatcagtaacagcagcagacacagcagtatactactgcgcaagactattctacggatcaggaatatactacttcgactactggggacaaggaacactagtaacagtatcatca

SEQ ID NO: 46212 - RNA, 360 nt, synthetic construct
  misc_feature 1..360: note = derived and/or modified sequence opt6 from HuMab-036_HeavyChain_VDJ-Region
  source 1..360: mol_type = other RNA
caagtacaactacaacaatggggagcaggactactaaaaccaagcgaaacactatcactaacatgcgcagtatacggaggatcattctcagactactactggtcatggataagacaaccaccaggaaaaggactagaatggataggagaaataaaccactcaggatcaacaaactacaacccatcactaaaatcaagagtaacaatatcagtagacacatcaaaaaaccaattctcactaaaactaagctcagtaacagcagcagacacagcagtatactactgcgcaagactatactacggatcaggaacatactacttcgactactggggacaaggaacactagtaacagtatcatca

SEQ ID NO: 46213 - RNA, 321 nt, synthetic construct
  misc_feature 1..321: note = derived and/or modified sequence opt6 from HuMab-036_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctaacatggtaccaacaaaaaccagaaaaagccccaaaatcactaatatacgcagcatcaagactacaatcaggagtaccatcaagattctcaggatcaggatcaggaacagacttcacactaacaatatcatcactacaaccagaagacttcgcaacatactactgccaacaatacaactcattcccaccaacattcggacaaggaacaaaagtagaaataaaa

SEQ ID NO: 46214 - RNA, 366 nt, synthetic construct
  misc_feature 1..366: note = derived and/or modified sequence opt6 from HuMab-041_HeavyChain_VDJ-Region
  source 1..366: mol_type = other RNA
gaagtacaattagtacaaagcggagcagaagtaaaaaaaccaggagaaagcttaaaaataagctgtaaaggaagcggatactcattcacaagctattggataggatgggtaagacaaatgccaggaaaaggactagaatggatgggatcaatatatccaggagactcacacacaagatatagaccaagctttcaaggacaagtaacaataagcgcagacaaaagcataagcacagcatatctacaatggtcaagcttaaaagcaagcgatacagcaatgtattactgtgcaagacaaaaaggagatttctattactttttcggactagatgtatggggacaaggaacagcaataacagtaagctca

SEQ ID NO: 46215 - RNA, 366 nt, synthetic construct
  misc_feature 1..366: note = derived and/or modified sequence opt6 from HuMab-044_HeavyChain_VDJ-Region
  source 1..366: mol_type = other RNA
gaagtacaattagtacaaagtggagcagaagtaaaaaaaccaggagaaagcttaaaaataagttgtaaaggaagtggatatagatttagtagctattggataggatgggtaagacaaatgccaggaaaaggattagaatggatgggaagtatatttccaggagatagtgatacaagatatagtccaagttttcaaggacaagtaacaataagtgcagataaaagtataacaacagcatatttacaatggagtagtttaaaagcaagtgatacagcaatgtattattgtgcaagacaagcaggagattattattattataatggaatggatgtatggggacaaggaacaacagtaacagtaagtagt

SEQ ID NO: 46216 - RNA, 357 nt, synthetic construct
  misc_feature 1..357: note = derived and/or modified sequence opt6 from HuMab-049_HeavyChain_VDJ-Region
  source 1..357: mol_type = other RNA
gaagtacaattattagaaagtggaggagatttagtacaaccaggaggaagtttaagattaagttgtgcagcaagtggatttacatttagtagttatgcaatgagttgggtaagacaagcaccaggaaaaggattagaatgggtaagtgcaataagtggaagaggaggaacaacatattatgcagatagtgtaaaaggaagatttacaataagtagagataatagtaaaagtacattatgtttacaaatgaatagtttaagagcagaagatacagcagtatattattgtgcaaaagcaagagcaaattgggattatttcgattattggggtcaaggaacattagtaacagtaagcagt

SEQ ID NO: 46217 - RNA, 321 nt, synthetic construct
  misc_feature 1..321: note = derived and/or modified sequence opt6 from HuMab-049_LightChain_VJ-Region
  source 1..321: mol_type = other RNA
gacatacaaatgacacaatcaccatcatcagtatccgcatcagtaggagacagagtaacaataacatgcagagcatcacaaggaatatcatcctggctagcatggtaccaacacaaaccaggaaaagcaccaaaactactaatatacgcagcatcaatactacaatcaggagtaccatcacgattctcaggatcaggatcaggaacagacttcacactaacaatatcatcactaagaccagaagacttcgcaacatactactgccaacaagcaaactcattcccaataacattcggacaaggaacaagactagaaataaaa

SEQ ID NO: 46218 - RNA, 357 nt, synthetic construct
  misc_feature 1..357: note = derived and/or modified sequence opt6 from HuMab-050_HeavyChain_VDJ-Region
  source 1..357: mol_type = other RNA
gaagtacaattattagaaagtggaggaggattagtacaaccaggaggaagtttaagattaagttgtgcagcaagtggatttacatttagtagttatgcaatgaattgggtaagacaagcaccaggaaaaggattagaatgggtaagtgcaataagtggaagaggaggaacaacatattatgcagatagtgtaaaaggaagatttacaataagtagagataatagcaaaaatacactatatttacaaatgagtagtttaagagcagaagatacagcagtatattattgtgcaaaagcaagagcaaattgggattattttgattattggggacaaggaacattagtaacagtaagtagt

SEQ ID NO: 46219 - RNA, 321 nt, synthetic construct
  misc_feature 1..321: note = derived and/or modified sequence opt6 from HuMab-050_LightChain_VJ-Region
  source 1..321: mol_type = other RNA
gacatacaaatgacacaatcaccatcatcagtatcagcatcagtaggagacagagtaacaataacatgcagagcatcacaaggaatatcatcatggctagcatggtaccaacacaaaccaggaaaagcaccaaaactactaatatacgcagcatcaatattacaatcaggagtaccatcaagattctcaggatcaggatcaggaacagacttcacattaacaatatcatcactacaaccagaagacttcgcaacatactactgccaacaagcaaactcattcccaataacattcggacaaggaacaagactagaaataaaa

SEQ ID NO: 46220 - RNA, 360 nt, synthetic construct
  misc_feature 1..360: note = derived and/or modified sequence opt6 from HuMab-054_HeavyChain_VDJ-Region
  source 1..360: mol_type = other RNA
caagtacaactacaacaatggggagcaggactactaaaaccatcagaaacactatcattaacatgcgcagtatacggaggatcattctcaggatactactggtcatggataagacaaccaccaggaaaaggactagaatggataggagaaatacaccactcaggatcaacaaactacaacccatcactaaaatcaagagtaacaatatccgtagacacatcaaaaaaccaattctcactaaaactatcatcagtaacagcagcagacacagcagtatactactgcgcaagactatggtacggatcaggatcatactacttcgactactggggacaaggaacactagtaacagtatcatca

SEQ ID NO: 46221 - RNA, 321 nt, synthetic construct
  misc_feature 1..321: note = derived and/or modified sequence opt6 from HuMab-054_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcattcccaccaacattcggaggaggaacaaaagtagaaataaaa

SEQ ID NO: 46222 - RNA, 357 nt, synthetic construct
  misc_feature 1..357: note = derived and/or modified sequence opt6 from HuMab-055_HeavyChain_VDJ-Region
  source 1..357: mol_type = other RNA
gaagtacaattattagaatcaggaggaggattagtacaaccaggaggatcattaagattatcatgtgcagcatcaggatttacatttagttcatatgcaatgaattgggtaagacaagcaccaggaaaaggattagaatgggtatcagcaataagcggaagaggaggaacaacatattatgcagattcagtaaaaggaagatttacaatatcaagagataatagtaaatcaacattatgtttacaaatgaattcattaagagcagaagatacagcagtatattattgtgcaaaagcaagagcaaattgggattattttgattattggggacaaggaacattagtaacagtaagttca

SEQ ID NO: 46223 - RNA, 366 nt, synthetic construct
  misc_feature 1..366: note = derived and/or modified sequence opt6 from HuMab-059_HeavyChain_VDJ-Region
  source 1..366: mol_type = other RNA
caagtacaattagtacaaagcggagcagaagtaaaaaaaccaggagcaagcgtaagagtaccatgtaaagcaagcggatacacattcacaagatatggaataagctgggtaagacaagcaccaggacaaggactagaatggatgggatggatatcagcatataacggaaaaacatactatgcacaaaaattacaaggaagagtaacaatgacaacagacacaagcacaagcacagcatatatggaactaagaagcttaagatcagacgatacagcagtatattactgtgcaagaagcccactattatggtttgaagaactatatttcgattactggggacaaggaacactagtaacagtaagctca

SEQ ID NO: 46224 - RNA, 324 nt, synthetic construct
  misc_feature 1..324: note = derived and/or modified sequence opt6 from HuMab-059_LightChain_VJ-Region
  source 1..324: mol_type = other RNA
gaaatagtactaacacaatcaccaggaacactatcattatcaccaggagaaagagcaacactatcatgccgagcatcacaatcagtatcatcaacatacctagcatggtaccaacaaaaaccaggacaagcaccaagactattaatatacggagcatcatcaagagcaacaggaataccagacagattctcaggatcaggatcaggaacagacttcacactaacaatatcaagactagaaccagaagacttcgcagtatactactgccaacaatacggaacatcactattcacattcggaccaggaacaaaagtagacataaaa

SEQ ID NO: 46225 - RNA, 366 nt, synthetic construct
  misc_feature 1..366: note = derived and/or modified sequence opt6 from HuMab-060_HeavyChain_VDJ-Region
  source 1..366: mol_type = other RNA
gaagtacaattagtacaaagtggagcagaagtaaaaaaaccaggagaaagtttaaaaataagttgtaaaggaagtggatatagatttacaagttattggataggatgggtaagacaaatgccaggaaaaggattagaatggatgggatcaatatatccaggagatagttatacaagaaatagtccaagttttcaaggacaagtaacaataagtgcagataaaagtatagcaacagcatatttacaatggaatagtttaaaagcaagtgatacagcaatgtattattgtgcaagacatgcaggagatttttattattttgatggattagatgtatggggacaaggaacaacagtaacagtaagtagt

SEQ ID NO: 46226 - RNA, 327 nt, synthetic construct
  misc_feature 1..327: note = derived and/or modified sequence opt6 from HuMab-060_LightChain_VJ-Region
  source 1..327: mol_type = other RNA
gaaatagtactaacacaatcaccaggaacactatcactatcaccaggagaaagagcaacactatcatgcagagcatcacaatcagtatcatcatcatacctagcctggtaccaacaaaaaccaggacaagcaccaagactactaatatacggagcatcatcaagagcaacaggaataccagacagattctcaggatcaggatcaggaacagacttcacactaacaatatcaagactagaaccagaagacttcgcagtatactactgccaacaatacggatcatcaccaccaataacattcggacaaggaacaagactagaaataaaa

SEQ ID NO: 46227 - RNA, 366 nt, synthetic construct
  misc_feature 1..366: note = derived and/or modified sequence opt6 from HuMab-067_HeavyChain_VDJ-Region
  source 1..366: mol_type = other RNA
gaagtacaattagtacaaagcggagcagaagtaaaaaaaccaggagaaagcttaaaaataagttgtaaaggaagcggatattcattcacaagctattggataggatgggtaagacaaatgccaggaaaaggattagaatggatgggaataatatatccaggagactcagacacaagatatagcccaagttttcaaggacaagtaacaataagcgtagacaaaagcataagcacagcatatttacaatggtcaagtttaaaagcaagcgatacagcaatgtattactgtgcaagacaaaaaggagattactattaccattacggactagatgtatggggacaaggaacaacagtaacagtaagttca

SEQ ID NO: 46228 - RNA, 366 nt, synthetic construct
  misc_feature 1..366: note = derived and/or modified sequence opt6 from HuMab-072_HeavyChain_VDJ-Region
  source 1..366: mol_type = other RNA
gaagtacaattagtacaaagcggagcagaagtaaaaaaaccaggagaaagcttaaaaataagctgtaaaggaagcggatactcattcacaagttattggataggatgggtaagacaaatgccaggaaaaggactagaatggatgggaataatatatccaggagacagtgacacaagatatagcccgagctttcaaggacaagtaacaataagcgcagacaaaagcataagtacagcatatttacaatggtcaagcttaaaagcaagtgatacagcaatgtattactgtgcaagacaaaaaggagattactattactttaacggactagatgtatggggacaaggaacaacagtaacagtaagctca

SEQ ID NO: 46229 - RNA, 327 nt, synthetic construct
  misc_feature 1..327: note = derived and/or modified sequence opt6 from HuMab-072_LightChain_VJ-Region
  source 1..327: mol_type = other RNA
gaaatagtattaacacaatcaccaggaacattaagcctaagcccaggagaaagagcaacattaagctgtagagcaagccaatcagtaagctcaagctatctagcatggtatcaacaaaaaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacaatacggaagttcaccaagactaacattcggaggaggaacaaaagtagaaataaaa

SEQ ID NO: 46230 - RNA, 363 nt, synthetic construct
  misc_feature 1..363: note = derived and/or modified sequence opt6 from HuMab-084_HeavyChain_VDJ-Region
  source 1..363: mol_type = other RNA
caagtacaactagtacaatcaggagcagaagtaaaaaaaccaggaagctcagtaaaagtatcatgcaaagcatcaggaggaacatttagaacatacgcaataaattgggtaagacaagcaccaggacaaggactagaatggatgggaagaataaacacagtattaggaatagtaaatcacgcacaaaaattccaaggaagagtaacaataacagcagataaatcaacaaatacagcatacatggaattaaactcactaagaagcgaagacacagcagtatactattgcgcaagagaaaaaggagtagattactattacggaatagaggtatggggacaaggaacaacagtaacagtaagctca

SEQ ID NO: 46231 - RNA, 321 nt, synthetic construct
  misc_feature 1..321: note = derived and/or modified sequence opt6 from HuMab-084_LightChain_VJ-Region
  source 1..321: mol_type = other RNA
gacatacaaatgacacaatcaccatcatcagtatcagcatcagtaggagacagagtaacaataacatgcagagcatcacaaggaatatcatcatggctagcatggtaccaacacaaaccaggaaaagcaccaaaattactaatatacgtagcatcaacactacaatcaggagtaccatcaagattctcaggatcaggatcaggaacagacttcacactaacaatatcatcactacaaccagaagacttcgcaacatactactgccaacaagcaaactcattcccactaacattcggaggaggaacaaaagtagaaataaaa

SEQ ID NO: 46232 - RNA, 360 nt, synthetic construct
  misc_feature 1..360: note = derived and/or modified sequence opt6 from HuMab-091_HeavyChain_VDJ-Region
  source 1..360: mol_type = other RNA
caagtacaactacaacaatggggagcaggattactaaaaccatcagaaacactatcactaacatgcgcagtatcaggaggatcattctcaggatactactggacatggataagacaaccaccaggaaaaggactagaatggataggagaaatataccactcaggagacacaaactacaacccatcactaaaatcaagagtaacaatatcagtagacacatcaaaaaaccaattctcactaaaactatactcagtaacagcagcagacacagcagtatactactgcgcaagactatacttcggatcaggaatatactacctagactactggggacaaggcacactagtaacagtatcatca

SEQ ID NO: 46233 - RNA, 321 nt, synthetic construct
  misc_feature 1..321: note = derived and/or modified sequence opt6 from HuMab-091_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagtatggtaccaacaaaaaccagaaaaagcaccaaaatcactaatatacgcagcatcatcactacaatcaggagtaccatcaagattctcaggatcaggatcaggaacagacttcacattaacaatatcatcactacaaccagaagacttcgcaacatactactgccaacaatacaactcattcccaccaacattcggacaaggaacaaaagtagaaataaaa

SEQ ID NO: 46234 - RNA, 366 nt, synthetic construct
  misc_feature 1..366: note = derived and/or modified sequence opt6 from HuMab-093_HeavyChain_VDJ-Region
  source 1..366: mol_type = other RNA
gaagtacaattagtacaaagcggagcagaagtaaaaaaaccaggagaaagcttaaaaataagttgtaaaggaagcggatactcattcacaagttattggataggctgggtaagacaaatgccaggaaaaggactagaatggatgggaagaatatatccaggagactcagatacaagatatagcccaagctttcaaggacaagtaacaataagcgcagacaaaagcataacaacagcatatctacaatggtcaagcttaagagcaagcgatacagcaatgtattactgtgcaagacaaagaggagattactattactttttcggactagatatatggggacaaggaacaacagtaacagtaagttta

SEQ ID NO: 46235 - RNA, 372 nt, synthetic construct
  misc_feature 1..372: note = derived and/or modified sequence opt6 from HuMab-098_HeavyChain_VDJ-Region
  source 1..372: mol_type = other RNA
gaagtacaattactagaaagcggaggaggactagtacaaccaggaggaagtttaagattaagctgtgcagcaagcggattcacattctcaaactatggaatgagctgggtaagacaagcaccaggaaaaggactagaatgggtaagcgcaatatcaggatcagcatatagcacatactatgcagatagcgtgaaaggaagatttacaataagtagagacaatagcaaaaacacactatggctacaaatgaatagcttaagagcagaagatacagcagtatattactgtgcaaaagcacattaccatggatcaggatcatactatacattattcgattactggggacaaggaacactagtaacagtaagctca

SEQ ID NO: 46236 - RNA, 321 nt, synthetic construct
  misc_feature 1..321: note = derived and/or modified sequence opt6 from HuMab-098_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcatacccatacacattcggacaaggaacaaaactagaaataaaa

SEQ ID NO: 46237 - RNA, 372 nt, synthetic construct
  misc_feature 1..372: note = derived and/or modified sequence opt6 from HuMab-100_HeavyChain_VDJ-Region
  source 1..372: mol_type = other RNA
gaagtacaattactagaaagtggaggaggactagtacaaccaggaggaagtttaagattaagctgtgcagcaagcggattcacattcaataactatggaatgaactgggtaagacaagcaccaggaaaaggactagaatgggtaagtgcaatatcaggaacaggatatagcacatactatgcagatagtgtaaaaggaagatttacaataagcagagacaatagcaaaaacacactatatctacaaatgaatagcttaagagcagaagatacagcagtatattactgtgcaaaagcacattactttggatcaggatcatactatacattattcgattactggggacaaggaacactagtaacagtaagctca

SEQ ID NO: 46238 - RNA, 372 nt, synthetic construct
  misc_feature 1..372: note = derived and/or modified sequence opt6 from HuMab-106_HeavyChain_VDJ-Region
  source 1..372: mol_type = other RNA
gaagtacaattggtacaaagtggagcagaagtaaaaaaaccaggagaaagtttaaaaataagctgtaaaggaagcggatacagtttcacaagatattggataggatgggtaagacaaatgccaggaaaaggactagaatggatgggaataatatatccaggagactcagacacaagatatagtccaagctttcaaggacaagtaacaataagtgcagacaaaagcataagcacagcatatctacaatggtcaagtttaaaagcaagtgatacagcaatgtattactgtgcaagactaacaggagatagaggattcgattactatagtggaatggatgtatggggacaaggaacaacagtaacagtaagttca

SEQ ID NO: 46239 - RNA, 321 nt, synthetic construct
  misc_feature 1..321: note = derived and/or modified sequence opt6 from HuMab-106_LightChain_VJ-Region
  source 1..321: mol_type = other RNA
gaaatagtactaacacaatcaccaggaacattaagtttaagcccaggagaaagagcaacattatcatgtagagcaagtcaaagcgtaagctcaagctatctagcatggtatcaacaaaaaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacaatacggaagctcattcacattcggaccaggaacaaaagtagatataaaa

SEQ ID NO: 46240 - RNA, 351 nt, synthetic construct
  misc_feature 1..351: note = derived and/or modified sequence opt6 from HuMab_10F8_HeavyChain_V-Region
  source 1..351: mol_type = other RNA
caagtacaattagtagaaagtggaggaggagtagtacaaccaggaagaagcttaagattaagttgtacagcaagtggatttacatttagtcattatggaatgtattgggtaagacaagcaccaggaaaaggattagaatgggtagcagtaatatggtatgatggaagttatgaatataatgaagatagtgtaaaaggaagatttacaataagtagagataatagtaaaaatacattatatttacaaatgaatagtttaagagcagaagatacagcagtatattattgtgcaagagatagagtaggattatttgattattggggacaaggaacattagtaacagtaagtagt

SEQ ID NO: 46241 - RNA, 408 nt, synthetic construct
  misc_feature 1..408: note = derived and/or modified sequence opt6 from HuMab_10F8_HeavyChain_V-Region_Precursor
  source 1..408: mol_type = other RNA
atggaatttggattaagttgggtatttttagtagcattattaagaggagtacaatgtcaagtacaattagtagaaagcggaggaggagtagtacaaccaggaagaagtttaagactaagttgtacagcaagtggatttacatttagtcattatggaatgtattgggtaagacaagcaccaggaaaaggattagaatgggtagcagtaatatggtatgatggaagttatgaatataatgcagatagtgtaaaaggaagatttacaataagtagagataatagtaaaaatacattatatctacaaatgaatagtttaagagcagaagatacagcagtatattattgtgcaagggatagagtaggattatttgattattggggacaaggaacattagtaacagtaagtagc

SEQ ID NO: 46242 - RNA, 321 nt, synthetic construct
  misc_feature 1..321: note = derived and/or modified sequence opt6 from HuMab_10F8_LightChain_V-Region
  source 1..321: mol_type = other RNA
gaaatagtactaacacaatcaccaggaacactatcactatcaccaggagaaagagcaacactatcatgcagagcatcacaatcaatatcatcatcatacctagcatggtatcaacaaaaaccaggacaagcaccaagactactaatatacggaccatcatcaagagcaacaggaataccagacagattcagcggatcaggatcaggaacagacttcacactaacaatatcaagactagaaccagaagacttcgcagtatactactgtcaacaatacgcaggatcactaacattcggacccggaacaaaagtagacataaaa

SEQ ID NO: 46243 - RNA, 381 nt, synthetic construct
  misc_feature 1..381: note = derived and/or modified sequence opt6 from HuMab_10F8_LightChain_V-Region_Precursor
  source 1..381: mol_type = other RNA
atggaaacacccgcacaattactatttctactactactatggctaccagacacaacaggagaaatagtactaacacaatcaccaggaacactatcactatcaccaggagaaagagcaacattatcatgcagagcatcacaatcaatatcatcatcatacctagcatggtatcaacaaaaaccaggacaagcaccaagactactaatatacggaccatcatcaagagcaacaggaataccagacagattcagcggatcaggatcaggaacagacttcacactaacaatatcaagactagaaccagaagacttcgcagtatattactgccaacaatacgcaggatcactaacattcggaccaggaacaaaagtagacataaaa

SEQ ID NO: 46244 - RNA, 357 nt, synthetic construct
  misc_feature 1..357: note = derived and/or modified sequence opt6 from HuMab-111_HeavyChain_VDJ-Region
  source 1..357: mol_type = other RNA
caagtacaattagtacaaagtggagcagaagtaaaaaaaccaggaagcagtgtaaaagtaagttgtaaagcaagtggaggaacatttagtagttatggaataagttgggtaagacaagcaccaggaccaggattagaatggatgggaagaataataccaatattaggaatagcaaattatgcacaaaaatttcaaggaagagtaacaataacagcagataaaagtacaaatacagcatatatggaactaagtagtttaagaagtgaagatacagcagtatattattgtgcaagagatcaagaatatagtagtaattggtattattggggacaaggaacattagtaacagtaagtagt

SEQ ID NO: 46245 - RNA, 321 nt, synthetic construct
  misc_feature 1..321: note = derived and/or modified sequence opt6 from HuMab-111_LightChain_VJ-Region
  source 1..321: mol_type = other RNA
gaaatagtactaacacaatcaccaggaacattaagcttaagtccaggagaaagagcaacattaagctgtagagcaagccaaagcgtaagatcaagctatctagcatggtatcaacaaaaaccaggacaagcaccaagactactaatatacggagcatcaagcagagcaacaggaataccagatagatttagcggaagcggaagcggaacagatttcacactaacaatatcaagattagaaccagaagatttcgcagtatattactgtcaattatacggaagctcaccaacattcggaccaggaacaaaagtagatataaaa

SEQ ID NO: 46246 - RNA, 363 nt, synthetic construct
  misc_feature 1..363: note = derived and/or modified sequence opt6 from HuMab-123_HeavyChain_VDJ-Region
  source 1..363: mol_type = other RNA
caagtacaattagtacaatcaggagcagaagtaaaaaaaccaggagcatcagtaaaagtatcatgcaaagcagcaggatatacatttacaaattacggaatatcatgggtaagacaagcaccaggacaagcattagaatggatgggatggataacaacatactcaagcaatacaatatacgcacaaaaactacaaggaagagtaacaatgacaacagatacatcaacatcaacagcatacatggaattaagatcactaagaagcgatgacacagcagtatactattgcgcaagagatagagtagtagtaagaccagactatttcgattactggggacaaggaacactagtaacagtaagctca

SEQ ID NO: 46247 - RNA, 321 nt, synthetic construct
  misc_feature 1..321: note = derived and/or modified sequence opt6 from HuMab-123_LightChain_VJ-Region
  source 1..321: mol_type = other RNA
gaaatagtactaacacaatcaccagcaacactatcactaagcccaggagaaagagcaacactatcatgcagagcatcacaatcagtatcatcatacctagcatggtaccaacaaaaaccaggacaagcaccaagactactaatatacgacacatcaaaccgagcaacaggaataccagcaagattctcaggatcaggatcaggaacagacttcacactaacaatatcatcactagaaccagaagacttcgcagtatactactgccaacaaagatcacactggccaagaacattcggacaaggaacaaaagtagaaataaaa

SEQ ID NO: 46248 - RNA, 363 nt, synthetic construct
  misc_feature 1..363: note = derived and/or modified sequence opt6 from HuMab-124_HeavyChain_VDJ-Region
  source 1..363: mol_type = other RNA
caagtacaactagtacaatcaggagcagaagtaaaaaaaccaggagcatcagtaaaagtatcatgcaaagcagcaggatatacatttacaaattacggaatatcatgggtaagacaagcaccaggacaaggactagaatggatgggatggataataacatacaatggaaatacaatatacgcacaaagattccaagacagagtaacaatgacaacagatacatcaacatcaacagcatacatggaattaagatcactaagaagcgatgacacagcagtatactattgcgcaagagacagaataatagtaagaccagactatttcgattactggggacaaggaacactagtaacagtaagctca

SEQ ID NO: 46249 - RNA, 372 nt, synthetic construct
  misc_feature 1..372: note = derived and/or modified sequence opt6 from HuMab-125_HeavyChain_VDJ-Region
  source 1..372: mol_type = other RNA
gaagtacaattactagaaagcggaggaggactagtacaaccaggaggaagcttaagactaagctgtgcagcaagcggattcacattcacagactatgcaatgaactgggtaagacaagcaccaggaaaaggactagaatgggtaagcacaatatcaggatcaggatatgcaacatactatgcagatagcgtaaaaggaagatttacaataagcagagacaattcaaaaacaacattatatctacaaatgaatagcttaagagcagaagatacagcagtatattactgtgcaaaaggacatacattaggatcaggatcatactatacattattcgattactggggacaaggaacactagtgacagtaagctca

SEQ ID NO: 46250 - RNA, 321 nt, synthetic construct
  misc_feature 1..321: note = derived and/or modified sequence opt6 from HuMab-125_LightChain_VJ-Region
  source 1..321: mol_type = other RNA
gacatacaaatgacacaatcaccatcatcactatcagcatcagtaggagacagagtaacaataacatgcagagcatcacaaggaataaactcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcatacccatacacattcggacaaggaacaaaactagaaataaaa

SEQ ID NO: 46251 - RNA, 369 nt, synthetic construct
  misc_feature 1..369: note = derived and/or modified sequence opt6 from HuMab-127_HeavyChain_VDJ-Region
  source 1..369: mol_type = other RNA
gaagtacaattagtacaaagtggagcagaagtaaaaaaaccaggagaaagcttaacaataagttgtaaaggaagtggatatagttttagtatatattggataggatgggtaagacaaatgccaggaaaaggattagaatggatgggaataatatttccaggagatagtgatataagatatagtccaagttttcaaggacaagtaacaataagtgcagataaaagcataagtacagcatatttacaatggagtagtttaaaagcaagtgatacagcaatgtattattgtgcaagacaaccaggagattggagtccaagacattggtattttgatttatggggaagaggaacattagtaacagtaagtagt

SEQ ID NO: 46252 - RNA, 321 nt, synthetic construct
  misc_feature 1..321: note = derived and/or modified sequence opt6 from HuMab-127_LightChain_VJ-Region
  source 1..321: mol_type = other RNA
gtaatatggatgacacaatcaccatcactactatcagcatcaacaggagacagagtaacaatatcatgcagaatgtcacaaggaatatcatcatacctagcatggtaccaacaaaaaccaggaaaagcaccagaactactaatatacgcagcatcaacactacaatcaggagtaccatcaagattctcaggatcaggatcaggaacagacttcacactaacaatatcatacctacaatcagaagacttcgcaacatactactgccaacaatactactcattcccactaacattcggaggaggaacaaaagtagaaataaaa

SEQ ID NO: 46253 - RNA, 357 nt, synthetic construct
  misc_feature 1..357: note = derived and/or modified sequence opt6 from HuMab-129_HeavyChain_VDJ-Region
  source 1..357: mol_type = other RNA
caagtacaattagtagaaagtggaggaggagtagtacaaccaggaagaagtttaagactaagttgtgcagcaagtggatttacatttagtacatttgcaatacattgggtaagacaagcaccaggaaaaggattagaatgggtagcagtaataagttatgatggaggacataaattttatgcagatagtgtaaaaggaagatttacaataagcagagataatagtaaaaatacattatatttacaaatgaatagtttaagagcagaagatacagcaatgtattattgtgcaagaggattaggagtatggggggcatttgattattggggacaaggaacattagtaacagtaagtagt

SEQ ID NO: 46254 - RNA, 318 nt, synthetic construct
  misc_feature 1..318: note = derived and/or modified sequence opt6 from HuMab-129_LightChain_VJ-Region
  source 1..318: mol_type = other RNA
gaaatagtattaacacaatcaccagcaacattaagcttaagcccaggagaaagagcaacattaagctgtagagcaagccaaagtgtaagctcatacttagcatggtaccaacaaaaaccaggacaagcaccaagattattaatatatgacgcaagcaatagagcaacaggaataccagcaagattctcaggatcaggatcaggaacagactttacattaacaataagctcactagaaccagaagactttgcagtatactattgccaacaaagaagcaattggtggacatttggccaaggaacaaaagtagaaataaaa

SEQ ID NO: 46255 - RNA, 375 nt, synthetic construct
  misc_feature 1..375: note = derived and/or modified sequence opt6 from HuMab-132_HeavyChain_VDJ-Region
  source 1..375: mol_type = other RNA
caagtacaattagtacaatcaggagcagaagtaaaaaaaccaggagcatcagtaaaagtatcatgcaaagcatcaggatatacatttacatcatacggaatatcatgggtaagacaagcaccaggacaaggactagaatggatgggatggataagcgcatacaatggaaatagcaattacgtacaaaaattccaaggaagagtaacaatgacaacagatacaacaacatcaacagcatacatggaattaagatcactaacaagcgatgacacagcagtatactattgcgcaagagaatactcatacgatagcggaacatatttctattacggaatggatgtatggggacaaggaacaacagtaacagtaagctca

SEQ ID NO: 46256 - RNA, 324 nt, synthetic construct
  misc_feature 1..324: note = derived and/or modified sequence opt6 from HuMab-132_LightChain_VJ-Region
  source 1..324: mol_type = other RNA
gaaatagtactaacacaatcaccagcaacactatcactatcaccaggagaaagagcaacactatcatgcagagcatcacaatcagtatcatcatacctagcatggtaccaacaaaaaccaggacaagcaccaagactactaatatacgacgcatcaaacagagcaacaggaataccagcaagattctcaggatcaggatcaggaacagacttcaccctaacaatatcctcactagaaccagaagacttcgcagtatactactgccaacaaagatcaaactggccaatgtacacattcggacaaggaacaaaactagaaataaaa

SEQ ID NO: 46257 - RNA, 360 nt, synthetic construct
  misc_feature 1..360: note = derived and/or modified sequence opt6 from HuMab-143_HeavyChain_VDJ-Region
  source 1..360: mol_type = other RNA
caagtacaattacaacaatggggagcaggattattaaaaccaagcgaaacattaagcttaacatgtgcagtatacggaggatcattctcaggatattactggaactggataagacaaccaccaggaaaaggactagaatggataggagaaatacatcactcaggatcagcaaattacaatccatcactaatgagcagagtaacaatatcagtagatacatcaaaaaatcaatttagcttacaattaagctcagtaacagcagcagacacagcagtatactattgcgcaagaggatactatggatcaggatattactatttcgattactggggacaaggaacactagtaacagtaagttca

SEQ ID NO: 46258 - RNA, 321 nt, synthetic construct
  misc_feature 1..321: note = derived and/or modified sequence opt6 from HuMab-143_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatccctaatatacgcagcatcaagattacaatcaggagtaccatcaagattctcaggatcaggatcaggaacagacttcacactaacaatatcatcactacaaccagaagacttcgcaacatactactgccaacaatacaactcatacccaataacattcggacaaggaacaagactagaaataaaa

SEQ ID NO: 46259 - RNA, 366 nt, synthetic construct
  misc_feature 1..366: note = derived and/or modified sequence opt6 from HuMab-150_HeavyChain_VDJ-Region
  source 1..366: mol_type = other RNA
gaagtacaattagtacaaagtggagcagaagtaaaaaaaccaggagaaagcttaaaaataagctgtaaaggaagcggatactcattcacaagctattggataggatgggtaaggcaaatgccaggaaaaggactagaatggatgggatcaatatatccaggagactcacacacaagatatagaccaagctttcaaggacaagtaacaataagcgcagacaaaagcataagcacagcatatctacaatggtcaagcttaaaagcaagcgatacagcaatgtattactgtgcaagacaagcaggagattactattactataacggaatggatgtatggggacaaggaacaacagtaacagtaagctca

SEQ ID NO: 46260 - RNA, 321 nt, synthetic construct
  misc_feature 1..321: note = derived and/or modified sequence opt6 from HuMab-150_LightChain_VJ-Region
  source 1..321: mol_type = other RNA
gaaatagtactaacacaatcaccaggaacactaagcttaagcccaggagaaagagcaacattaagctgtagagcaagccaaagcgtatcatcatcatatctaacatggtatcaacaaaaaccaggacaagcaccaagattactaatatacggagcatcaagcagagcaacaggaataccagatagatttagtggaagcggaagcggaacagatttcacactaacaatatcaagattagaaccagaagatttcgcagtatattactgtcaacaatacggatcatcactaacattcggaggaggaacaaaagtagaaataaaa

SEQ ID NO: 46261 - RNA, 363 nt, synthetic construct
  misc_feature 1..363: note = derived and/or modified sequence opt6 from HuMab-152_HeavyChain_VDJ-Region
  source 1..363: mol_type = other RNA
caagtacaagtagtagaaagtggaggaggagtagtacaaccaggaagaagtttaagattaagttgtgcagcaagtggatttacatttagtagttatgcaatgcattgggtaagacaagcaccaggaaaaggattagaatgggtagcagtaataagttatgatggaagttataaatattatgcagatagtgtaaaaggaagatttacaataagtagagataatagtaaaaatacattatatttacaaatgaatagtttaagagcagaagatacagcagtatattattgtgcaagaggaagtataacaggaagtacaggagtatttgattattggggacaaggaacattagtaacagtaagtagt

SEQ ID NO: 46262 - RNA, 321 nt, synthetic construct
  misc_feature 1..321: note = derived and/or modified sequence opt6 from HuMab-152_LightChain_VJ-Region
  source 1..321: mol_type = other RNA
gacatacaaatgacacaatcaccatcatcactatcagcatcagtaggagacagagtaacaataacatgcagagcatcacaaggaataaactcatggctagcatggtaccaacaaaaaccagaaaaagcaccaaaatcactaatatacgacgcatcatcactacaatcaggagtaccatcaagattctcaggatcaggatcaggaacagacttcacactaacaatatcatcactacaaccagaaaacttcgcaacatactactgccaacaatacaactcatacccaataacattcggacaaggaacaagactagaaataaaa

SEQ ID NO: 46263 - RNA, 363 nt, synthetic construct
  misc_feature 1..363: note = derived and/or modified sequence opt6 from HuMab-153_HeavyChain_VDJ-Region
  source 1..363: mol_type = other RNA
caagtacaattagtagaaagtggaggaggagtagtacaaccaggaagaagtttaagattaagttgtgcagcaagtggatttacatttagtgattatgtaatacactgggtaagacaagcaccaggaaaaggattagaatgggtaacagtaataagttatgatggaagtaataaatattatgcagatagtgtaaaaggaagatttacaataagtagagataatagtaaaaatacattatatttacaaatgaatagtttaagtgcagaagatacagcaatgtattattgtgcaagaggaggaataacagggacaacaggagtatttgattattggggacaaggaacattagtaacagtaagtagt

SEQ ID NO: 46264 - RNA, 321 nt, synthetic construct
  misc_feature 1..321: note = derived and/or modified sequence opt6 from HuMab-153_LightChain_VJ-Region
  source 1..321: mol_type = other RNA
gacatacaaatgacacaatcaccatcatcattatcagcatcagtaggagacagagtaacaataacatgccgagcatcacaaggaatatcatcatggctagcatggtaccaacaaaaaccagaaaaagcaccaaaatcactaatatacgacgcatcatcactacaatcaggagtaccatcaagattctcaggatcaggatacggaacagacttctcactaacaatatcatcactacaaccagaagacttcgcaatatactactgccaacaatacaaatcatacccaataacattcggacaaggaacaagactagaaataaaa

SEQ ID NO: 46265 - RNA, 378 nt, synthetic construct
  misc_feature 1..378: note = derived and/or modified sequence opt6 from HuMab-159_HeavyChain_VDJ-Region
  source 1..378: mol_type = other RNA
gaagtacaattagtacaatcaggagcagaagtaaaaaaaccaggagaatcattaaaaatatcatgtaaaggatcaggatataatttcacatcatactggataggatgggtaagacaaatgccaggaaaaggattagaatggatgggaataatatatccaggagacagtgacacaagatactcaccatcatttcaaggacaagtaacaatatcagcagataaatcaatatcaacagcatacttacaatggagctcactaaaagcatcagacacagcaatgtattactgcgcaagatggggaacatattatgacatactaacaggatattttaattggtttgacccatggggacaaggaacattagtaacagtatcaagt

SEQ ID NO: 46266 - RNA, 321 nt, synthetic construct
  misc_feature 1..321: note = derived and/or modified sequence opt6 from HuMab-159_LightChain_VJ-Region
  source 1..321: mol_type = other RNA
gacatacaaatgacacaatcaccatcatcactatcagcatcagtaggagacagagtaacaataacatgccgagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatactacatatacccatggacattcggacaaggaacaaaagtagaaataaaa

SEQ ID NO: 46267 - RNA, 363 nt, synthetic construct
  misc_feature 1..363: note = derived and/or modified sequence opt6 from HuMab-160_HeavyChain_VDJ-Region
  source 1..363: mol_type = other RNA
caagtacaattagtagaaagtggaggaggagtagtacaaccaggaagaagtttaagattaagttgtgcagcaagtggatttacatttagtagtcatgcaatgcattgggtaagacaagcaccaggaaaaggattagaatgggtagcagcaataagttatgatggaagtaataaatattatgcagatagtgtaaaaggaagattcacaataagtagagataatagtaaaaatacaatgtatttacaaatgaatagtttaagagcagaagatacagcaatgtgttattgtgcaagaggaagtataacaggaagtacaggagtatttgattattggggacaaggaacattagtaacagtaagtagt

SEQ ID NO: 46268 - RNA, 321 nt, synthetic construct
  misc_feature 1..321: note = derived and/or modified sequence opt6 from HuMab-160_LightChain_VJ-Region
  source 1..321: mol_type = other RNA
gacatacaaatgacacaatcaccatcatcactatcagcatcagtaggagacagagtaacaataacatgccgagcatcacaagacatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcatacccaataacattcggacaaggaacaagactagaaataaaa

SEQ ID NO: 46269 - RNA, 372 nt, synthetic construct
  misc_feature 1..372: note = derived and/or modified sequence opt6 from HuMab-162_HeavyChain_VDJ-Region
  source 1..372: mol_type = other RNA
gaagtacaattatgggaaagcggaggaggaagcgtacaaccaggaggaagtttaagattaagctgtgcagcaagcggattcacattctcaagctatggaatgagctgggtaagacaagcaccaggaaaaggactagaatgggtaagcggaatatcaggatcaggatatagcacatactatgcagatagcgtaaaaggaagatttacaataagcagagacaatagcaaaaacacactatatctacaaatgaatagcttaagagcagaagatacagcagtatattactgtgcaaaaggatattaccatggatcaggatcatactatacatcatttgattactggggacaaggaacactagtaacagtaagttca

SEQ ID NO: 46270 - RNA, 321 nt, synthetic construct
  misc_feature 1..321: note = derived and/or modified sequence opt6 from HuMab-162_LightChain_VJ-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcattacaatcaggagtaccatcaagattctcaggatcaggatcaggaacagacttcacactaacaatatcatcactacaaccagaagacttcgcaacatactactgccaacaatacaactcatacccactaacattcggaggaggaacaaaagtagaaataaaa

SEQ ID NO: 46271 - RNA, 366 nt, synthetic construct
  misc_feature 1..366: note = derived and/or modified sequence opt6 from HuMab-163_HeavyChain_VDJ-Region
  source 1..366: mol_type = other RNA
gaagtacaattagtacaaagtggagcagaagtaaaaaaaccaggagaaagtttaaaaataagttgtcaaggaagtggatatagatttataagttattggataggatgggtaagacaaatgccaggaaaaggattagaatggatgggaagaatatatccaggagatagtgatacaagatatagtccaagttttcaaggacaagtgacaataagtgtagataaaagtataagcacagcatatttacaatggagtagtttaaaagcaagtgatacagcaatgtattattgtgcaagacaaagaggagattattattattttaatggattagatgtatggggacaaggaacaacagtaacagtaagtagt

SEQ ID NO: 46272 - RNA, 321 nt, synthetic construct
  misc_feature 1..321: note = derived and/or modified sequence opt6 from HuMab-163_LightChain_VJ-Region
  source 1..321: mol_type = other RNA
gaaatagtattaacacaatcaccaggaacattaagcttaagcccaggagaaagagcaacattaagctgtagagcaagtcaaagcgtaagctcaagctatctagcatggtatcaacaaaaaccaggacaagcaccaagattactaatatacggagcatcaagtagagcaacaggaataccagatagatttagcggaagcggaagcggaacagatttcacactaacaatatcaagattagaaccagaagatttcgcagtatattactgtcaacaatacggaagctcactaacattcggaggaggaacaaaagtagaaataaaa

SEQ ID NO: 46273 - RNA, 363 nt, synthetic construct
  misc_feature 1..363: note = derived and/or modified sequence opt6 from HuMab-166_HeavyChain_VDJ-Region
  source 1..363: mol_type = other RNA
caagtacaattagtagaaagtggaggaggagtagtacaaccaggaagaagtttaagattaagttgtgcagcaagtggatttacatttagtagttatgcaatgcattgggtaagacaagcaccaggaaaaggattagaatgggtagcagtaataagttatgatggaagtaatgaatattatgcagatagtgtaaaaggaagatttacaataagtagagataatagtaaaaatacattatatttacaaatgaatagtttaagagcagaagatacagcagtatattattgtgcaagaggaagtataataggaagtacaggagtatttgattattggggacaaggaacattagtaacagtaagtagt

SEQ ID NO: 46274 - RNA, 321 nt, synthetic construct
  misc_feature 1..321: note = derived and/or modified sequence opt6 from HuMab-166_LightChain_VJ-Region
  source 1..321: mol_type = other RNA
gacatacaaatgacacaatcaccatcatcactatcagcatcagtaggagacagagtaaccataacatgcagagcatcacaaggaatatcaaactggctagcatggtaccaacaaaaaccagaaaaagcaccaaaatcactaatatacgacgcatcatcactacaatcaggagtaccatcaagattctcaggatcaggatcaggaacagacttcacactaacaatatcatcactacaaccagaagacttcgccacatactactgccaacaatacaactcatacccaataacattcggacaaggaacaagactagaaataaaa

SEQ ID NO: 46275 - RNA, 363 nt, synthetic construct
  misc_feature 1..363: note = derived and/or modified sequence opt6 from HuMab-167_HeavyChain_VDJ-Region
  source 1..363: mol_type = other RNA
caagtacaactagtagaatcaggaggaggagtagtacaaccaggaagatcactaagactatcatgcgcagcaagtggatttacatttagctcatatgcaatacattgggtaagacaagcaccaggaaaaggattagaatgggtagcagtaataagctatgacggaagtaataaatattatgcagactcagtaaaaggaagatttacaatatcaagagataattcaaaaaatacattatatttacaaatgaactcattaagagcagaagacacagcagtatactattgtgcaagaggaagcataacaggaagtacaggagtattcgattactggggacaaggaacactagtaacagtaagttca

SEQ ID NO: 46276 - RNA, 363 nt, synthetic construct
  misc_feature 1..363: note = derived and/or modified sequence opt6 from HuMab-169_HeavyChain_VDJ-Region
  source 1..363: mol_type = other RNA
caagtacaattagtacaaagtggagcagaagtaaaaaaaccaggagcaagtgtaaaagtaagttgtaaagcaagtggatatacatttacaaattatggaataagttgggtaagacaagcaccgggacaaggattagaatggatgggatggttaagtgcatatagtggaaatacaatatatgcacaaaaattacaaggaagagtaacaatgacaacagatacaagcacaacaacagcatatatggaattaagaagtttaagaagtgatgatacagcagtatattattgtgcaagagatagaatagtagtaagaccagattattttgattattggggacaaggaacattagtaacagtaagtagt

SEQ ID NO: 46277 - RNA, 321 nt, synthetic construct
  misc_feature 1..321: note = derived and/or modified sequence opt6 from HuMab-169_LightChain_VJ-Region
  source 1..321: mol_type = other RNA
gaaatagtactaacacaatcaccagcaacactatcattatcaccaggagaaagagcaacactatcatgcagagcatcacaatcagtatcatcatacctagcatggtaccaacaaaaaccaggacaagcaccaagactactaatatacgacgcatcaaacagagcaacaggaataccagcaagattctcaggatcaggatcaggaacagacttcacactaacaatatcatcactagaaccagaagacttcgcagtatactactgccaacaaagatcaaactggccaagaacattcggacaaggaacaaaagtagaaataaaa

SEQ ID NO: 46278 - RNA, 366 nt, synthetic construct
  misc_feature 1..366: note = derived and/or modified sequence opt6 from HuMab-7D8_HeavyChain_VH-Region
  source 1..366: mol_type = other RNA
gaagtacaattagtagaaagtggaggaggattagtacaaccagatagaagtttaagattaagttgtgcagcaagtggatttacatttcatgattatgcaatgcattgggtaagacaagcaccaggaaaaggattagaatgggtaagtacaataagttggaatagtggaacaataggatatgcagatagtgtaaaaggaagatttacaataagcagagataatgcaaaaaatagtttatatttacaaatgaatagtttaagagcagaagatacagcattatattattgtgcaaaagatatacaatatggaaattattattatggaatggatgtatggggacaaggaacaacagtaacagtaagcagt

SEQ ID NO: 46279 - RNA, 366 nt, synthetic construct
  misc_feature 1..366: note = derived and/or modified sequence opt6 from HuMab-7D8_HeavyChain_V-Region
  source 1..366: mol_type = other RNA
gaagtacaattagtagaaagtggaggaggattagtacaaccagatagaagtttaagattaagttgtgcagcaagtggatttacatttcatgattatgcaatgcattgggtaagacaagcaccaggaaaaggattagaatgggtaagtacaataagttggaatagtggaacaataggatatgcagatagtgtaaaaggaagatttacaataagtagagataatgcaaaaaatagtttatatttacaaatgaatagtttaagagcagaagatacagcattatattattgtgcaaaagatatacaatatggaaattattattatggaatggatgtatggggacaaggaacaacagtaacagtaagtagt

SEQ ID NO: 46280 - RNA, 321 nt, synthetic construct
  misc_feature 1..321: note = derived and/or modified sequence opt6 from HuMab-7D8_LightChain_VL-Region
  source 1..321: mol_type = other RNA
gaaatagtactaacacaatcaccagcaacactatcactatcaccaggagaaagagcaacactatcatgcagagcatcacaatcagtatcatcatacctagcatggtaccaacaaaaaccaggacaagcaccaagactattaatatacgacgcatcaaacagagcaacaggaataccagcaagattctcaggatcaggatcaggaacagacttcacactaacaataagctcactagaaccagaagacttcgcagtatactactgccaacaaagatcaaactggccaataacattcggacaaggaacaagactagaaataaaa

SEQ ID NO: 46281 - RNA, 321 nt, synthetic construct
  misc_feature 1..321: note = derived and/or modified sequence opt6 from HuMab-7D8_LightChain_V-Region
  source 1..321: mol_type = other RNA
gaaatagtactaacacaatcaccagcaacattaagtttaagcccaggagaaagagcaacattaagctgtagagcaagccaaagcgtaagctcgtacttagcatggtaccaacaaaaaccaggacaagcaccaagactattaatatatgacgcaagcaatagagcaacaggaataccagcaagattctcaggatcaggatcaggaacagactttacattaacaataagttcactagaaccagaagactttgcagtatactattgccaacaaagaagcaattggccaataacattcggacaaggaacaagactagaaataaaa

SEQ ID NO: 46282 - RNA, 324 nt, synthetic construct
  misc_feature 1..324: note = derived and/or modified sequence opt6 from huMAb-anti-MSP10.1_LightChain_VJ-Region
  source 1..324: mol_type = other RNA
gaaatagtactaacacaatcaccagatatattaagcttaagcccaggagaaagagcaacattaagctgtagagcaagccaagcattaacagcaaaatatctagcatggtatcaacaaaaaccaggacaagtaccaagattactaatatacggaagctcaacaagagcaacaggaataccagatagatttagaggaagcggaagcggaacagatttcacactaacaatatcaagattagaaccagcagatagcgcagtatattactgtcaacaatacgaagactcaccatggacatttggacaaggaacaaaattagaaataaaa

SEQ ID NO: 46283 - RNA, 324 nt, synthetic construct
  misc_feature 1..324: note = derived and/or modified sequence opt6 from huMAb-anti-MSP10.2_LightChain_VJ-Region
  source 1..324: mol_type = other RNA
gaaatagtactaacacaatcaccagacacactatcactatcaccaggcgaaacagcaacactatcatgcagagcatcacaaacagtaagaagaaactcactagcatggtaccaacaaaaaccaggacaagcaccaagactactaatatacggagcatcagacagagcaacaggaataccagacagattctcaggatcaggattcggaacagacttcacactaacagtatcaggactagaaccagaagacttcgcagtatactactgccaacaatacggaacctcaccaagaacattcggacaaggaacaaaactagaaataaaa

SEQ ID NO: 46284 - RNA, 324 nt, synthetic construct
  misc_feature 1..324: note = derived and/or modified sequence opt6 from HUMAB-Clone_18_VJ-Region
  source 1..324: mol_type = other RNA
gaaatagtattaacacaatcaccagcaacactatcactatcaccaggagaaagagcaacactatcatgcagagcatcacaatcagtatcatcatacctagcatggtaccaacaaaaaccaggacaagcaccaagactactaatatacgacgcatcaaaaagagcaacaggaataccagcaagattctcaggatcaggatcaggaacagacttcacactaacaatatcatcactagaaccagaagacttcgcagtatactactgccaacaaagatcaaaatggccaccatggacattcggacaaggaacaaaagtagaatcaaaa

SEQ ID NO: 46285 - RNA, 324 nt, synthetic construct
  misc_feature 1..324: note = derived and/or modified sequence opt6 from HUMAB-Clone_22_VJ-Region
  source 1..324: mol_type = other RNA
gaaatagtactaacacaatcaccagcaacattaagcttaagcccaggagaaagagcaacattaagctgtagagcaagccaaagcgtaagctcatacttagcatggtaccaacaaaaaccaggacaagcaccaagactattaatatatgacgcaagcaatagagcaacaggaataccagcaagattctcaggatcaggatcaggaacagactttacattaacaataagctcactagaaccagaagactttgcagtatactattgccaacaaagaagcaaatggccaccatggacatttggacaaggaacaaaagtagaaataaaa

SEQ ID NO: 46286 - RNA, 432 nt, synthetic construct
  misc_feature 1..432: note = derived and/or modified sequence opt6 from HuMab-L612_Chain_VDJ-Region_Precursor
  source 1..432: mol_type = other RNA
atggaatttggattaacatggttatttttagtagcaaatttaaaaggagtacaatgtgaagtgcaattattagatagtggaggaggattagtacaaccaggaggatgtttaagattaagttgtgcagcgagtggatttacattttcaagttgtgcaatgagttgggtaaggcaagcaccaggaaaaggattagaatgggtaagtgcaataagtggaagtggaggaagcacatattatgcagatagcgtaaaaggaagatttacaataagtagagataaaagtaaaaatacattatatttacaaatgaatagtttaagagcagaagatacagcagtatattattgtgcaaaaggaggaaatgatatattaacaggatattatgcatggggacaaggaacactagtaacagtaagtagtggaagtgcaagtgca

SEQ ID NO: 46287 - RNA, 321 nt, synthetic construct
  misc_feature 1..321: note = derived and/or modified sequence opt6 from HuMab_LC5002-002_LightChain_V-Region
  source 1..321: mol_type = other RNA
gacatacaaatgacacaatcaccatcatcactatcagcatcagtaggagaccgagtaacaataacatgcagagcatcacaaggaatatcaagatgggtagcatggtaccaacaaaaaccagaaaaagcaccaaaatcactaatatacgcagcatcatcactacaatcaggagtaccatcaagattctcaggatcaggatcaggaacagacttcacactaacaataagctcactacaaccagaagacttcgcaacatactactgccaacaatacaactcatacccatggacattcggacaaggaacaaaagtagaaataaaa

SEQ ID NO: 46288 - RNA, 357 nt, synthetic construct
  misc_feature 1..357: note = derived and/or modified sequence opt6 from HuMab_LC5002-002_gamma1-Chain_V-Region
  source 1..357: mol_type = other RNA
gaagtacaattattagaaagtggaggaggattagtacaaccaggaggaagtttaagattaagttgtgcagcaagtggatttacatttaatatatatgcaatgaattgggtaagacaagcaccaggaaaaggattagaatgggtaagtgtaataagtggaagaggaataacaacatattatgcagatagtgtaaaaggaagatttacaataagtagagataatagtaaaaatacattatatttacaaatgaatagtttaagagcagatgatacagcagtatattattgtgcaaaaggaagtagcagttggacagattttgattattggggacaaggaacattagtaacagtaagtagt

SEQ ID NO: 46289 - RNA, 321 nt, synthetic construct
  misc_feature 1..321: note = derived and/or modified sequence opt6 from HuMab_LC5002-003_LightChain_V-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcatacccatggacattcggacaaggaacaaaagtagaaataaaa

SEQ ID NO: 46290 - RNA, 357 nt, synthetic construct
  misc_feature 1..357: note = derived and/or modified sequence opt6 from HuMab_LC5002-003_gamma1-Chain_V-Region
  source 1..357: mol_type = other RNA
gaagtacaattattagaaagtggaggagatttaatacaaccaggaggaagtttaagattaagttgtgcagcaagtggatttacatttaatatatatgcaatgaactgggtaagacaagcaccaggaaaaggattagaatgggtaagtgtaatatcaggaagaggaataacaacatattatgcagatagtgtaaaaggaagatttacaataagcagagataatagtaaaaatacattatatttacaaatggatagtttaagagcagaagatacagcagtatattactgtgcaaaaggaagtagttattggacagattttgattattggggacaaggaacattagtaacagtaagtagt

SEQ ID NO: 46291 - RNA, 321 nt, synthetic construct
  misc_feature 1..321: note = derived and/or modified sequence opt6 from HuMab_LC5002-005_LightChain_V-Region
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcacactaacaatatcatcactacaaccagaagacttcgcaacatactactgccaacaatacaactcacacccaccaacattcggacaaggaacaaaattagaaataaaa

SEQ ID NO: 46292 - RNA, 354 nt, synthetic construct
  misc_feature 1..354: note = derived and/or modified sequence opt6 from HuMab_LC5002-005_gamma1-Chain_V-Region
  source 1..354: mol_type = other RNA
gaagtacaagtactagatagcggaggaggactagtacaaccaggaggaagtttaagattaagctgtacagcaagcggattcacattcagactatatacaatgagctgggtaagacaaacaccaggaagaggactagaatgggtaagcggaatatcaggatcaggattaagcacatactttgcagatagcgtaaaaggaagatttacaataagcagagacaatagtaaaaacacagtatatctacaaatgaatagtttaagagcagaagatacagcagtatattactgtgcaaaagaaggagactggatatatttcgatagctggggacaaggaacactagtaatagtaagctca

SEQ ID NO: 46293 - RNA, 321 nt, synthetic construct
  misc_feature 1..321: note = derived and/or modified sequence opt6 from HuMab_LC5002-007_LightChain_V-Region
  source 1..321: mol_type = other RNA
gaaatagtactaacacaatcaccaggaacattaagcttaagtccaggagaaagagcaacattaagctgtagagcaagccaaagcgtaagctcaagctatctagcatggtatcaacaaaaaccaggacaagcaccaagattactaatatacggagcatcaagcagagcaataggaataccagatagatttagtggaagcggaagcggaacagatttcacactaacaatatcaagattagaaccagaagatttcgcagtatattactgtcaacattacggaagttcactcacattcggaggaggaacaaaagtagaaataaaa

SEQ ID NO: 46294 - RNA, 369 nt, synthetic construct
  misc_feature 1..369: note = derived and/or modified sequence opt6 from HuMab_LC5002-007__gamma1-Chain_V-Region
  source 1..369: mol_type = other RNA
caagtacaattagtacaaagcggagcagaagtaaaaaaaccaggaagtagtgtaaaagtaagttgtaaagtaagtggaggaacatttagtagttatgcatttagctgggtaagacaagcaccaggacaaggattagaatggatgggaagaataataccaatattaggaagaacaaattatgcacaaaaatttcaaggaagagtaacaataacagcagataaaagtacaagtacagcatatatggaagtaagtagcctaagaagtgaagatacagcagtatattattgtgcaagagaaggagaaacattagattatttttattatggaatggatgtatggggacaaggaacaacagtaacagtaagtagt

SEQ ID NO: 46295 - RNA, 357 nt, synthetic construct
  misc_feature 1..357: note = derived and/or modified sequence opt6 from HuMab_LC5002-018_gamma1-Chain_V-Region
  source 1..357: mol_type = other RNA
gaagtacaattattagaaagtggaggaggattagtacaaccaggaggaagtttaagattaagttgtgcagcaagtggatttacatttaatatatatgcaatgaattgggtaagacaagcaccaggaaaaggattagaatgggtaagtgtaataagtggaagtggagtaacaacatattatgcagatagtgtaaaaggaagatttacaataagtagagataatagtaaaaatacattatatttacaaatgaatagtttaagagcagaagatacagcagtatattattgtgcaaaaggaagtagttggtatgtagattttgattattggggacaaggaacattagtaacagtaagtagt

SEQ ID NO: 46296 - RNA, 1347 nt, synthetic construct
  misc_feature 1..1347: note = derived and/or modified sequence opt6 from Ibalizumab_HeavyChain1
  source 1..1347: mol_type = other RNA
caagtacaattacaacaaagtggaccagaagtagtaaaaccaggagcttcagtaaaaatgtcatgtaaagccagcggttatacatttaccagctacgtaatacactgggtcagacaaaaacccggacaaggattagattggataggatatataaacccctacaacgacggaactgattatgacgaaaaattcaaaggcaaagctaccttgacctcagatacatcaacatcaacagcctacatggaactatcaagtttaagatcagaagacacagcagtatactactgcgcacgcgaaaaagataattacgctacaggagcctggttcgcatattggggccaaggaactctagtaacagtgtcatcagcatcaaccaaaggaccttcagtattcccattagcaccttgcagtagaagtacaagtgaaagcacagcagcactaggatgtttagtaaaagactacttcccagaaccagtaacagtctcatggaactctggcgcactaacttcaggcgtacacacattcccagcagtattacaaagttccggattatattcattatcatctgtggtaacagtaccatcatcaagcctaggaacaaaaacctatacatgtaacgtagatcataaaccatcaaatacaaaagtagataagagagtagaatcaaaatacggacccccatgcccatcatgtccagcaccagaattcctaggagggccatcagtattcctattccctccaaaaccaaaagacacattaatgatatcacgaacaccagaagtaacatgcgtagtagtagatgtatcacaagaagaccccgaagtacaattcaactggtatgtagacggagtagaagtacataacgccaaaacaaaaccaagggaagaacaattcaactcaacatatcgagtagtatccgtactaaccgtattacatcaagactggttaaacggaaaagaatataaatgtaaagtatccaacaaaggcctaccttcaagcatagaaaaaaccatatctaaagcaaaaggacaaccaagagaaccacaagtatacaccttaccaccatcacaagaagaaatgacaaaaaaccaagtatcattaacatgtctagtaaaaggattttaccctagcgatatagcagtagaatgggaaagcaacggccaaccagaaaataactacaaaacaactcccccagtattagactcagacggctcattcttcctatactcgagattaaccgtagacaaatcaagatggcaagaaggcaacgtattctcatgttctgtaatgcacgaagctcttcacaatcactacacacagaaaagccttagtttaagcctaggtaaa

SEQ ID NO: 46297 - RNA, 657 nt, synthetic construct
  misc_feature 1..657: note = derived and/or modified sequence opt6 from Ibalizumab_LightChain1
  source 1..657: mol_type = other RNA
gacatagtaatgacacaatcaccagactcactagcagtatcactaggagaacgagtaacaatgaactgcaaatcatcacaatcactactatactcaacaaatcaaaaaaactacttagcatggtaccaacaaaaaccaggacaatcaccaaaactactaatatactgggcatcaacaagagaatcaggagtaccagacagattctccggatcaggatcaggaacagatttcacactaacaatatcatcagtacaagcagaagacgtagcagtatactactgccaacaatactattcctacagaacattcggaggaggaacaaaactagaaataaaaagaacagtagcagcaccaagtgtattcatattcccaccatccgacgaacaactaaaatcaggaacagcttcagtagtatgcttactaaacaacttttacccaagagaagccaaagtacaatggaaagtagacaacgcactacaatcaggaaactcacaagaatcagtaacagaacaagactcaaaagactcaacatactcattatcctcaacattaacactatcaaaagcagactacgaaaaacacaaagtatatgcatgcgaagtcacacatcaaggcctatcatcaccagtaacaaaaagcttcaacagaggagaatgc

SEQ ID NO: 46298 - RNA, 1329 nt, synthetic construct
  misc_feature 1..1329: note = derived and/or modified sequence opt6 from Ibritumomab_tiuxetan_HeavyChain
  source 1..1329: mol_type = other RNA
caagcatacctacaacaatcaggagcagaattagttcgaccaggcgccagcgtgaaaatgtcatgcaaagcatcaggatacacatttacatcctacaacatgcactgggtaaaacaaacccccagacaaggtttagaatggataggagccatttatccaggaaatggcgacacatcatataatcaaaaattcaaaggcaaagctacactaaccgtagacaaatcatcatcaacagcttacatgcaattatcaagtctaacttccgaagactccgcagtatacttctgcgcaagagtcgtttattactcaaactcatattggtatttcgatgtatggggcacaggaacaaccgtaacagtatcagccccatcagtatatccactagcaccagtttgcggagacactaccggatcttcagtaaccttaggatgccttgtaaaaggatatttcccagaacccgttacattaacatggaactcaggatcactatcatcaggagtacacacatttccagcagtcttacaatcagacttatatacactttcatcatccgtaaccgtaacctccagtacatggccttcacaatcaattacatgtaatgtagcacacccagcatcttcaacaaaagtagacaaaaaaatagaacccagaggaccaaccataaaaccatgtccaccatgtaaatgcccagctccaaatttattaggcggccccagtgtattcatatttcccccaaaaataaaagacgtcttaatgatatcgttatcaccaatagtcacatgcgtagtagtagacgtatcagaagacgaccccgacgtccaaatttcatggtttgtaaacaacgtcgaagttcacaccgcacaaacccaaacccaccgtgaagattacaactctacattacgagtagtatccgcactacccatacaacatcaagactggatgtcaggcaaagaattcaaatgcaaagtcaacaacaaagacttaccagcccccatagaaagaaccatatccaaaccaaaaggctcagtaagagcaccccaagtatacgtactaccccctccagaagaagaaatgacaaaaaaacaagtaacattaacatgcatggtcaccgatttcatgccagaagatatatatgttgaatggacaaacaatggcaaaaccgaactcaactataaaaacacagaacctgtactagactcagatggttcatacttcatgtattcaaaattacgagtagaaaaaaaaaactgggtagaaagaaactcctactcatgctcagttgtacacgaaggactacacaaccaccacacaacaaaatcattctctaga

SEQ ID NO: 46299 - RNA, 627 nt, synthetic construct
  misc_feature 1..627: note = derived and/or modified sequence opt6 from Ibritumomab_tiuxetan_LightChain
  source 1..627: mol_type = other RNA
caaatagtattatcacaatcaccagcaatattatcagcttcaccaggagaaaaagtaacaatgacatgcagagcatcatcatcagtatcatatatgcactggtaccaacaaaaacccggatcatcaccaaaaccatggatatacgcaccatccaacctagcatccggagtaccagcacgattctccggatcaggatcaggaacatcctattcactaacaatatcaagagtagaagcagaagacgcagcaacatactactgccaacaatggtcattcaacccaccaacattcggagccggcacaaaattagaactaaaacgagcagacgcagccccaacagtattcatattccctccatccgacgaacaattaaaaagtggaacagcatcagtagtatgcctattaaacaatttctacccaagagaagcaaaagtacaatggaaagtagacaacgcattacaatcaggaaactcacaagaaagcgtaaccgaacaagactcaaaagattcaacatacagcctatcatcaacactcacactatcaaaagcagactacgaaaaacacaaagtatacgcatgcgaagtaacacaccaaggattatcatcacccgtaacaaaatcattcaac

SEQ ID NO: 46300 - RNA, 1368 nt, synthetic construct
  misc_feature 1..1368: note = derived and/or modified sequence opt6 from Icrucumab_HeavyChain1
  source 1..1368: mol_type = other RNA
caagctcaagtagttgaatcaggaggaggagtagtacaatccggaagatctttaagactaagctgcgccgcatcagggtttgccttttcatcatatggaatgcactgggtcaggcaagcaccaggcaaaggactagaatgggtagcagtaatatggtatgacggatcaaacaaatactatgcagattctgtaagaggaagattcacaatatctagagacaatagcgaaaacacactatacttacaaatgaatagtttaagagcagaagataccgcagtatactactgtgccagagatcattacggaagtggagtacaccactacttctattacggattagacgtatggggacaaggtacaacagtaactgtatcatcagctagtactaaaggcccatcagtattccctttagcaccatcatctaaatcaacatcaggaggtacagctgcactaggttgcctggtaaaagattactttccagaaccagtcacagtatcatggaattcaggtgctttaacctccggtgtacacacatttccagccgtattacaatcaagcggactatactccctaagcagcgttgtaaccgtaccatcttcatcattaggaacacaaacatatatctgcaatgtaaatcacaaaccatcaaatacaaaagtagataaacgtgtagaacctaaatcatgtgataaaacacacacatgcccaccctgtccagcacctgaactactaggtgggccaagcgtcttcttattcccaccaaaaccaaaagatacccttatgatatcacgtacacctgaagtaacttgtgtcgttgtagatgtatcacatgaagatccagaagtaaaattcaactggtatgtagatggagtagaagtacataatgcaaaaacaaaaccacgagaagaacaatacaattcaacatatagagttgtatctgtattaacagttctacaccaagattggctaaacggaaaagaatacaaatgtaaagtaagcaataaagccttaccagcaccaatagaaaaaacaatatcaaaagccaaaggacaaccaagagaaccccaagtatatacactcccaccatcaagagaagaaatgacaaaaaatcaagtatcattaacatgcctagtaaaaggattctatccatcagacatagcagttgaatgggaatcaaatggccaaccagaaaataattacaaaactacaccaccagttttagactcagatggatccttctttttatactcaaaacttaccgtagataaatcaagatggcaacaaggaaatgttttctcttgttcagtaatgcatgaagcactacataatcactatacacaaaaaagtttatccttaagtcctggcaaa

SEQ ID NO: 46301 - RNA, 645 nt, synthetic construct
  misc_feature 1..645: note = derived and/or modified sequence opt6 from Icrucumab_LightChain1
  source 1..645: mol_type = other RNA
gaaatagttctaacccaatcaccaggtacactatcattatccccaggagaaagagccacattatcatgccgagcatcacaatcagtatcatcatcatacctagcatggtatcaacaaaaaccaggacaagcacccagattactaatctacggagcatcatcaagagcaacaggaataccagacagattctcaggatcaggatcaggaacagactttacactaacaatatcaagactagaaccagaagatttcgcagtatactactgccaacaatacggatcatccccactaacatttggaggaggaacaaaagtagaaataaaacgaacagtagcagcaccatcagtattcatattccccccctcagacgaacaactaaaatcaggaacagcatcagtagtatgcctattaaacaatttctacccaagagaagcaaaagtacaatggaaagtagacaacgcactacaatcaggaaattcacaagaatcagtaacagaacaagactcaaaagactcaacatactcactatcatcaacactaacactatcaaaagcagactacgaaaaacacaaagtatacgcctgcgaagtaacacaccaaggcctatcatcaccagtaacaaaaagcttcaacagaggagaatgc

SEQ ID NO: 46302 - RNA, 675 nt, synthetic construct
  misc_feature 1..675: note = derived and/or modified sequence opt6 from Idarucizumab_HeavyChain1
  source 1..675: mol_type = other RNA
caagtacaattacaagaaagtggaccaggattagtaaaaccatcagaaacactatcactaacatgcacagtatcaggattctcattaacatcctacatagtagactggatcagacaaccaccaggaaaaggattagaatggataggtgtcatatgggcaggaggatcaacaggatacaactcagcactaagaagcagagtatcaataacaaaagacacatcaaaaaaccaattctcattaaaattatcatcagtaacagcagcagacacagcagtatattactgcgcatccgcagcatactattcatactacaactacgacggattcgcatactggggacaaggaacattagtaacagtatcatcagcatcaacaaaaggtccatcagtattcccactagcaccatcatcaaaatccacatccggaggaacagcagcactaggatgcttagtaaaagactacttcccagaaccagtaacagtatcatggaactcaggagcactaacatcaggagtacacacattcccagcagtactacaatcatcaggattatactcattatcatcagtagtaacagtaccatcatcatcactaggaacacaaacatacatatgcaacgtaaaccacaaaccatcaaacacaaaagtagacaaaaaagtagaaccaaaatcatgc

SEQ ID NO: 46303 - RNA, 657 nt, synthetic construct
  misc_feature 1..657: note = derived and/or modified sequence opt6 from Idarucizumab_LightChain1
  source 1..657: mol_type = other RNA
gacgtagtaatgacccaatccccactatcactaccagtaacactaggacaaccagcatcaatatcatgcaaatcatctcaatcactactatacacagacggaaaaacatacctatattggttcttacaaagaccaggacaatcacccagaagactaatatacctagtatccaaattagactcaggagtaccagacagattctcaggttcaggatcaggaacagacttcacattaaaaatatcaagagtagaagccgaagacgtaggagtatactactgcctacaatcaacacacttcccacacacatttggaggaggaacaaaagtagaaataaaaagaacagtagccgcaccatcagtattcatattcccaccatcagacgaacaactaaaatcaggaacagcatcagtcgtatgcctattaaacaacttctacccaagagaagcaaaagtacaatggaaagtagacaacgccctacaatcaggaaactcacaagaatccgtaacagaacaagactcaaaagactcaacatactcactatcatcaacactaacattatcaaaagcagactacgaaaaacacaaagtatacgcatgcgaagtaacacatcaaggactatcatcaccagtaacaaaatcattcaacagaggagaatgc

SEQ ID NO: 46304 - RNA, 1332 nt, synthetic construct
  misc_feature 1..1332: note = derived and/or modified sequence opt6 from Igatuzuab_HeavyChain1
  source 1..1332: mol_type = other RNA
caagtacaattagtacaatctggagcagaagtcaaaaaaccaggatccagtgtcaaagtctcctgtaaagcctcaggatttaccttcacagactacaaaatccactgggtccgacaagcacccggacaaggtttagaatggggatatttcaacccaaactcaggatactcaacatatgcacaaaaattccaaggaagagttactataacggccgataaatcaacatctacagcctacgaactatcatcactacgaagcgaagatacagcagtatattactgcgcaagattatcaccaggaggttactacgtagacgcatggggacaaggcacaaccgtaacagtttcaagcgcatcaacaaaaggaccaagcgtcttcccactagcaccatcatcaaaatcaacatcaggaggaacagccgccttgggatgcctagtaaaagactatttcccagaaccagtaacagtatcatggaactcaggagcattaacctccggcgtacatacattcccagcagtactccaatcctcaggactatactcattatcatccgttgtaactgtcccatcatcatcactaggaacacaaacatacatatgcaacgtaaaccacaaaccttcaaacacaaaagtagataaaaaagtcgaaccaaaatcatgtgacaaaactcacacgtgtccaccatgcccagcacctgaactattaggcggtccatccgtcttcctatttccaccaaaacccaaagacacactaataagccgcacacctgaagtaacttgtgtcgtagtagatgtatcacacgaagatccagaagtaaagtttaattggtacgtagacggagtagaagtacacaacgcaaaaacaaaaccaagagaagaacaatataactcaacttatcgtgtagtatcagtattaacagtcttacaccaagattggctaaacggtaaagaatataaatgcaaagtatccaataaagcattacccgcaccaatagaaaaaacaatctcaaaagcaaaaggtcaacctagagaaccacaagtatacacattaccaccatcaagagacgaactaacaaaaaatcaagtctccttaacatgcttagttaaaggtttttacccctcagatatagcagttgaatgggaatcaaacggacaacccgaaaataactacaaaacaacaccaccagtactagactctgatggatcattcttcttatactctaaattaacagtcgacaaatcacgttggcaacaaggtaacgtattttcatgttcagttcatgaagcactacacaaccactacacacaaaaatctctttcattatctcccgga

SEQ ID NO: 46305 - RNA, 636 nt, synthetic construct
  misc_feature 1..636: note = derived and/or modified sequence opt6 from Igatuzuab_LightChain1
  source 1..636: mol_type = other RNA
gacatacaaacacaatcaccatcatcactatcagcatcagtaggagaccgagtaacaataacatgcagagcatcacaaggaataaataactacttaaactggtaccaacaaaaaccaggaaaagccccaaaaagactcatatacaacacaaacaacttacaaacaggagtaccatcaagattctcaggatcaggatcaggaacagaattcacactaacaatatcctcactacaaccagaagacttcgcaacatactactgcttacaacacaactccttcccaacattcggacaaggaacaaaactagaaatcaaaagaacagtagcagccccatcagtattcatattcccaccatcagacgaacaactaaaatcaggaacagcatcagtagtatgcctactaaacaacttctacccacgagaagcaaaagtacaatggaaagtagacaacgcactccaatcaggcaactcacaagaatcagtaacagaacaagactcaaaagactcaacatactccctatcctccaccctaaccctatcaaaagcagactacgaaaaacacaaagtatacgcatgcgaagtaacacaccaaggactctcatcaccagtaacaaaatcatttaacagaggagaatgc

SEQ ID NO: 46306 - RNA, 357 nt, synthetic construct
  misc_feature 1..357: note = derived and/or modified sequence opt6 from IGF-IR_HUMAB-1A_HeavyChain
  source 1..357: mol_type = other RNA
gaagtacaattagtacaaagtggaggaggattagtacatccaggaggaagtttaagattaagttgtgcaggaagtggatttacatttagaaattatgcaatgtattgggtaagacaagcaccaggaaaaggattagaatgggtaagtgcaataggaagtggaggaggaacatattatgcagatagtgtaaaaggaagatttacaataagtagagataatgcaaaaaatagtttatatttacaaatgaatagtttaagagcagaagatatggcagtatattattgtgcaagagcaccaaattggggaagtgatgcatttgatatatggggacaaggaacaatggtaacagtttcaagt

SEQ ID NO: 46307 - RNA, 357 nt, synthetic construct
  misc_feature 1..357: note = derived and/or modified sequence opt6 from IGF-IR_HUMAB-23_HeavyChain
  source 1..357: mol_type = other RNA
gaagtacaattagtacaaagtggaggaggattagtacatccaggaggaagtttaagattaagttgtgcaggaagtggatttacattttcaaattatgcaatgtattgggtaagacaagcaccaggaaaaggactagaatgggtaagtgcaataggaagtggaggaggaacatattatgcagatagtgtaaaaggaagatttacaataagtagagataatgcaaaaaatagtttatatttacaaatgaatagtttaagagcagaagatatggcagtatatcattgtgcaagagcaccaaattggggaagtgaagcatttgatatatggggacaaggaacaatggtaacagtaagtagt

SEQ ID NO: 46308 - RNA, 321 nt, synthetic construct
  misc_feature 1..321: note = derived and/or modified sequence opt6 from IGF-IR_HUMAB-23_LightChain
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggcgtaccatcaagattctcaggatcaggatcaggaacagacttcacactaacaatatcatcactacaaccagaagacttcgcaacatactactgccaacaatacaactcatacccaataacattcggacaaggaacaagactagaaataaaa

SEQ ID NO: 46309 - RNA, 357 nt, synthetic construct
  misc_feature 1..357: note = derived and/or modified sequence opt6 from IGF-IR_HUMAB-8_HeavyChain
  source 1..357: mol_type = other RNA
gaagtacaattagtacaaagtggaggaggattagtacatccaggaggaagtttaagattaagttgtgcaggaagtggatttacatttagaagttatgcaatgtattgggtaagacaagcaccaggaaaaggattagaatgggtaagtgcaataggaagtggaggaggaacatattatgcagatagtgtaaaaggaagatttacaataagtagagataatgcaaaaaatagtttatatttacaaatgaatagtttaagagcagaagatatggcagtatattattgtgcaagagcaccaaattggggaagtgatgcatttgatatatggggacaaggaacaatggtaacagtaagtagt

SEQ ID NO: 46310 - RNA, 321 nt, synthetic construct
  misc_feature 1..321: note = derived and/or modified sequence opt6 from IGF-IR_HUMAB-8_LightChain
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcatcactacaatcaggagtaccatcaagattctcaggatcaggatcaggaacagacttcaccctaacaatatcatcactacaaccagaagacttcgcaacatactactgccaacaatacaactcatacccaccaacattcggaccaggaacaaaagtagacataaaa

SEQ ID NO: 46311 - RNA, 708 nt, synthetic construct
  misc_feature 1..708: note = derived and/or modified sequence opt6 from ImAb1_LightChain
  source 1..708: mol_type = other RNA
atggacatgagagccccagcacaattcttcggaatactactactatggttcccaggaataagatgtgacataaaaatgacacaatcaccatcatcaatgtacgcaagcctaggcgaaagagtaacaataacatgtaaagcctcacaagacataaaatcatacctctcatggtaccaacaaaaaccttggaaatcaccaaaaatactaatctactacgcaacatcactagcagacggagtaccaagcagaatatccggatcaggatcaggacaagactactcattaacaatctcatcactagaatcagacgacacagcaacatactactgcctacaacacggagaaagcccatacacattcggaggaggaactaaattagaaataaaaagagcagacgcagcaccaacagtcagtatattcccaccatcatcagaacaattaacctcaggaggagcatcagtagtatgctttctaaacaacttctacccaaaagacataaacgtaaaatggaaaatagacggatcagaaagacaaaacggtgtactaaacagctggaccgaccaagactcaaaagactcaacatacagtatgtcatctacactaacactaacaaaagacgaatacgaaagacataactcatacacatgcgaagcaacacacaaaacatcaacctcaccaatagtaaaatccttcaacagaaacgaatgc

SEQ ID NO: 46312 - RNA, 681 nt, synthetic construct
  misc_feature 1..681: note = derived and/or modified sequence opt6 from ImAb1_gamma1-Chain
  source 1..681: mol_type = other RNA
atgaactttggattctcattaatatttctagtactagtattaaaaggagtacaatgtgaagtaaaattagtagaatcaggaggaggactcgtaaaaccaggaggatcattaaaattatcatgtgcagcaagtggcttcacattctcaaactatgcaatgtcatgggtaagacaaacaccagaaaaaagattagaatgggtagcatcaatatcaagtgatggagatacatatttcccagacaatgtaaaaggaagattcacaatatcaagagaaaatgcaggaaatatattatttttacaaatgtcatccttaagaagtgaagacacagcaatgtattattgcgcacgaggattcatgatcacattctggggacaaggaacattagtaaccgtatcagcagcaaaaacaacaccaccatcagtatatccattagcaccaggatgcggagacacaacaggatcatcagtaacattaggatgcttagtcaaaggatatttcccagaatcagtaacagtaacatggaattcaggatcattaagttcatcagtacacacattcccagcactactacaatcaggattatatacaatgtcatcatcagtaacagtaccatcaagcacatggccaagccaaacagtaacatgttcagtagcacatccagcatcatcaaccacagtagat

SEQ ID NO: 46313 - RNA, 1344 nt, synthetic construct
  misc_feature 1..1344: note = derived and/or modified sequence opt6 from Imalumab_HeavyChain1
  source 1..1344: mol_type = other RNA
gaagtccaattattagaaagtggaggtggactagtacaaccaggaggaagtctccgattatcctgtgctgcatcaggttttactttctcaatatactcaatgaactgggtcagacaagctccaggcaaaggattagaatgggtatcaagcatcggatcctcaggaggaacaacatactatgcagactctgtaaaaggaagatttacaatatcaagagataattctaaaaataccctatacttacaaatgaactcactcagagcagaagacacagcagtatattactgtgcaggctcacaatggctatacggcatggatgtatggggccaaggaacaacagtaacagtctcatcagcaagtaccaaaggaccttcagtattcccattagccccttcatcaaaatcaacatcaggaggaacagcagcactcggatgcctcgttaaagactactttccagaaccggtaacagtatcatggaattcaggagctctaacttccggagtacacacattcccagctgtactccaatcaagtggattatactctttatcatcagtagtaacagtaccatcatcctctttaggaactcaaacatatatttgtaacgttaatcacaaaccatctaacacaaaagttgataaaagagtcgaaccaaaatcctgtgataaaacacacacgtgtcctccatgcccagcacccgaactacttggcggaccatcagtattcctttttccaccaaaaccaaaagatacattaatgataagcagaacaccagaagtaacatgcgttgtcgtagatgtatcacacgaagatccagaagtcaaatttaattggtacgtagacggagtagaagtccataatgcaaaaacaaaaccaagagaagaacaatataattcaacctaccgtgtagtctccgtactaacagtacttcaccaagactggctaaacggaaaagaatataaatgcaaagtctcaaataaagccctaccagcacctatagaaaaaaccatatcaaaagcaaaaggacaaccaagagaaccccaagtatacactctaccaccatccagagaagaaatgacaaaaaaccaagtatcattaacctgcctagtcaaaggattctatccatcagacatcgctgtcgaatgggaaagcaatggccaaccagagaataactataaaacaacaccaccagtactagactctgacggatcattttttctatattcaaaactaaccgtcgacaaatctagatggcaacaaggcaacgtatttagctgttcagtaatgcatgaagctttacacaatcactacacacaaaagtcattatccctatctccaggcaaa

SEQ ID NO: 46314 - RNA, 642 nt, synthetic construct
  misc_feature 1..642: note = derived and/or modified sequence opt6 from Imalumab_LightChain1
  source 1..642: mol_type = other RNA
gatatacaaatgacacaatcaccatcatccctatcagcatcagtaggagacagagtaacaataacatgcagatcatcccaacgtataatgacctacttaaactggtaccaacaaaaaccaggaaaagcaccaaaactactaatatttgtagcaagccactcccaatcaggagtaccatcaagattcagaggctcaggatcagaaacagacttcacactaacaatatcaggcctacaaccagaagactcagcaacatactattgccaacaatcattctggacaccactaacattcggaggaggaacaaaagtcgaaataaaaagaacagtagcagcaccatcagtattcatattcccaccatcagacgaacaactaaaatctggaacagcatcagtagtttgcctactaaacaacttctacccaagagaagcaaaagtacaatggaaagtagacaacgcattacaatccggaaactcacaagaatccgtaacagaacaagactcaaaagactcaacctactcattaagctcaacattaacactatcaaaagcagactacgaaaaacacaaagtatacgcatgcgaagtaacacaccaaggattatcatcaccagtaacaaaatcatttaacagaggagaatgc

SEQ ID NO: 46315 - RNA, 1347 nt, synthetic construct
  misc_feature 1..1347: note = derived and/or modified sequence opt6 from Imgatuzumab_HeavyChain1
  source 1..1347: mol_type = other RNA
caagtacaactagtacaatcaggagctgaagttaaaaaaccaggctcatcagttaaagtctcatgcaaagcctcaggatttacatttaccgactataaaatacactgggtcagacaagccccaggacaaggattagaatggatgggatactttaaccctaattcaggttactccacatacgcacaaaaatttcaaggaagagtaacaataacagcagacaaatcaacatcaacagcatatatggaactatcgtctttaagatctgaagataccgcagtctactattgcgccagattatcaccaggcggctactacgtcatggatgcctggggacaaggtacaacagtaacagtatcctctgcatccacaaaaggaccatctgtattccctttagccccaagttcaaaatcaacatcaggcggtacagcagctctcggatgcttagtaaaagactatttcccagaaccagtaacagtctcatggaattccggtgctttaaccagcggagttcatacattcccagcagtattacaatcctcaggtctatattcactatcatctgtagtaacagtaccatcatcatccttaggaactcaaacctacatatgcaatgtaaaccacaaaccatcaaacacaaaagtagataaaaaagtcgaaccaaaatcatgtgacaaaactcacacctgtccaccttgccccgcacctgaacttttaggaggaccatctgtattcctattccccccaaaaccaaaagacaccctcatgatatcaagaactccagaagtcacctgtgtcgtagtagacgtatcacatgaagatccagaagtaaaattcaactggtacgtagacggagtagaagtccataacgcaaaaacaaaaccaagagaagaacaatataattcaacatacagagtagtatcagtactaacagttttacatcaagactggctcaacggaaaagaatataaatgtaaagtctctaacaaggctctacctgcaccaatagaaaaaacaatatcaaaagccaaaggacaaccaagagaaccacaagtctacacattaccaccatcaagagacgaactaacaaaaaaccaagtatcactaacatgcttagtcaaaggcttctacccatcagatatagccgttgaatgggaaagcaatggacaacccgaaaataattacaaaaccacaccccccgtactagactcagacggatcatttttcctatactcaaaactaacagtagacaaatcacgatggcaacaaggaaacgtattctcatgctcagtaatgcacgaagcattacataaccactatacccaaaaatcactatcattatccccagga

SEQ ID NO: 46316 - RNA, 639 nt, synthetic construct
  misc_feature 1..639: note = derived and/or modified sequence opt6 from Imgatuzumab_LightChain1
  source 1..639: mol_type = other RNA
gatatacaaatgacacaatcaccctcatcactatcagcatcagtaggagaccgcgtaacaataacatgcagagcatcacaaggaatcaacaactacctcaactggtaccaacaaaaaccaggcaaagcaccaaaacgattaatatacaacacaaacaacttacaaacaggagtcccatctagattctcaggatcaggctcaggaacagaattcacactaacaatatcatccctacaaccagaagacttcgcaacatactactgcttacaacacaactcattcccaacattcggacaaggaacaaaactcgaaataaaaagaacagtagcagccccatcagtattcatattcccaccatcagacgaacaactaaaatcaggaacagcatcagtagtatgtctactaaacaacttctacccacgagaagcaaaagtccaatggaaagtagacaacgcactacaatcaggaaactcacaagaatcagtaacagaacaagactcaaaagactcaacctactcactatcatctacactcaccttatcaaaagcagactacgaaaaacacaaagtatacgcatgcgaagtcacacaccaaggactatcatcaccagtaacaaaatcattcaaccgaggagaatgc

SEQ ID NO: 46317 - RNA, 1353 nt, synthetic construct
  misc_feature 1..1353: note = derived and/or modified sequence opt6 from Inclacumab_HeavyChain1
  source 1..1353: mol_type = other RNA
gaagtacaactagtagaatcaggaggaggattagttcgaccaggaggttccctacgactatcatgtgcagcatccggatttacattctcaaattatgatatgcattgggtacgacaagccacaggaaaaggtttagaatgggtatccgctatcacagcagcaggagacatttactacccaggttcagttaagggaagatttacaataagtagagaaaacgctaaaaattcattatatttacaaatgaattcattaagagcaggtgacacagcagtatactactgtgcaagaggaagatattcaggaagcggttcatattataatgactggtttgacccctggggacaaggtacactagtgacagtatcttcagcatcaaccaaaggacctagcgtatttcctcttgcaccatgttcaagaagtacatcagaatcaaccgccgcattaggatgtctagttaaagattattttccagaaccagtaacagtctcatggaattcaggggctttaacttccggagtacatacatttccggccgtattacaatcttcaggactatattcattatcaagcgtagttacagtaccatcatcatcactaggtactaaaacatatacatgtaacgtagatcacaaaccatctaacacaaaagtagataaacgagtagaatctaaatacggaccaccatgtccaccatgcccagctcctgaatttgaaggaggtccatcagtatttctatttcctcccaaaccaaaagatacactaatgatatccagaacacctgaagtaacttgcgtggtagtagatgtaagccaagaagatccagaagtacaatttaattggtacgtagatggagtagaagttcacaacgccaaaacaaaaccaagagaagaacaatttaactcaacatatcgcgtagtatcagtattaactgtattacaccaagattggttaaatggtaaagaatacaaatgtaaagtttcaaataaaggacttccatcaagcatagaaaaaacaatttccaaagcaaaaggacaaccccgagaaccacaagtatatacacttcccccatcccaagaagaaatgacaaaaaatcaagtttcattaacatgtctggtaaaaggattctatccatccgacatagcagttgaatgggaaagcaacggccaacctgaaaataattataaaacaacacctcccgttttagattcagacggaagttttttcctatactcacgattaacagtagataaatcacgatggcaagaaggaaatgtgttttcatgttcagtaatgcatgaagcattacataatcactacacacaaaaatcactttcattatctttaggaaaa

SEQ ID NO: 46318 - RNA, 642 nt, synthetic construct
  misc_feature 1..642: note = derived and/or modified sequence opt6 from Inclacumab_LightChain1
  source 1..642: mol_type = other RNA
gaaatagtattaacacaatcaccagcaacactaagcctaagcccaggagaaagagcaacattatcatgcagagcaagccaatcagtttcatcatacttagcatggtatcaacaaaaaccaggacaagcaccaagactactaatatatgacgcaagcaacagagcaacaggaataccagccagattctcaggatcaggatcaggaacagactttacattaacaataagctcactagaaccagaagacttcgcagtatactattgccaacaaagatcaaattggccattaacattcggtggaggaacaaaagtcgaaataaaaagaacagtagcagcaccatcagtattcatattcccaccatctgacgaacaattaaaatcaggaacagcatcagttgtatgcttactaaataacttctacccaagagaagcaaaagtccaatggaaagtagataacgcattacaaagcggaaactcacaagaaagcgtaacagaacaagacagcaaagactcaacatacagtctatcatcaactttaaccttatccaaagcagactacgaaaaacataaagtatacgcatgcgaagtaacacaccaaggattaagctcaccagtaacaaaatcatttaatagaggagaatgc

SEQ ID NO: 46319 - RNA, 1347 nt, synthetic construct
  misc_feature 1..1347: note = derived and/or modified sequence opt6 from Indatuximab_ravtansine_HeavyChain1
  source 1..1347: mol_type = other RNA
caagtacaactacaacaatcaggatcagaactaatgatgccaggcgctagtgtaaaaataagttgcaaagctaccggatatactttttctaactattggatagaatgggtaaaacaaagaccaggacacggattagaatggataggcgaaatattaccagggacaggacgaacaatatataacgaaaaatttaaaggaaaagcaacattcacagccgacataagctccaatacagtacaaatgcaattatccagtctaacttcagaagactctgcagtatattattgtgcaagaagagattattatggaaacttttactacgcaatggactattggggccaaggaacaagtgtaacagtatcatcagcatccacaaaaggaccaagcgtatttccattagccccatgcagcagaagtacatcagaatcaacagcagcactaggatgtctagtaaaagactacttcccagaaccagtaactgtatcttggaactcaggagcactaacaagtggagttcacacattcccagcagttctccaatcctcaggattatactctctctccagcgtagtaacagttccaagctcttcactaggaaccaaaacatatacatgtaacgtagaccacaaaccatcaaatacaaaagtcgacaaacgagtagaatcaaaatacggaccaccctgcccttcctgccccgcccccgaattcttaggaggtccaagtgtattcctatttccaccaaaaccaaaagacacactaatgataagtcgaacaccagaagtaacatgcgtagtagtcgacgtatcccaagaagaccccgaagtacaattcaactggtacgtagacggagtagaagtacacaatgcaaaaactaaaccaagagaagaacaatttaactcaacatacagggtagtaagtgttctcacagttctacatcaagactggctaaacggtaaagaatacaaatgtaaagtctcgaataaaggattaccatcctccatagaaaaaacaatatcaaaagcaaaaggacaaccaagagaaccacaagtatacacactccctccatcacaagaagaaatgacaaaaaatcaagtatcattaacatgcctagtaaaaggattttacccatcagatatcgcagttgaatgggaaagcaacggacaacctgaaaacaattacaaaacaacaccaccagtattagattcagacggctcctttttcttatatagccgcttaacagtcgataaaagcagatggcaagaaggaaacgttttctcctgttctgtaatgcacgaagcactacacaaccattacacacaaaaatcattaagtctatcattaggaaaa

SEQ ID NO: 46320 - RNA, 642 nt, synthetic construct
  misc_feature 1..642: note = derived and/or modified sequence opt6 from Indatuximab_ravtansine_LightChain1
  source 1..642: mol_type = other RNA
gacatacaaatgacacaatcaacatcaagcctaagcgcctcattaggcgacagagtaacaataagctgcagcgcaagccaaggaataaacaattacttaaactggtaccaacaaaaaccagacggcacagtagaactactaatatactacaccagcacactacaatctggagtaccatcaagattctcaggatcaggctcaggaacagactactcactaacaataagcaacttagaaccagaagacataggaacatactactgccaacaatactcaaaactaccaagaacattcggcggaggaacaaaactagaaataaaaagaacagtagcagcaccatcagtattcatattcccaccatcagacgaacaattaaaatcaggcacagcatcagtagtatgcctactaaacaacttctacccacgcgaagcaaaagtacaatggaaagtagacaacgcactacaaagcggaaactcacaagaaagtgtaacagaacaagacagcaaagactcaacatactcattaagttcaacattaacactaagcaaagcagactacgaaaaacacaaagtatacgcatgcgaagtaacacaccaaggattatcatcaccagtaacaaaaagcttcaacagaggcgaatgc

SEQ ID NO: 46321 - RNA, 1347 nt, synthetic construct
  misc_feature 1..1347: note = derived and/or modified sequence opt6 from Indusatumab_vedotin_HeavyChain1
  source 1..1347: mol_type = other RNA
caagtacaattacaacaatggggcgcaggacttctaaaaccaagcgaaacactatctttaacatgcgcagtatttggaggatcattttcaggatactattggtcatggatcagacaaccaccaggcaaaggtctcgaatggattggagaaataaaccaccgaggaaacacaaacgataacccatcactcaaatcaagagtaacaatatccgtagacacaagcaaaaatcaatttgcactaaaattatcatcagtaacagcagccgacacagctgtatactactgtgcaagagaaagaggatacacatatggaaacttcgatcattggggccaaggaaccctcgtaacagtatcatctgcctccactaaaggaccatcagtattccccttagccccctcatcaaaatccacatccggaggaacagcagctttaggttgtttagtaaaagattatttccctgaaccagtcacagtatcatggaattccggagcactaacctcaggtgttcatacattcccagcagttttacagtcatctggcctatactcactaagctctgtagtaaccgtaccctcatcaagcttaggcacacaaacatacatatgtaatgtaaaccataagccatccaacacaaaagtagacaaaaaagtagaaccaaaatcctgtgataaaacccacacatgtccaccatgcccagctcccgaactacttggaggcccctctgtctttttattcccaccaaaacccaaagacacattaatgatatcaagaacaccagaagtaacttgcgtagttgtagacgtaagtcacgaagacccagaagtaaaatttaactggtacgtagacggagtagaagtacataacgcaaaaacaaaaccaagagaagaacaatacaactccacatacagagtcgtctcagtactaaccgtcctacatcaagactggctaaatggaaaagaatacaaatgcaaagtatcaaataaagcgcttccagcaccaatagaaaaaactatatctaaagcaaaaggacaaccaagagaaccccaagtatatacattaccaccatctcgagatgaactaacaaaaaaccaagtatccctcacatgtctcgtaaaaggtttttacccatccgacattgcagtagaatgggaatctaatggccagcccgaaaacaattacaaaacaacaccacctgtactagatagcgacggttcattttttctatattctaaactaacagtagacaaatcaagatggcaacaaggcaacgtattctcatgttctgtaatgcatgaagcactacataaccactacacacaaaaatccttatccttatcacccggaaaa

SEQ ID NO: 46322 - RNA, 642 nt, synthetic construct
  misc_feature 1..642: note = derived and/or modified sequence opt6 from Indusatumab_vedotin_LightChain1
  source 1..642: mol_type = other RNA
gaaatagtaatgacacaatcaccagcaactctaagtgtatcaccaggagaaagagcaacattaagctgtagagcaagccaatcagtaagcagaaacttagcatggtaccaacaaaaaccaggacaagcaccaagactattaatatatggagcaagcacaagagcaacaggaataccagcaagattctcaggatctggatctggcacagaatttacactaacaataggatcactacaaagcgaagactttgcagtatactattgccaacaatataaaacctggccaagaacattcggacaaggaacaaatgtagaaataaaaagaacagtagcagcaccaagcgtattcatattcccaccatcagacgaacaactaaaatcaggtacagcatcagtagtatgcttactaaataacttttacccacgagaagcaaaagtacaatggaaagtagataacgcactacaaagcggaaactcacaagaaagcgtaacagaacaagatagcaaagactcgacatatagtttaagctcaacattaacactaagcaaagcagattacgaaaaacataaagtatatgcatgcgaagtaacacaccaaggattaagctcaccagtaacaaaaagctttaacagaggagaatgc

SEQ ID NO: 46323 - RNA, 1353 nt, synthetic construct
  misc_feature 1..1353: note = derived and/or modified sequence opt6 from Inebilizumab_HeavyChain1
  source 1..1353: mol_type = other RNA
gaagtacaattagttgaatcaggcggaggtttagtacaaccaggaggatcactaagactctcatgcgcagcttcaggatttacatttagctcatcatggatgaactgggtcagacaagcaccaggaaaaggattagaatgggtaggtagaatatacccaggtgacggagatacaaattacaatgtcaaatttaaaggaagatttacaatatctagagacgattcaaaaaacagtctttatctccaaatgaactcattaaaaacagaagatacagcagtctattattgcgcaagatccggatttattacaacagttagagatttcgattactggggacaaggaacattagtaacagtatcatcagcatcaaccaaaggaccaagtgtatttccactcgcacccagttcaaaatcaacatcaggaggaacagcagctctaggctgcttagtaaaagactatttcccagaaccagtaacagtatcctggaattcaggtgcattaacaagtggcgtacacactttccctgcagtcttacaaagtagcggcctatactcactatcaagcgtagtaactgtaccttcatctagtctcggaactcaaacatacatatgcaacgtcaatcacaaaccttccaacaccaaagttgacaaaagagtagaaccaaaatcatgcgataaaacccacacatgcccaccatgcccagccccagagctcttaggaggaccatcagtatttttatttcctccaaaaccaaaagatacattaatgatatcacgtactccagaagtcacctgtgtagtagtagacgtaagccacgaagacccagaagtaaaatttaactggtacgtagacggagtagaagttcataacgcaaaaacaaaaccacgagaagaacaatacaacagtacatatagagtagtttccgtactaacagtactacaccaagactggttaaacggtaaagaatataaatgtaaagtaagtaataaagcactaccagcaccaatcgagaaaacaatatcaaaagcgaaaggacaaccacgagaaccacaagtctacaccttaccacctagcagagaagaaatgactaaaaaccaagtatccttaacatgcttagtaaaaggtttctatccatcagatatagccgtagaatgggaatctaacggtcaaccagaaaataattataaaacaacaccaccagtactagacagcgatggatcattctttctatattcaaaattaacagtagacaaatccagatggcaacaaggaaacgtattttcatgtagtgtaatgcatgaagcactacataaccattacacacaaaaatctttatctttatcacctggtaaa

SEQ ID NO: 46324 - RNA, 654 nt, synthetic construct
  misc_feature 1..654: note = derived and/or modified sequence opt6 from Inebilizumab_LightChain1
  source 1..654: mol_type = other RNA
gaaatagtattaacacaatcacccgacttccaaagcgtaacaccaaaagaaaaagtcacaataacttgccgagcaagcgaaagtgtagacacattcggaatatcattcatgaattggttccaacaaaaaccagaccaatcaccaaaactattaatacacgaagcatcaaaccaaggaagcggagtaccaagcagattctcaggatcaggctcaggaacagacttcacattaacaataaactcactagaagccgaagacgcagcaacatactactgccaacaatcaaaagaagtaccattcacattcggaggaggaacaaaagtagaaataaaaagaacagtagcagcaccaagcgtattcatattcccaccatcagacgaacaactaaaatcaggaacagcatcagtagtatgcctactaaacaacttctacccaagagaagccaaagtacaatggaaagtagacaacgcactacaaagcggaaattcacaagaatcagtaacagaacaagacagcaaagattcaacctatagcctaagctcaacactaacattatcaaaagcagactacgaaaaacacaaagtatatgcatgtgaagtaacacaccaaggcttatcatcaccagtaacaaaaagcttcaaccgaggagaatgc

SEQ ID NO: 46325 - RNA, 90 nt, synthetic construct
  misc_feature 1..90: note = derived and/or modified sequence opt6 from Insulin_peglispro_Fragment1
  source 1..90: mol_type = other RNA
ttcgtaaaccaacacttatgcggaagccatctagtagaagcactatatctagtatgcggagaaagaggatttttctatacaaaaccaaca

SEQ ID NO: 46326 - RNA, 63 nt, synthetic construct
  misc_feature 1..63: note = derived and/or modified sequence opt6 from Insulin_peglispro_Fragment2
  source 1..63: mol_type = other RNA
ggaatagtcgaacaatgctgtacatcaatatgttcattataccaactagaaaactattgcaat

SEQ ID NO: 46327 - RNA, 495 nt, synthetic construct
  misc_feature 1..495: note = derived and/or modified sequence opt6 from Interferon_beta-1b_chain1
  source 1..495: mol_type = other RNA
tcatacaacctactaggattcctacaaagatcatcaaacttccaatcacaaaaactactatggcaactaaacggaagactagaatactgcctaaaagacagaatgaacttcgacataccagaagaaataaaacaactccaacaattccaaaaagaagacgcagcactaacaatatacgaaatgctacaaaacatattcgcaatattcagacaagactcatcatcaacaggatggaatgaaacaatagtagaaaacctactagcaaacgtataccaccaaataaaccacctaaaaacagtattagaagaaaaactagaaaaagaagacttcacaagaggaaaactaatgtcatcactacacctaaaaagatactacggaagaatactacactacctaaaagcaaaagaatactcacactgcgcatggacaatagtaagagtagaaatactcagaaacttctacttcataaacagactaacaggatacttaagaaac

SEQ ID NO: 46328 - RNA, 1347 nt, synthetic construct
  misc_feature 1..1347: note = derived and/or modified sequence opt6 from Intetumumab_HeavyChain1
  source 1..1347: mol_type = other RNA
caagttcaattagtagaatcaggtggcggcgtagttcaaccaggaagatcaagacgcttatcatgcgcagcttcaggttttacattctcaagatatacaatgcattgggtaagacaagcacccggaaaaggattagaatgggtagcagtaatatcattcgatggatcaaacaaatactatgtcgactcagtaaaaggtcgattcactatatcaagagacaactcagaaaacacattatacttacaagtaaacatattacgcgcagaagacacagctgtatattattgcgccagagaagcaagaggctcttacgccttcgatatatggggccaaggaaccatggtaacagtatcatccgcatccacaaaaggaccaagtgtttttcccctagccccttcatcaaaatccacatcaggcggaacagcagccctaggatgcctagtaaaagactatttcccagaaccagtcactgtctcatggaacagtggagcactaacatcaggtgtacacacatttccagcagtactacaatcatcgggcctctattcactatcatccgtcgtaacagttccctcctcatccctaggtacacaaacatacatatgcaatgtaaaccataaaccctcaaatacaaaagtagataaaaaagtcgaaccaaaatcatgtgataaaacccacacatgtccaccatgtccagcaccagaactattaggaggaccatcagttttcttatttccacctaaaccaaaagatacactaatgatatccagaacaccagaagtaacatgtgttgtagtagatgtctcacacgaagacccggaagtaaaatttaattggtacgtagacggagtcgaagtccacaacgcgaaaacaaaaccacgtgaagaacaatataactcaacatatagagtagtttcagtactaacagttttacaccaagactggttaaacggtaaagaatacaaatgcaaagtatcaaacaaagccctaccagccccaatagaaaaaacaatctcaaaagcaaaaggacaaccaagagaaccacaagtttatacattaccaccctcaagagatgaactaacaaaaaaccaagtatcactaacctgtctagttaaaggtttttatccatccgatatagctgtagaatgggagtcaaatggccaaccagaaaacaactacaaaactacaccaccagtattagattcagacggatcattcttcctatattctaaattaacagtcgacaaatcaagatggcaacaaggaaacgtcttttcatgctccgttatgcatgaagcattacacaatcattacacacaaaaatcattatcattatctccaggcaaa

SEQ ID NO: 46329 - RNA, 645 nt, synthetic construct
  misc_feature 1..645: note = derived and/or modified sequence opt6 from Intetumumab_LightChain1
  source 1..645: mol_type = other RNA
gaaatagtactaacacaatccccagcaacactatcattatcaccaggagaaagagcaacattatcttgcagagcatcacaatcagtatcatcatacctagcatggtaccaacaaaaacccggccaagctccacgcttactaatatacgacgcatcaaaccgagcaacaggcataccagcaagattctctggatcaggatcaggaacagacttcacactaacaatctcttcactagaaccagaagacttcgcagtatactactgccaacaaagatcaaactggccaccattcacattcggaccaggaaccaaagtagacataaaaagaacagtagcagcaccatccgtattcatattcccaccatcagatgaacaactaaaatctggaacagcatcagtagtatgcctattaaacaacttctacccccgagaagcaaaagtacaatggaaagttgacaacgctttacaatccggaaactcacaagaatcagtaaccgaacaagactcaaaagactcaacctactcactatcatcaacactaacactatctaaagcagactacgaaaaacacaaagtatacgcatgcgaagtaacacaccaaggattatcatcaccagtcacaaaatcattcaacagaggcgaatgc

SEQ ID NO: 46330 - RNA, 1347 nt, synthetic construct
  misc_feature 1..1347: note = derived and/or modified sequence opt6 from Iodine_(124I)_Girentuximab_HeavyChain1
  source 1..1347: mol_type = other RNA
gatgtaaaattagtagaatcaggaggaggcctagtaaaactaggaggctccttaaaactatcatgcgcagcatctggatttacattttcaaactactacatgtcctgggtaagacaaacacctgaaaaaagactagaattagtcgcagcaataaactcggatggcggaataacttattacctagatactgtaaagggaagatttactatatcacgagataacgcaaaaaatactttatacttacaaatgtcttcactaaaatcagaagacacagcattattctactgcgctagacatcgaagtggttatttttcaatggactactggggacaaggaacaagtgtaacagtatcctccgcatcaacaaaaggaccctcagttttcccattagcaccatcaagtaaatcaacatcaggaggcacggcagcactcggatgcctcgttaaagactacttcccagaaccagttaccgtatcctggaactcaggagcattaacatcaggagtacacacattcccagccgtcctccaatcctcaggactatattcactctcatccgtagtcacagttccttcttcatcattaggtacacaaacctacatatgcaacgtaaaccacaaaccctctaataccaaagtagataaaaaagtagaaccaaaatcgtgtgataaaacacacacttgcccaccatgcccagcaccggaactattaggaggaccatccgtatttttatttcctccaaaaccaaaagacaccctcatgatatcaagaacaccagaagtcacctgcgtagtcgtagacgtatcacacgaagacccagaagtaaaatttaactggtacgtagacggtgtcgaagtacacaacgcaaaaacaaaaccaagagaagaacaatataactcaacatacagagtagtatcagtactcactgtattacaccaagactggctaaatggaaaagaatacaaatgcaaagtaagcaataaagccttaccagcaccaatcgaaaaaacaatatccaaagcaaaaggtcaaccaagagaaccacaagtttacacacttcccccctccagagacgaactaacaaaaaatcaagtaagcctaacatgcctagtaaaaggattttacccttcagatatagcagtcgaatgggaatcaaacggacaaccagaaaacaattacaaaacaacacccccagtactagactctgatggatcattcttcctatactcaaaattaaccgttgacaaatcaagatggcaacaaggaaatgtattctcatgttcagtaatgcacgaagcactacacaaccactatacacaaaaatcattatcattatcaccaggaaaa

SEQ ID NO: 46331 - RNA, 642 nt, synthetic construct
  misc_feature 1..642: note = derived and/or modified sequence opt6 from Iodine_(124I)_Girentuximab_LightChain1
  source 1..642: mol_type = other RNA
gatatagttatgacacaatctcaaagattcatgagcactacagtaggagatagagtatcaataacatgtaaagcaagccaaaacgtagtatcagcagtcgcatggtaccaacaaaaaccaggacaatcacccaaactattaatatatagcgcaagcaatagatatacaggagtaccagacagattcacaggatcaggatcaggaacagactttacactaacaatatcaaatatgcaatcagaagacctagcagatttcttttgccaacaatacagcaattacccatggacatttggaggaggaacaaaactagaaataaaaagaacagtagcagcaccaagcgtattcatattcccaccatcagacgaacaattaaaatcaggaacagcatcagtagtatgcttactaaataacttttacccaagagaagcaaaagtacaatggaaagtagataacgcactacaaagtggaaactcacaagaaagcgtaacagaacaagacagcaaagattcaacctattcattaagctcaaccttaaccctatcaaaagcagattacgaaaaacataaagtatacgcatgcgaagtaacacaccaaggattaagctcacccgtaacaaaaagctttaacagaggagaatgc

SEQ ID NO: 46332 - RNA, 1335 nt, synthetic construct
  misc_feature 1..1335: note = derived and/or modified sequence opt6 from Iodine_(131I)_derlotuxiab_biotin_HeavyChain1
  source 1..1335: mol_type = other RNA
caggtacaattaaaagaatcaggtccaggtttagtcgccccatcccaatcattatcaataacttgcacagtatcaggattctctctaacagactacggtgtaagatggataagacaaccaccaggaaaaggcttagaatggcttggcgttatatggggaggaggatctacatattacaactctgccttaaaatcaagactatctatatcaaaagacaatagcaaatcccaagtattcctcaaaaactcactacaaacagatgacacagcatactactgtgcaaaagaaaaaagaagaggatactactacgctgactactggggacaaggaacatctgtcacagtctcatctgcatcaaccaaaggaccctccgtatttccactagcaccatcatcaaaatcaacatcaggcggaaccgcagcactagggtgcctagtaaaagattacttccccgaaccagtaacagtatcatggaactctggagcactaacttcaggtgtacacacatttcctgcagtactacaatcctcaggactatattcattatcatcagtagtaaccgtaccatccagttctctaggaacacaaacatatatctgcaacgttaaccacaaaccatcaaatacaaaagtagataaaaaagctgaaccaaaatcctgcgataaaacccacacatgtcccccctgcccagcaccagaactattaggtggtccatccgtcttcctatttccaccaaaaccaaaagatactctaatatcccgaacaccagaagtcacatgtgtcgtagtagacgtttcacacgaagatccagaagtaaaattcaattggtacgtcgacggcgtcgaagtacataacgccaaaacaaaaccaagagaagaacaatacaactcaacatacagagtagtatcagttctaacagtcttacatcaagactggctaaacggaaaagaatacaaatgtaaagtaagcaacaaagcactaccagcaccaatagaaaaaacaatatcaaaagcaaaaggccaaccacgagaaccacaagtttacacattacccccatcaagagacgaattaacaaaaaatcaagtatcattaacctgtctagtaaaaggtttctacccatcagatatagcagtagaatgggaatcaaacggacaaccagaaaacaactacaaaacaacaccaccagtattagactccgacggatcattttttctctacagtaaactaacagtcgacaaatcaagatggcaacaaggaaacgtattctcatgctcagtacacgaagcactccacaaccactacacacaaaaatccctatctctatctcctggaaaa

SEQ ID NO: 46333 - RNA, 639 nt, synthetic construct
  misc_feature 1..639: note = derived and/or modified sequence opt6 from Iodine_(131I)_derlotuxiab_biotin_LightChain1
  source 1..639: mol_type = other RNA
gaaaacgtattaacacaatcaccagccatatcagcatcaccaggagaaaaagtaacaacctgccgagcatcatcatcagtatcatcatcatacctacactggtaccaacaaaaatcaggagcatcaccaaaattatggatatactcaacatcaaacctagcatcaggtgtcccagcaagattctcaggatcaggatcaggcacatcatactcactaactatttcctccgtagaagccgaagacgcagcaacatactactgccaacaatactcaggatacccattaacattcggcggaggaacaaaactagaaataaaaagaacagtagcagcaccatcagtattcatattcccaccctcagacgaacaattaaaatcaggaacagcatcagtagtatgcctattaaacaacttctatccaagagaagcaaaagtacaatggaaagtagacaacgcactacaatccggaaactcacaagaatcagtaacagaacaagactcaaaagactcaacatactcactatcatcaaccctaaccctatcaaaagccgactacgaaaaacacaaagtatacgcatgcgaagtaacacaccaaggactatcatcaccagtaacaaaatcatttaacagaggagaatgc

SEQ ID NO: 46334 - RNA, 1350 nt, synthetic construct
  misc_feature 1..1350: note = derived and/or modified sequence opt6 from Iodine_(131I)_Derlotuximab_biotin_HeavyChain1
  source 1..1350: mol_type = other RNA
caagtacaactcaaagaatcaggcccaggactagtagccccatcacaatctctatctataacatgcaccgtatcaggattctctctcaccgattacggagtaagatggataagacaaccacccggaaaaggactagaatggttaggagtaatatggggaggagggtcgacatactacaacagcgcactaaaatcaagactatcaattagcaaagataactcaaaatcacaagttttcctaaaaatgaacagtttacaaactgatgacacagccatgtactattgcgcaaaagaaaaaaggcgaggatattactatgcaatggattactggggacaaggcacatcagtaacagtatcttcagcatcaacaaagggaccaagcgtattcccattagcacccagtagtaaatcaacaagcggaggaacagcagcccttggatgtctagtaaaagactacttcccagaaccagttacagtatcatggaattctggagcattaacatcaggcgtccacacatttccagcagttttacaatcatcaggattatacagtctatcaagtgtagtaacggtaccatcatcaagcctaggaacccaaacatacatatgcaacgttaatcataaaccatctaacacaaaagtagacaaaaaagcagaaccaaaatcatgcgacaaaacacacacatgcccaccatgcccagcacccgagctattaggaggaccatcagtattcttgttcccaccaaaaccaaaagatactttaatgataagcagaacaccagaagtaacatgcgtagtcgttgacgtatcccatgaagaccccgaagtcaaattcaactggtatgtagatggagtagaagtacataacgcaaaaacaaaaccacgcgaagaacaatataactcaacatatagagttgtatcagtacttacagttctacaccaagactggctaaatggaaaagaatacaaatgcaaagtatcaaacaaagcattaccagcaccaatagaaaaaactatatcaaaagcaaaaggacaaccaagagaaccccaagtatatacattacctccaagtcgagacgaattaacaaaaaaccaagtatcattaacatgcctcgtaaaaggattctatcccagcgacatcgcagtcgaatgggaatcaaatggacaacctgaaaataattacaaaacaacaccaccagtattagattcagacggatcattctttttatactcaaaactaacagtagataaatcaagatggcaacaaggaaatgtcttcagttgctcagtaatgcatgaagcactacataatcattacactcaaaaatcattatcactatccccaggaaaa

SEQ ID NO: 46335 - RNA, 645 nt, synthetic construct
  misc_feature 1..645: note = derived and/or modified sequence opt6 from Iodine_(131I)_Derlotuximab_biotin_LightChain1
  source 1..645: mol_type = other RNA
gaaaacgtcctaacccaatcaccagcaataatgtcagcatcaccaggagaaaaagtaacaatgacatgcagagcatcctcatcagtatcatcctcatacctacattggtatcaacaaaaatccggagcatcaccaaaactatggatatactccacatcaaacttagcatcaggagtcccagcaagattctcaggatcaggatcaggaacatcatactcattaaccatatcatcagtagaagcagaagacgccgcaacatactactgccaacaatattcaggatacccattaacattcggaggaggaacaaaattagaaatcaaaagaacagtagcagcaccatctgtattcatattcccaccatcagacgaacaactaaaatccggaacagcatcagtagtatgcctactaaacaacttctatccaagagaagcaaaagtacaatggaaagtagacaacgcactacaatcaggaaactcacaagaatcagtaacagaacaagactcaaaagactcaacatactcactatcatcaactctaacactatcaaaagcagactatgaaaaacacaaagtatacgcatgtgaagtaacacaccaaggcctatcatccccagtaacaaaatcattcaacagaggagaatgc

SEQ ID NO: 46336 - RNA, 1344 nt, synthetic construct
  misc_feature 1..1344: note = derived and/or modified sequence opt6 from Ipilimumab_HeavyChain
  source 1..1344: mol_type = other RNA
caagtacaattagtagaatcaggaggaggtgtagtacaaccaggaaggtcactaagactatcatgtgctgcatcaggattcacattctcttcatacacaatgcattgggtacgacaagcaccaggaaaagggttagaatgggtaacattcatatcttacgatggaaacaacaaatattatgccgactccgtaaaaggtcgcttcaccatatcaagagacaactccaaaaacactttatacttacaaatgaactcattaagagcagaagacactgctatatattactgtgccagaacaggatggctaggccctttcgactactggggacaaggaacactagtcacagtatcatcagcatcaacaaaagggccatcagtattcccattagcaccatctagcaaatcgacatcaggaggaacagcagccctaggatgcctcgtaaaagactatttccccgaacctgtaactgtatcttggaactcaggagcacttacatctggagtccacacttttcctgccgtactacaatcttcaggattatactcattatcatcagttgtaacagtaccttcatcatcactaggaacacaaacatacatatgcaacgtaaaccacaaaccatcaaatacaaaagtagacaaacgagtagaaccaaaatcctgcgacaaaacacatacatgtccaccatgccccgcaccagaactcttaggaggcccctcagtattcttatttccacctaaacccaaggacacattaatgatatcaagaacacccgaagtaacctgcgtagtagtagacgtctcacacgaagatccagaagttaaatttaattggtacgtagacggagtagaagtacacaatgcaaaaacaaaaccaagagaagaacaatacaattcaacatacagagtagtatctgtattaactgtactccaccaagactggttaaacggaaaggaatacaaatgcaaagtctcaaacaaagcactacccgcacccatcgaaaaaacaatatcaaaagcaaaaggtcaacccagagaaccccaagtctacacattacccccatccagagatgaactaacaaaaaatcaagtatccttaacatgcctagttaaagggttttacccatccgatatagcggtagaatgggaatccaacggacaaccagaaaacaattataaaacaacacctccagtactagactcagatggatcattcttcctatattcaaaattaacagtagacaaatcaagatggcaacaaggaaacgttttctcatgctccgttatgcacgaagcactacataatcactatacacaaaaatcactttccctctcacccggaaaa

SEQ ID NO: 46337 - RNA, 645 nt, synthetic construct
  misc_feature 1..645: note = derived and/or modified sequence opt6 from Ipilimumab_LightChain
  source 1..645: mol_type = other RNA
gaaatagtattaacacaatcacccggaacattatcactatcaccaggagaaagagcaacactatcatgcagagcatcacaatcagtaggaagctcctacctagcatggtaccaacaaaaaccaggacaagcaccaagactactaatatacggagcattttcaagagcaacaggaataccagatagattctcaggatcaggatcaggaacagacttcacactaacaatatcaagattagaaccagaagacttcgcagtatactactgccaacaatacggatcatcaccatggacattcggacaaggaacaaaagtagaaatcaaaagaacagtagcagcaccaagcgtattcatattcccaccatcagacgaacaattaaaatcaggtacagcatcagtagtatgcctcttaaacaacttctacccaagagaagctaaagttcaatggaaagtagacaacgcactacaaagcggaaactcacaagaatcagtaacagaacaagactcaaaagactcaacatactcactatcatcaacactaacactaagcaaagcagactacgaaaaacacaaagtatacgcatgcgaagtaacacaccaaggtctatcatcaccagtaaccaaatccttcaacagaggagaatgc

SEQ ID NO: 46338 - RNA, 186 nt, synthetic construct
  misc_feature 1..186: note = derived and/or modified sequence opt6 from Iratumumab_HeavyChain1
  source 1..186: mol_type = other RNA
caagtacaattacaacaatggggagcaggattattaaaaccaagtgaaacattaagtctaacatgtgcagtatatggaggaagttttagtgcatattattggagttggataagacaaccaccaggaaaaggattagaatggataggagattattggggacaaggaagtttagtaacagtaagtagt

SEQ ID NO: 46339 - RNA, 321 nt, synthetic construct
  misc_feature 1..321: note = derived and/or modified sequence opt6 from Iratumumab_LightChain1
  source 1..321: mol_type = other RNA
gacatacaaatgacacaatcaccaacatcactatcagcatcagtaggagacagagtaacaataacatgcagagcatcacaaggaatatcatcatggctaacatggtaccaacaaaaaccagaaaaagcaccaaaatcactaatatacgcagcatcatcactacaatcaggagtaccatccagattctcaggatcaggatcaggaacagacttcacactaacaatatcatcactacaaccagaagacttcgcaacatactactgccaacaatacgactcatacccaataacattcggacaaggaacaagactagaaataaaa

SEQ ID NO: 46340 - RNA, 1350 nt, synthetic construct
  misc_feature 1..1350: note = derived and/or modified sequence opt6 from Isatuximab_HeavyChain1
  source 1..1350: mol_type = other RNA
caagtacaactagtacaatcaggagcagaagtagccaaaccaggaacctcagtaaaactctcttgcaaagcatcaggatatactttcacagactactggatgcaatgggtaaaacaaagaccaggacaaggactcgaatggataggaacaatatacccaggcgatggagatactggatacgcccaaaaatttcaaggtaaagccacactcacagccgacaaatcatctaaaacagtttacatgcatttatcatctttagcaagcgaagattcagcagtatactactgtgcacgaggagactattatggatcaaattcattagactattggggacaaggtaccagcgtaacagtttcttcagcatcaacaaaaggaccatcagtatttcctttagccccatcctcaaaatcaacatccggaggaaccgcagccttaggatgtttagtaaaagactactttccagaacccgtaacagtatcatggaactcaggagctttaacatcaggagtacataccttcccagcagtattacaatcaagtggattatattctctaagcagcgttgtaacagtaccttcatcatcactaggaactcaaacatatatatgtaacgtcaatcataaaccaagcaacacaaaagtcgataaaaaagtagaaccaaaaagctgcgacaaaacacacacatgccctccttgcccagcaccagaactattaggaggaccatctgtcttcttatttcccccaaaaccaaaagacacactaatgatctcaagaactccagaagtaacatgcgtagttgtagacgtaagtcacgaagaccccgaagtaaaatttaactggtacgtagacggagttgaagtccacaatgcaaaaacaaaaccacgagaagaacaatataactctacatatcgcgtagtatctgtacttaccgttttacatcaagactggctaaacggcaaagaatacaaatgcaaagtatcaaacaaagcattaccagcaccaatagaaaaaacaataagcaaagccaagggccaacccagggaaccccaagtctacacactaccaccatcaagagacgaattaacaaaaaaccaagtatcactaacatgcttagtcaaaggattttacccatcagatatcgccgtagaatgggaaagtaacggacaaccagaaaacaactacaaaacaacaccaccagtactagactcagatggatcatttttcctatattcaaaactcacagtagacaaaagtcgatggcaacaaggaaacgtattctcctgctcagtaatgcacgaagcattacacaaccactacactcaaaaatctttatcattatcaccaggaaaa

SEQ ID NO: 46341 - RNA, 642 nt, synthetic construct
  misc_feature 1..642: note = derived and/or modified sequence opt6 from Isatuximab_LightChain1
  source 1..642: mol_type = other RNA
gacatagtaatgacacaatcacacctatcaatgtccacatcactaggcgacccagtatccataacctgcaaagcatcacaagatgtatcaacagtagtagcatggtaccaacaaaaaccaggacaatcaccaagaagactaatatactcagcatcatacagatacataggagtaccagacagattcacaggctccggagcaggcacagacttcacattcacaatatcctcagtccaagcagaagacctagcagtatactactgccaacaacattactccccaccatacacattcggaggcggaactaaactagaaataaaaagaacagtagcagcaccatcagtattcatattcccaccatcagacgaacaactaaaatcaggcacagcatcagtagtatgcctactaaacaacttctatccacgagaagcaaaagtacaatggaaagtagacaacgcattacaatcaggaaactcacaagaatcagtaacagaacaagactccaaagactcaacctactcattatcatcaacactaaccctatcaaaagcagactacgaaaaacacaaagtatacgcatgcgaagtaacacaccaaggattatcatcaccagtaacaaaatcatttaacagaggagaatgc

SEQ ID NO: 46342 - RNA, 1347 nt, synthetic construct
  misc_feature 1..1347: note = derived and/or modified sequence opt6 from Itolizumab_HeavyChain1
  source 1..1347: mol_type = other RNA
gaagtccaattagttgaatcaggaggaggactagtaaaaccaggaggttcattaaaattatcatgcgcagcatcaggattcaaattctcaagatatgcaatgtcatgggtaagacaagcacctggaaaaagactagaatgggtagcaacaatatcctcaggaggctcttacatatactaccccgactcagtcaaaggccgattcacaatatcaagagacaacgtaaaaaacacattatatttacaaatgtcatcactaagatctgaagacacagctatgtattattgcgccagacgcgattacgacttagattacttcgattcctggggacaaggaacactagtaacagtatcatcagcatccacaaaaggaccctccgtcttccccctagcaccatcaagcaaatccacatccggcggaactgcagcattaggatgcctagttaaagactatttccctgaacctgttaccgtttcatggaactcaggagcactcacatctggagtacatacatttcctgcagtcttacaatcatcaggactatattcattatcttcagtagtaacagtaccctcatcaagcttaggtacacaaacatacatatgtaacgtaaatcacaaaccatctaacacaaaagtagacaaaaaagtagaaccaaaatcatgcgataaaacccatacatgcccaccctgtccagcccccgaactattaggcggcccatcagtttttttattccctccaaaaccaaaagatactctaatgatatcacgaacaccagaagtaacctgcgttgtcgtagatgtctcacatgaagatccagaagtcaaattcaattggtatgtagacggtgtagaagtccacaacgcaaaaacaaaaccaagagaagaacaatataactcaacataccgagtagtcagcgtattaactgtacttcatcaagactggctaaacggaaaagaatacaaatgtaaagtatcaaacaaagccctaccagccccaatcgaaaaaacaatatcaaaagcaaaaggtcaaccaagagaaccccaagtatatacactaccaccatcaagagacgaattaactaaaaatcaagtatctctaacatgcctcgtcaaaggattctacccttccgatatagccgtagaatgggaatcaaatggacaaccagaaaacaactataaaaccacaccaccagtactagactccgacggatccttcttcctatactcaaaattaaccgtcgacaaatcacgatggcaacagggaaacgtcttctcatgttcagtcatgcacgaagccctacacaatcactacacccaaaaatctttaagtctatcaccaggaaaa

SEQ ID NO: 46343 - RNA, 642 nt, synthetic construct
  misc_feature 1..642: note = derived and/or modified sequence opt6 from Itolizumab_LightChain1
  source 1..642: mol_type = other RNA
gacatacaaatgacccaatcaccctctagcttatcagcatcagtaggagacagagtaacaataacatgtaaagcatcaagagacataagatcatacctaacatggtaccaacaaaaacccggaaaagcaccaaaaaccctaatatattacgccacatcactagcagacggagtaccctcaagattctccggatccggatcaggacaagactactcactaactatatcctcactagaatcagacgacacagcaacatactactgcctacaacacggagaatcaccattcacactaggatcaggaacaaaactagaaataaaaagaacagtagcagcaccatcagtattcatattcccaccatcagacgaacaactaaaatcaggaacagcatcagtagtatgcctattaaacaacttctacccaagagaagcaaaagtccaatggaaagtagacaacgcactacaatccggaaactcacaagaatcagtaacagaacaagacagcaaagactcaacatactcactatcctcaacattaacactatccaaagccgactacgaaaaacacaaagtatacgcttgcgaagtaacacaccaaggcctatcatcacccgtaacaaaatccttcaaccgaggagaatgc

SEQ ID NO: 46344 - RNA, 1335 nt, synthetic construct
  misc_feature 1..1335: note = derived and/or modified sequence opt6 from Ixekizumab_HeavyChain1
  source 1..1335: mol_type = other RNA
caagtacaacttgttcaatccggagcggaagtcaaaaaaccaggctcaagcgtcaaagtttcatgtaaagcaagcggttattcattcacagattatcacattcactgggtaagacaagcacctggacaaggactagaatggatgggagtaattaatccaatgtacggaaccacagactataaccaacgatttaaaggaagagtaaccataacagcagacgaatcaacatcaacagcatatatggaactcagttcattaagatcagaagatacagcagtttattactgcgcaagatatgattattttacaggcaccggagtatattggggacaaggaacattagtaacagtttcaagcgcctcaacaaaaggaccctccgtattcccattagcaccatgctcaagatcaacatccgaatcaacagcagcattaggatgtctagtcaaagattattttccagaacctgtaacagtatcctggaactcaggagctttaacttcaggagtacacacattccctgcagtcttacaatcatccggactatattcattatcatccgtcgttacagtaccatcatcttctctaggcactaaaacatatacatgcaacgttgaccacaaaccctcaaacacaaaagtagacaaaagagttgaatcaaaatacggaccaccatgcccaccatgccccgcaccagaattcctaggaggaccttcagtatttctatttccaccaaaaccaaaagacacactaatgatatcacgaacaccagaagtaacatgcgtagtagtagatgtctcacaagaagatccagaagttcaatttaactggtatgtagatggagtagaagtccataacgcaaaaacaaaaccaagagaagaacaatttaactccacatacagagtagtatcagtattaactgtactacaccaagactggctaaacggaaaagaatataaatgtaaggtatccaacaaaggactaccctcatcaatagaaaaaacaataagcaaagcaaaaggacaacctcgagaaccacaagtatatacattaccaccttcacaagaagaaatgactaaaaaccaagtatctttaacatgcctagtaaaaggattctatccttctgatatagctgtcgaatgggaaagcaacgggcaaccagaaaataactataaaaccacaccaccagtattagactccgacggaagcttctttctatatagcagattaacagtagacaaatcacgatggcaagaaggaaatgtattcagttgttctgtaatgcatgaagcactccataaccattatactcaaaaatcattatcactatctttaggc

SEQ ID NO: 46345 - RNA, 657 nt, synthetic construct
  misc_feature 1..657: note = derived and/or modified sequence opt6 from Ixekizumab_LightChain1
  source 1..657: mol_type = other RNA
gacatagtaatgacacaaacacccctatcactatcagtaacaccaggacaaccagcatccatatcatgtagatcatcacgatcactagtacactcacgaggaaacacatacctacactggtacctacaaaaaccaggacaatcaccacaactattaatatacaaagtttctaacagattcataggagtaccagacagattctcaggatcaggatcaggaaccgacttcacactaaaaatatcacgagtagaagcagaagacgtaggagtatactactgctcacaatcaacccacctaccattcacatttggacaaggaaccaaactagaaataaaacgcactgtagcagcaccatcagttttcatattcccaccatcagacgaacaactaaaatcaggaacagcttcagtagtatgcctactaaacaacttctacccacgagaagcaaaagtacaatggaaagtagataatgcattacaatcaggaaactcacaagaatccgtaacagaacaagactcaaaagactcaacatactcactatcatcaacactaaccctatcaaaagcagactacgaaaaacacaaagtatacgcatgcgaagtaacacaccaaggactatcatcaccagtaacaaaatcattcaacagaggagaatgc

SEQ ID NO: 46346 - RNA, 1347 nt, synthetic construct
  misc_feature 1..1347: note = derived and/or modified sequence opt6 from Labetuzumab_govitecan_HeavyChain1
  source 1..1347: mol_type = other RNA
gaagttcaattagtagaatcaggtggaggagttgtacaaccaggaagaagtctaagactttcttgttcagcatcaggatttgacttcacaacctactggatgtcatgggtacgacaagcaccaggaaaaggacttgaatggataggcgaaatacacccagactcctcaactattaactacgcaccttcactaaaagacagattcacaatatcacgagacaatgcaaaaaatacccttttcttacaaatggattctttaagaccagaagacaccggagtatatttctgcgcctctttatacttcggatttccatggttcgcatactggggccaaggaacaccagttacagtctcatctgcttcaactaaaggaccatcagtctttccattagcaccctcctctaaatctacatcaggaggaactgcagcactaggatgcttagtaaaagactacttcccagaaccagttacagtatcctggaattcaggagccctaacatcaggagtacacacatttccagcagtacttcaatcatcaggattatattcactcagttccgtagtaaccgtaccatcttcttcactaggaacacaaacatatatttgcaacgtgaaccataaaccctcaaacacaaaagtcgataaaagagtagaaccaaaatcatgtgataaaacccacacttgccccccttgcccagcacctgaactactaggaggaccatctgtattcctcttcccaccaaaaccaaaagatacactcatgatatcaagaacacccgaagtcacatgcgtagtagtagatgtatcacacgaagacccggaagtaaaattcaactggtacgttgatggagtcgaagtacacaacgcaaaaacaaaacccagagaagaacaatataactcaacctaccgagtagtatcagtcctaacagtacttcaccaagattggctaaacggtaaagaatacaaatgcaaagtttctaacaaagcactacccgcccccatagaaaaaaccatctccaaagcaaaaggacaaccaagagaaccacaagtctacacactaccaccatctcgagaagaaatgacaaaaaaccaagtatcattaacatgccttgtcaaaggattctacccctcagacatagcagtagaatgggaatcaaacggccaaccagaaaacaactacaaaacaacacccccagttcttgactcagacggttcattctttctatactcaaaactaacagttgacaaatccagatggcaacaaggcaacgtattctcatgctcagtaatgcacgaagcactacacaatcactatacacaaaaatcactatcattatcaccaggaaaa

SEQ ID NO: 46347 - RNA, 639 nt, synthetic construct
  misc_feature 1..639: note = derived and/or modified sequence opt6 from Labetuzumab_govitecan_LightChain1
  source 1..639: mol_type = other RNA
gacatacaactaacacaatcaccatcatcactatcagcctcagtaggagacagagtaacaataacatgcaaagcctcacaagacgtaggcacatccgtagcctggtaccaacaaaaaccaggaaaagcaccaaaactattaatctactggacatcaacaagacacacaggagtaccatcaagattctcaggctcaggttcaggaacagacttcacattcacaatatcatcactacaaccagaagacatcgcaacatactactgccaacaatactcactatacagatcattcggacaaggaacaaaagtagaaataaaaagaacagtagcagcaccctcagtcttcatattcccaccatcagatgaacaactaaaatcaggaacagcatccgtagtatgcctactaaacaacttctacccaagagaagccaaagtccaatggaaagtagacaacgcattacaatcaggtaactcacaagaatcagtaacagaacaagactcaaaagactcaacatactcactatcctcaacactaacattatcaaaagcagattacgaaaaacacaaagtatacgcctgcgaagtaacacaccaaggactatcatcacccgtaaccaaatcattcaacagaggagaatgc

SEQ ID NO: 46348 - RNA, 1341 nt, synthetic construct
  misc_feature 1..1341: note = derived and/or modified sequence opt6 from Lambrolizumab_HeavyChain1
  source 1..1341: mol_type = other RNA
caagtacaactagtacaatcaggtgtcgaagttaaaaaacctggagcgtcagtaaaagtaagttgcaaagctagcggatacacatttacaaattattatatgtattgggtaagacaagccccaggacaaggattagaatggatgggaggtattaacccatcaaacggaggaacaaacttcaacgaaaaattcaaaaatcgagtaaccctcactacagattcaagcacaacaacagcatatatggaattaaaatcactccaattcgacgacactgcagtctactattgtgctagaagagattaccgattcgacatgggatttgattattggggccaaggaacaacagtaaccgtatcatcagcttcaacaaaaggaccctctgtattcccattagcaccatgttcaagaagcacatcagaatcaacagcagcactaggatgcttagtaaaagactactttccagaacctgtcacagtatcttggaactcaggagcattaacctccggagtacacactttcccagctgtattacaatcttccggactatattcattatcatcagtagtcacagtcccatcatcatccttaggaacaaaaacatacacatgcaacgtagaccacaaaccatcaaacacaaaagtagacaaaagagtagaatcaaaatatggaccaccatgccccccatgtccggccccggaattcttaggcggcccttcagtcttcttattccctccaaaaccaaaagatacactaatgatatcaagaacacccgaagtcacatgcgtagtagtagatgtatctcaggaagatccagaagtccaattcaactggtacgtagacggagtagaagtacacaatgcaaaaacaaaaccaagagaagaacaatttaactcaacatatcgcgtagtatcagtcctaacagtactacaccaagattggttaaacggtaaagaatacaaatgtaaagtatcaaacaaaggattaccatcatcaatcgaaaaaaccataagcaaagcaaaaggacaaccaagagaaccacaagtatacacattaccaccatctcaagaagaaatgacaaaaaatcaagtatcactaacctgcttagtcaaaggtttttacccatcagatatcgcagtagaatgggaatctaatggacaaccagaaaacaattacaaaacaacaccacctgtactagactcagacggaagttttttcctatactcacgcctaacagtagataaaagcagatggcaagaaggaaacgtattctcatgttcagtaatgcacgaagctttacacaatcattacacccaaaaatccttatcattatcactaggaaaa

SEQ ID NO: 46349 - RNA, 654 nt, synthetic construct
  misc_feature 1..654: note = derived and/or modified sequence opt6 from Lambrolizumab_LightChain1
  source 1..654: mol_type = other RNA
gaaatagtactaacacaatctccagcaacattaagcttaagcccaggagaaagagcaacattaagctgtagagcaagcaaaggcgtatcaacatctggatactcttacttacactggtaccaacaaaaaccaggacaagcaccaagactattaatatatctagcatcatatctagaaagcggagtaccagcaagattctcaggatcaggatcaggaacagactttacattaacaataagctcattagaaccagaagactttgcagtatactattgccaacactcaagagacctaccactaacattcggaggaggtacaaaagtagaaataaaaagaacagtagcagcaccaagcgtcttcatattcccaccatcagatgaacaattaaaatcaggcacagcatcagtagtatgcttactaaacaatttttacccaagagaagcaaaagtacaatggaaagtagataacgcactccaatcaggcaactcacaagaatcagtaacagaacaagattcaaaagactcaacctattcactaagctcaacactaaccttaagcaaagccgactacgaaaaacataaagtttacgcatgcgaagtaacacaccaaggattaagctcaccagtaaccaaatcctttaacagaggagaatgc

SEQ ID NO: 46350 - RNA, 669 nt, synthetic construct
  misc_feature 1..669: note = derived and/or modified sequence opt6 from Lampalizumab_HeavyChain1
  source 1..669: mol_type = other RNA
gaagtacaattagtacaatcaggaccagaactaaaaaaaccaggagcatcagtaaaagtcagctgtaaagcatcaggatacactttcacaaactatggaatgaactgggtacgacaagcaccaggacaaggtctagaatggatgggatggataaatacatatacaggagaaacaacatatgcagacgactttaaaggaagatttgtcttttcactagacacatcagtatcaacagcatatctacaaatatcatcacttaaagctgaagacacagcagtatattactgtgaaagagaaggaggagtcaacaattggggacaaggaacactagtaactgtaagttcagcatcaacaaaaggaccaagtgtatttccactagcaccatcatcaaaatcaacatcaggaggaacagcagcactaggatgtctagtaaaagattactttccagaaccagtaaccgtaagttggaactcaggagcactaacatcaggtgtacatacatttccagcagtattacaaagttcaggtctatattcgttatcatcagtcgtaacagtaccaagctcatcactaggaacacaaacatatatatgtaacgtaaaccataaaccatcaaacactaaagtagataaaaaagtagaaccaaaatcatgtgacaaaacacataca

SEQ ID NO: 46351 - RNA, 642 nt, synthetic construct
  misc_feature 1..642: note = derived and/or modified sequence opt6 from Lampalizumab_LightChain1
  source 1..642: mol_type = other RNA
gacatacaagtaacacaatcaccatcctcactaagcgcatcagtaggagaccgagtaacaataacatgcataacatcaacagacatagacgatgacatgaactggtaccaacaaaaaccaggaaaagtacccaaactcctaatatcaggaggaaacacgctaagaccaggagtaccatcaagattctcaggatcaggatcaggaacagacttcacactaacaatatcctcactacaacctgaagacgtagcaacatactactgcctacaatcagactcactaccatacacattcggacaaggaacaaaagttgaaataaaaagaacagtagccgcaccatcagtattcatattcccaccatcagacgaacaactaaaatcaggaacagcatccgtcgtatgcttactaaacaacttctacccacgagaagcaaaagtacaatggaaagtcgataacgcattacaatcaggaaactcgcaagaatcagtaacagaacaagactccaaagactcaacctactcactatcatcaacactaacactatcaaaagcagactacgaaaaacacaaagtatatgcatgcgaagtcacacaccaaggcttatcctcacccgtaaccaaatcattcaacagaggagaatgc

SEQ ID NO: 46352 - RNA, 1353 nt, synthetic construct
  misc_feature 1..1353: note = derived and/or modified sequence opt6 from Lanadelumab_HeavyChain1
  source 1..1353: mol_type = other RNA
gaagtacaactactagaatcaggaggaggactagtacaaccaggtggttcacttagattatcatgcgcagcttctggttttacattctcacactacataatgatgtgggtaagacaagccccaggaaaaggactagaatgggtatcaggaatctattcctctggaggaataacagtatacgcagattccgtaaaaggaagatttacaatatcaagagataactcaaaaaacacactctatttacaaatgaacagtcttagggcagaagacacagcagtatactactgcgcctacagacgaataggagtaccaagaagagacgaattcgatatatggggacaaggaactatggttacagtatcatcagcatcaacaaaaggaccctcagtatttcccctagctccctcatcaaaatcaacatcaggaggaacagcagctttaggatgccttgtaaaagattatttcccagaaccagtaacagtatcatggaattctggagctttaacatcaggagtacacacttttccagccgttctacaatcctcaggattatactctttatcttcagtagtaacagtcccaagctcatcattaggaacacaaacctacatatgtaacgtaaatcataaaccatcaaacactaaagtcgacaagagagtcgaaccaaaatcctgcgataaaactcacacatgccccccatgtccagcaccagaactattaggcggaccatcagtatttctattccctcccaaaccaaaggataccttaatgatatcaagaaccccagaagtcacatgcgtagttgtagatgtatcacatgaagaccctgaagtaaaattcaactggtacgttgatggcgtagaagtacacaacgccaaaaccaaaccaagagaagaacaatacaactcaacatacagagtagtaagtgtattaacagtattacatcaagactggctaaatggaaaagaatataaatgtaaagtatcaaacaaagcactaccagcaccaatagaaaaaacaatttccaaagctaaaggacaaccaagagaaccccaagtatacacactcccaccctcaagagaagaaatgacaaaaaatcaagtatcccttacatgcctagtaaaaggattttatccatcagatatagcagtagaatgggaatctaacggacaaccggaaaacaactataaaacaacaccaccagtactagattcagatggatcatttttcttatactcaaaactcacagtagataaatcaagatggcaacaagggaacgtattttcatgctcagtaatgcacgaagccttacacaaccattacacacaaaaatcattatcactatccccagga

SEQ ID NO: 46353 - RNA, 639 nt, synthetic construct
  misc_feature 1..639: note = derived and/or modified sequence opt6 from Lanadelumab_LightChain1
  source 1..639: mol_type = other RNA
gacatacaaatgacacaatcaccctcaacattatctgcatcagtcggagacagagtaacaataacatgcagagcctcacaatcaatatcaagctggctagcatggtatcaacaaaaaccaggaaaagcccctaaattactaatatacaaagcatcaacattagaatcaggagtcccatcaagattctccggatcaggatcaggaaccgaattcacactaacaatatcaagcctacaaccagacgacttcgcaacatactactgccaacaatacaacacatactggaccttcggacaaggaaccaaagtagaaataaaaagaacagtagcagcaccatcagtattcatatttccaccatcagatgaacaactaaaatcaggcaccgcatcagtagtatgcctattaaacaacttctacccaagagaagcaaaagtacaatggaaagtagacaacgcattacaatcaggaaactcacaagaatcagtaacagaacaagactcaaaagactcaacatactcactatcatcaacactaacattatcaaaagcagactacgaaaaacataaagtatacgcatgcgaagtaacacaccaaggactatcatcaccagtaacaaaatccttcaatagaggagaatgc

SEQ ID NO: 46354 - RNA, 1317 nt, synthetic construct
  misc_feature 1..1317: note = derived and/or modified sequence opt6 from Landogrozumab_HeavyChain1
  source 1..1317: mol_type = other RNA
gaagtacaactagtagaatcaggaggaggattagtacaaccaggaggttcattaagactatcatgtgcagcatctggtttaacatttagtagatatcctatgtcatgggtaagacaagcaccaggtaaaggcctagtttgggtatccgccataacatcatctggaggatcaacttactattcagatactgttaaaggccgatttacaatttcaagagataacgcaaaaaacactttatacctacaaatgaattcattaagagcagaagacacagcagtatactattgtgctagactgcctgactattggggacaaggtacactcgtaacagtatcttccgcatcaacaaaaggaccatccgtatttccattagcaccctgctcccgaagcacatctgaatctactgcagccttaggatgtttagtaaaagattactttccagaacccgttacagtatcatggaactctggagcactcacctctggtgtccatacatttcctgcagttttgcaatcatcaggcctatactctttatcttcagtagtaacagtaccatcctcttcattaggaaccaaaacatatacatgcaacgttgaccataaaccctctaacacgaaagttgacaaaagagtagaatcaaaatacggcccaccttgcccaccttgtccagccccagaattcttaggaggcccatctgtatttttattcccacctaaacctaaagacaccttaatgatatcaagaacaccagaagttacatgcgtagtcgtagatgtatcacaagaagatccagaagtacaattcaactggtacgttgacggagtagaagtacacaatgccaaaacaaaacccagagaagaacaatttaactccacttaccgagttgtttcagtattaacagtacttcaccaagattggttaaatggaaaagaatacaaatgtaaagtttccaataaaggattaccatcatcaatagaaaaaactatatcaaaagctaaaggacaaccacgagaaccacaagtatataccttaccaccttctcaagaagaaatgacaaaaaatcaagtttcattaacctgtctagtaaaaggcttttacccatcagatattgcagtagaatgggaatcaaacggacaacctgaaaataattataaaacaacccctccagtactagattcagatggatcattctttctatactcaagactaacagtagataaatctcgttggcaagaaggaaacgtattttcatgctcagtcatgcatgaagctctccataaccattatactcaaaaatcattatcactctcattagga

SEQ ID NO: 46355 - RNA, 645 nt, synthetic construct
  misc_feature 1..645: note = derived and/or modified sequence opt6 from Landogrozumab_LightChain1
  source 1..645: mol_type = other RNA
gaaatagtacttacacaatcaccaggaacactatcactatcaccaggagaacgagcaacactttcctgcagagcatcatcatcagtatcatcatcatacctacactggtaccaacaaaaacccggacaagcaccaagattactaatatactcaacatcaaacctagttgcaggaataccagacagattctcaggatcaggctccggaaccgacttcacactaacaatatcaagactagaaccagaagacttcgcagtatactactgtcaacaccactcaggataccacttcacattcggaggaggaacaaaagtcgaaataaaaagaacagtagcagcaccctcagtattcatattcccaccatcagatgaacaactaaaatcaggcacagcatcagtagtatgcctactaaacaacttctatcctagagaagcaaaagtacaatggaaagtagacaatgcattacaatccggaaattcccaagaatcagtaacagaacaagactcaaaagactcaacatactcactatcatcaacattaacactatccaaagcagactacgaaaaacacaaagtatacgcatgcgaagtcacacaccaaggcttatcatcaccagtaacaaaatcattcaacagaggcgaatgc

SEQ ID NO: 46356 - RNA, 1344 nt, synthetic construct
  misc_feature 1..1344: note = derived and/or modified sequence opt6 from Laprituximab_emtansine_HeavyChain1
  source 1..1344: mol_type = other RNA
caagtacaactagtacaaagtggcgcagaagtcgcaaaaccaggagcttcagtaaaactatcatgtaaagcatcagggtacactttcacatcatactggatgcaatgggtaaaacaaagacctggacaaggactcgaatgtattggaaccatttatccaggagatggtgatactacatacacccaaaaattccaaggaaaagctacactcacagcagacaaatcttcctctacagcttatatgcaactatcatcactacgatctgaagactccgcagtatactactgtgcacgatatgatgccccaggatatgcaatggactattggggacaaggaactttagtaacagtatcatcagcttctacaaaaggaccaagcgtattcccattagctccatcatctaaatcaacatctggcggaacagcagcactaggatgcctagtcaaagactatttcccagaaccagtaacagtatcttggaactcaggcgcattaacatcaggtgtacacacattcccagcagtactacaatcatcaggattatactcattatcatcagtagtaacagtaccatcatcctccttaggaacacaaacatacatatgcaacgtcaaccataaaccatccaatacaaaagtagataaaaaagtagaacccaaatcttgtgacaaaacacatacatgtcctccatgtcctgcaccagaattattaggtggaccatccgtatttttatttccaccaaaaccaaaagatacattaatgatatctcgaacaccagaagtaacatgcgttgtagtagacgtatcacatgaagacccggaagtaaaatttaactggtacgtcgatggtgtagaagtacataacgcaaaaacaaaaccaagagaagaacaatacaattcaacatatcgcgtagtttcagtactaacagtactacatcaagactggctaaatggcaaagaatacaaatgcaaagtatcaaataaagcactacccgcaccaatagaaaaaactatatctaaagccaaaggacaaccaagagaaccacaagtttacacactaccaccatcacgagatgaattaacaaaaaaccaagtaagcttaacatgcctagttaaaggcttctacccatcagacatagcagtagaatgggaatcaaacggccaaccagaaaacaattataaaacaaccccccctgtactagattcagacggatcattctttctatactccaaattaaccgtagataaatccagatggcaacaaggaaacgtcttctcttgttcagtaatgcatgaagcactacataaccactatactcaaaaaagcttaagcctatcacctgga

SEQ ID NO: 46357 - RNA, 642 nt, synthetic construct
  misc_feature 1..642: note = derived and/or modified sequence opt6 from Laprituximab_emtansine_LightChain1
  source 1..642: mol_type = other RNA
gacatacaaatgacacaatcaccctcctccttatcagcatcagtaggagacagagtaacaataacatgcagagcatcacaagacataaacaactacttagcatggtaccaacacaaaccaggaaaaggaccaaaactcttaatccactacacatcaacattacacccaggaataccatcaagattctcaggatcaggatcaggaagagactactcattctcaatatcctcactagaaccagaagacatagctacatactactgcctacaatatgacaacctactatacacattcggacaaggaacaaaattagaaataaaaagaacagtcgcagcaccatccgtattcatattcccaccatcagacgaacaactaaaatcaggaacagcatcagtagtatgcctactaaacaacttctacccaagagaagcaaaagtacaatggaaagtagacaacgcattacaatcaggaaactcacaagaatcagtaacagaacaagactcaaaagactcaacatactcactatcatcaacactaacactatcaaaagccgactacgaaaaacacaaagtatacgcatgcgaagtaacacaccaaggactatcctcaccagtaaccaaaagcttcaacagaggagaatgc

SEQ ID NO: 46358 - RNA, 1314 nt, synthetic construct
  misc_feature 1..1314: note = derived and/or modified sequence opt6 from Lealesoab_HeavyChain1
  source 1..1314: mol_type = other RNA
caagtacaactacaagaatcaggaccagaattaaaaaaaccaggtgaaacagtaaagatatcatgcaaagcctcaggatacacatttagaaactatggaaactgggtcaaacaagcaccaggcaaaggactaaaatggggatggataaacacatacacaggcgaacccacatacgcagatgattttaaaggacgcttcgcattctcactagaaacatcagcatcaacagcatacctacaaattaacaacgtaaaaaacgaagatacagcaacctacttctgcgcaagaaaaggatgggattttaacggatcatcacttgactactggggacaaggaaccacagtaacagtatcatctgcaaaaacaacccccccatctgtatacccattagcaccaggatccgcagcccaaactaacagcgtaacattaggctgcctagtaaaaggctacttcccagaaccagtcacagtcacatggaattctggatcactatcttccggcgttcatacatttccagcagtactacaatctgatttatacacactatcatcctcagtaaccgtaccaagttccccaagaccatcagaaaccgtaacatgcaacgtagcacatccagcatcatcaacaaaagttgacaaaaaaatcgtaccaagagattgcggatgcaaaccatgcatatgcacagtcccagaagtatcatccgtctttatttttccacctaaaccaaaggacgtattaacaataacattaacaccaaaagtaacatgtgtagtagtagacataagcaaagacgacccagaagtccaattctcctggttcgttgacgacgtagaagtccacacagcccaaacacaaccaagagaagaacaatttaactcaacattcagatcagtctcagaattaccaatacaccaagactggctaaacggcaaagaattcaaatgcagagtaaactccgcagcattcccagcaccaatagaaaaaacaataagcaaaacaaaaggaagaccaaaagctccacaagtatacacaatacccccaccaaaagaacaagctaaagacaaagtttcactaacatgcataaccgattttttcccagaagatataacagtagaatggcaatggaacggacaaccagcagaaaattataaaaacacacaaccaatcaacaccaatggatcctactttgtatactcaaaattaaacgtacaaaaatcaaactgggaagcaggaaatacatttacctgttcagtattacacgaaggactacataaccatcatacagaaaaatcactatcccactcaccaggcaaa

SEQ ID NO: 46359 - RNA, 654 nt, synthetic construct
  misc_feature 1..654: note = derived and/or modified sequence opt6 from Lealesoab_LightChain1
  source 1..654: mol_type = other RNA
gacatacaactaacacaaacaccactatcactaccagtaagcctaggagaccaagcatcaatatcatgcagatcatcacaatcaatagtacattcaaacggcaacacatacctcgaatggtacctacaaaaaccaggtcaatccccaaacttactaatatacaaagtatcaaacagattctcaggagtaccagacagattctcaggctcaggatcaggaaccgatttcacattaaaaatatcacgagtagaagcagaagaccttggagtatactactgcttccaaggatcacacgtaccaccaacattcggaggaggaacaaaactagaaataaaacgagccgacgcagcaccaacagtatcaatattcccaccatcatcagaacaactaacatcaggaggagcatcagtagtatgcttcctaaacaacttttacccaaaagacataaacgtaaaatggaaaatagacggatcagaaagacaaaacggagtactaaactcatggacagaccaagactcaaaagattcaacatactcatcatccacactaacactaacaaaagacgaatacgaacgccacaactcatacacatgcgaagcaacacacaaaacaagcacatcaccaatagtaaaatcattcaacagaaacgaatgc

SEQ ID NO: 46360 - RNA, 1335 nt, synthetic construct
  misc_feature 1..1335: note = derived and/or modified sequence opt6 from Lebrikizumab_HeavyChain1
  source 1..1335: mol_type = other RNA
caagtaacactaagagaatccggccccgccctcgtaaaaccaacacaaaccctaacattaacatgcactgtatcaggcttctctctttctgcatactcagtaaactggataagacaaccaccaggaaaagcattagaatggttagcaatgatatggggagacggcaaaatagtatacaacagcgccttaaaaagccgcctaacaatatcaaaagatacatcaaaaaaccaagtggtattaaccatgacaaatatggatccagtagacacagccacatactactgcgcaggagacggatattacccatacgctatggacaactggggacaaggaagtttagtaacagtatcatcagcatcaacaaaaggaccctcagtattcccactcgcaccatgctcaagatcaactagtgaatcaacagctgcattaggatgcttagtcaaagattattttccagaaccagtcaccgtttcttggaattcaggagccctaacgtcgggagtacacaccttcccagccgtcctacaatcatcaggtctatactccttatcatctgtagtcacagttccatcttcatcattaggtacaaaaacatacacatgcaacgtagaccacaaaccatccaatacaaaagtagacaaacgcgtagaatctaaatacggaccaccatgccccccatgcccagcacctgaattcctaggaggaccatcagtattcctattcccaccaaaaccaaaagacactttaatgatatcaagaacaccagaagtcacctgcgtagtcgtcgacgtctcacaagaagatccagaagtacaattcaactggtatgtagacggtgtagaagtccataatgcaaaaacaaaaccaagagaagaacaattcaattcaacatacagagtagtctcagttctaacagtcttacaccaagactggctaaacggaaaagaatacaaatgcaaagtatcaaacaaaggattaccctcttccatagaaaaaacaatatctaaagccaaaggacaacctagagaacctcaagtatatacattaccaccatcacaagaagaaatgaccaaaaaccaagtatccttaacatgtttagtaaaaggattttatccatcagacatagcagttgaatgggaatccaacggacaacccgaaaacaattataaaactacaccaccagtactcgactcggatggatccttttttctatactcacgtttaacagtagataaaagccgatggcaagaaggaaatgtattctcatgctcagtcatgcacgaagctttacacaaccactacactcaaaaatcactatcattatcactcggaaaa

SEQ ID NO: 46361 - RNA, 654 nt, synthetic construct
  misc_feature 1..654: note = derived and/or modified sequence opt6 from Lebrikizumab_LightChain1
  source 1..654: mol_type = other RNA
gatattgtaatgacacaatcacccgatagcctatcagtaagcttaggcgaaagagcaacaataaactgcagagcaagcaaaagcgtagactcatacgggaactcattcatgcactggtaccaacaaaaaccaggacaaccaccaaaattattaatatatctagcaagtaacctagaaagcggagtaccagacagattctcaggatcaggatcaggaacagactttactttaacaataagctcacttcaagcagaagacgtagcagtatactattgccaacaaaacaatgaagacccacgaacatttggaggaggaaccaaagtagaaataaaaagaacagtagcagcaccaagcgtcttcatatttccaccatcagacgaacaattaaaatcaggaacagcctcagtagtatgcttactcaataacttttacccaagagaagcaaaagtacaatggaaagtagacaacgcattacaatcaggaaactcacaagaatcagtaacagaacaagattcaaaagactcaacatacagtttaagttcaacattaacactaagcaaagcagactacgaaaaacataaagtatatgcatgcgaagtcacacaccaaggcttaagctcacccgtaacaaaaagttttaacagaggagaatgc

SEQ ID NO: 46362 - RNA, 1227 nt, synthetic construct
  misc_feature 1..1227: note = derived and/or modified sequence opt6 from Lenercept_chain1
  source 1..1227: mol_type = other RNA
ctagtaccacacctaggagacagagaaaaaagagactcagtatgtccacaaggtaaatacatacaccctcaaaacaactccatatgctgcacaaaatgtcacaaaggaacatacctatataacgactgcccaggaccaggacaagatacagactgcagagaatgcgaatcaggctcattcacagcttcagaaaatcacttaagacactgcttatcatgctcaaaatgcagaaaagaaatgggccaagtcgaaatatcctcatgcaccgttgatagagacacagtatgtggatgtagaaaaaaccaatataggcattactggtcagaaaacttattccaatgcttcaattgctccctatgcctaaatggaaccgtacacctatcctgccaagaaaaacaaaacacagtatgcacctgtcacgctggattcttcctaagagaaaacgaatgcgtctcatgcagcaactgcaaaaaatcattagaatgcacaaaactctgtctaccacaaatagaaaacgtaaaaggaaccgaagactcaggaacaaccgacaaaactcatacatgccccccatgcccagcacccgaactactaggaggaccaagcgtatttctcttcccaccaaaaccaaaagatacactcatgatctcccgcacaccagaagtaacatgtgttgtagtagatgtatcacacgaagacccagaagtcaaattcaactggtatgtcgacggcgtcgaagtacataacgcaaaaacaaaaccaagagaagaacaatacaactccacataccgcgtagtatcagtactcacagtactacaccaagactggctaaacggcaaagaatacaaatgtaaagtaagcaacaaagcattaccagcaccaatagaaaaaaccatatcaaaagccaaaggacaaccaagagaaccccaagtatacacattaccaccatcaagagaagaaatgaccaaaaaccaagtctccctaacatgtctcgtaaaaggcttctatccatcagacatagcagtagaatgggaatcaaatggccaacctgaaaacaactacaaaacaactccaccagtactagactcagacggctccttctttttatattcaaaactaacagttgataaatcaaggtggcaacaaggcaacgtcttttcctgctcagtaatgcacgaagccttacacaatcattacacacaaaaatcactatcactatcaccaggtaaa

SEQ ID NO: 46363 - RNA, 1347 nt, synthetic construct
  misc_feature 1..1347: note = derived and/or modified sequence opt6 from Lenzilumab_HeavyChain1
  source 1..1347: mol_type = other RNA
caagtacaattagtacaatccggtgcagaagtaaaaaaacccggagcatccgtaaaagtctcatgcaaagcatcaggatactctttcacaaactactacatccattgggtaagacaagcacccggtcaaagactcgaatggatgggttggataaatgcaggaaacggaaacacaaaatattcacaaaaattccaaggaagagtaacaataacaagagacacctcagcatcaacagcatacatggaactatcatccctcagatcagaagatacagcagtctactactgtgttagacgacaacgtttcccatactacttcgactactggggacaaggaacactagttacagtctcatcagcatcaacaaaaggcccttccgtcttcccactcgcaccatcctcaaaatcaacatccggaggaacagcagcactcggatgcctagtaaaagattactttcctgaaccagtaaccgtatcatggaattctggcgctctaacttccggagtacacacattccccgcagtactacaatcatcaggcttatactccctttcatcagtagtcacagtaccctcatcatcacttggcacacaaacatacatatgcaacgtaaaccacaaaccatctaacaccaaagtagataaaagagtcgaacctaaatcttgcgacaaaactcacacctgccccccatgcccagcaccagagctattaggtggcccctcagtattcctattcccaccaaaacctaaagacacactcatgatatcaagaacacccgaagtaacatgtgtagtagttgacgtatcccacgaagatccagaagtaaaattcaactggtatgtcgacggagttgaagtacataatgcaaaaactaaaccacgagaagaacaatacaactcaacatacagagtagtatcagtattaacagtccttcaccaagactggttaaatggcaaagaatacaaatgcaaagtatcaaacaaagcattaccagcacctatagaaaaaacaatctccaaagcaaaaggccaacccagagaaccacaagtatatacactaccaccatcaagagaagaaatgactaagaaccaagtatctctcacatgcctagtcaaaggattttacccatcagacatagcagtagaatgggaatcaaatggacaacctgaaaacaattacaaaacaaccccaccagtcttagactcagatggttccttcttcctatattcaaaactcacagtagacaaatcaagatggcaacaaggcaacgtattctcatgctcagtaatgcacgaagcacttcataaccattacacacaaaaatcattatcactatcaccaggaaaa

SEQ ID NO: 46364 - RNA, 642 nt, synthetic construct
  misc_feature 1..642: note = derived and/or modified sequence opt6 from Lenzilumab_LightChain1
  source 1..642: mol_type = other RNA
gaaatcgtactaacacaatcaccagcaacattatcagtatcaccaggagaaagagcaaccttatcatgcagagcatcccaatcagtaggaacaaacgtagcatggtaccaacaaaaaccaggacaagcaccaagagtcttaatatactcaacatcatcaagagcaacaggaataacagacagattctccggatccggatcaggaacagacttcacactaaccatatcaagactagaaccagaagacttcgcagtatactactgccaacaattcaacaaatcaccactaacattcggaggaggaacaaaagtagaaataaaaagaacagtagcagccccaagcgtattcatattcccaccatcagacgaacaattaaaatcaggaacagcatcagtagtatgcctactaaacaacttctaccccagagaagcaaaagtacaatggaaagtagacaacgcactacaatcaggaaactcacaagaatcagtaacagaacaagactcaaaagactcaacatattcactatcatccaccctaacactaagcaaagcagactacgaaaaacacaaagtatacgcatgtgaagtaacacaccaaggactatcatcaccagtaacaaaatcattcaacagaggagaatgc

SEQ ID NO: 46365 - RNA, 1326 nt, synthetic construct
  misc_feature 1..1326: note = derived and/or modified sequence opt6 from Lerdelimumab_HeavyChain1
  source 1..1326: mol_type = other RNA
gaagtacaactagtagaatcaggaggaggagtagtacaaccaggaagatctttaagactatcatgtgcggcaagcggattcacctttagcagttacggaatgcactgggtaagacaagcacccggaaaaggattagaatgggtagcagtaatatggtacgatggatcaaataaatactatgcagactcagtcaaaggaagattcacaataagtagagataatagcaaaaacaccctatatttacaaatggactcactaagagcagaagatacagcagtttattattgcggacgaacattagaatcatcactttggggacaaggaaccctagttacagtatcatccgctagcaccaaaggaccatcagtattcccattagctccatgcagtagaagtacctcagaatcaacagctgcattaggttgtctagtaaaagattattttccagaaccagtaacagtaagttggaactccggagcattaacaagtggagtacatactttcccagcagtactacaaagctcaggtctatattcactctcatcagtagtaacagtcccatcatccagcctaggaacaaaaacatatacctgtaacgtagaccacaaaccttccaacacaaaagtagataaacgagtagaatcaaaatatggaccaccttgtccttcatgtccagctccagaattcttaggaggaccatcagtatttttattcccaccaaaaccaaaagatacattaatgatatcaagaacccccgaagtaacatgtgtcgttgtagatgtatctcaagaagacccagaagtacaatttaactggtatgtagatggagtagaagtacataacgcaaagacaaaacccagagaagaacaatttaattccacataccgagtagtctcagtattaactgtattacatcaagattggctaaatggaaaagaatataaatgtaaagtaagcaataaaggtctacctagttcaatagaaaaaacaatatcaaaagcaaaaggacaaccaagagaaccacaagtctatacattaccaccaagccaagaagaaatgacaaaaaatcaagtatccctaacatgcctcgtaaaaggattttatccatcagacatagcagtagaatgggaatctaacggacaaccagaaaataattataaaacaacaccacctgtattagactcagatggatcattctttctatatagcagactaacagtcgataaatcacgatggcaagaaggaaacgtattctcatgttcagtaatgcacgaagctctacacaatcactacacacaaaaaagcttatcattatcactaggcaaa

SEQ ID NO: 46366 - RNA, 645 nt, synthetic construct
  misc_feature 1..645: note = derived and/or modified sequence opt6 from Lerdelimumab_LightChain1
  source 1..645: mol_type = other RNA
tcatcagaactaacacaagacccagcagtatcagtagcactcggtcaaaccgtaagaataacatgccaaggagactccttaagatcatactacgcttcatggtaccaacaaaaaccaggacaagcaccagtactagtaatctacggaaaaaacaacagaccatcaggaataccagacagattctcaggatcatcttcaggaaacacagcatcactaacaatcacaggagcacaagcagaagatgaagcagactactactgcaattcaagagactcatcatcaacacacagaggagtattcggcggaggaacaaaactaacagtattaggacaaccaaaagcagcaccatcagtaacactattcccaccatcctccgaagaattacaagcaaacaaagcaacattagtatgcctaatatcagacttctaccccggcgcagtaacagtagcatggaaagcagactcatcaccagtaaaagcaggagtagaaacaacaacaccatcaaaacaatcaaacaacaaatacgcagcatcatcatacctatcactaacaccagaacaatggaaatcacacagatcatactcatgtcaagtaacacacgaaggatcaacagtagaaaaaacagtagcaccaacagaatgctcc

SEQ ID NO: 46367 - RNA, 1353 nt, synthetic construct
  misc_feature 1..1353: note = derived and/or modified sequence opt6 from Lexatumumab_HeavyChain1
  source 1..1353: mol_type = other RNA
gaagtacaattagtacaaagcggcggaggagtagaaagaccaggaggaagtcttagactatcatgcgccgcctcaggatttacattcgacgactacggaatgagctgggtacgacaagcccccggaaaaggtttagaatgggtatcaggaataaattggaatggaggatcaacaggctacgcagactcagttaaaggaagggttacaatatctagagacaatgcaaaaaactccttatatctacaaatgaatagtttaagagccgaagatacagctgtatattactgtgcaaaaatcctaggtgcaggacgaggatggtactttgatttatggggtaaaggtacaacagtaacagtctcttctgccagcacgaaaggaccatcagtattccccttagcaccaagttcaaaatcaacatctggcggaactgctgccttaggatgtttagttaaagattactttccagaaccagtaaccgtatcttggaacagtggagctttaacaagcggcgtacatacttttccagcagtattacaaagctcaggactatactcactaagtagtgtagtaacagtaccaagttcatcactcggcacacaaacttatatatgcaacgtaaatcacaaaccaagtaatacaaaagtagacaaaagagtagaaccaaaatcatgtgacaaaacacatacatgtcctccatgccccgcaccagaactgctaggaggaccatcagtattcctattccccccaaaaccaaaagacacattaatgatatccagaactccagaagtaacatgcgtagtagtagacgtatcccatgaagatccagaagtaaaattcaattggtatgtcgatggagtagaagtacacaatgcaaaaacaaaaccaagagaagaacaatataatagtacatatagagtagtatcagtcttaacagtattacatcaagactggcttaatggcaaagaatataaatgtaaagtcagtaacaaagcacttccagccccaatagaaaaaacaatatccaaagcaaaaggacaaccaagagaacctcaagtttacacgctaccaccatcaagagaagaaatgacaaaaaaccaagtatctctcacatgcttagtcaaaggcttttacccatcagacatagcagtcgaatgggaatcaaatggacaaccagaaaacaactacaaaacaactccacctgtattagactctgatggttcatttttcttatattcaaaattaacagttgataaatcacgatggcaacaaggaaacgtattttcatgcagtgtcatgcacgaagccctacataaccactatacacaaaaatcactaagtctatcaccaggaaaa

SEQ ID NO: 46368 - RNA, 1353 nt, synthetic construct
  misc_feature 1..1353: note = derived and/or modified sequence opt6 from Lexatumumab_HeavyChain
  source 1..1353: mol_type = other RNA
gaagtacaattagtacaatcaggaggaggagtcgaacgaccaggaggatcattaagattatcatgtgcagcaagcggatttacatttgatgactatggaatgagctgggtcagacaagctccaggaaaaggcttagaatgggtatcaggtataaattggaatggcggatcaacaggatacgcagatagtgttaaaggaagagtaactatatcaagagacaatgcaaaaaatagtctatacctccaaatgaattccctaagagcagaagatacagctgtatactattgtgcaaaaatcctaggagcaggaagaggatggtacttcgatctatggggaaaaggtacaacagtcacagtcagctcagcttcaacaaaaggaccatcagtttttccacttgcaccatcatcaaaatcaacatccggaggaactgcagcacttggatgtttagtaaaagattacttcccagaacccgtaacagtatcatggaactcaggagctctaacctcgggagtacatacctttcccgcagttttacaaagcagcgggctatatagtctatcatcagtagtaacagtccccagctcaagcttaggaacacaaacttacatatgtaacgtaaaccataaaccatcaaatactaaagtagataaaagagtagaacccaaatcatgcgacaaaacacatacatgtcctccatgcccagctccagaactactaggaggacctagcgtatttctcttccctccaaagccaaaagacacactaatgatatcaagaacaccagaagtaacatgcgttgtagtagatgtatcacacgaagatccagaagtaaaattcaactggtatgtagacggagttgaagtacacaatgcaaaaacaaaaccaagagaagaacaatataattcaacatatagagtagtctctgtactaaccgtactacatcaagattggctaaatggtaaagaatacaaatgcaaagtttctaacaaagcattaccagcacctatagaaaaaaccataagtaaagctaaaggacaaccacgagaaccacaggtatacacattacctccatcaagagaagaaatgacaaaaaaccaagtctctctcacatgcctagtaaaaggattctatccatcagacatagcagtagaatgggaaagtaacggacaacctgaaaacaactataaaacaacaccacctgtattagactcagatggaagttttttcctatacagtaaattaacagtagacaaatcaagatggcaacaaggaaacgtgttttcatgctcagtaatgcacgaagcactccacaatcactatacccaaaaatcactatcattaagtccaggaaaa

SEQ ID NO: 46369 - RNA, 642 nt, synthetic construct
  misc_feature 1..642: note = derived and/or modified sequence opt6 from Lexatumumab_LightChain1
  source 1..642: mol_type = other RNA
tcttcagaattaacacaagacccagcagtatctgtagcattaggacaaacagtaagaataacatgccaaggagacagcttaagatcatactacgcctcatggtaccaacaaaaaccaggacaagccccagtactagtaatatacggaaaaaataacagaccatcaggaataccagaccgattcagcggatcttcaagcggaaacacagccagtctaacaataacaggagcacaagcagaagacgaagcagactattactgcaactcaagagactcatcaggaaaccacgtagtattcggaggaggaacaaaactaacagtactaggacaaccaaaagcagcaccatcagtaacactatttcctccatcatcagaagaattacaagcaaacaaagcaacactagtatgcttaatatctgacttctacccaggagcagtaacagtagcatggaaagcagactcatcaccagtaaaagcaggagtagaaaccacaacaccatcaaaacaatcaaataacaaatacgcagcatcatcttacctatcacttacaccagaacaatggaaatcacacagatcatactcatgtcaagtaacacacgaaggctcaacagtagaaaaaacagtagccccaaccgaatgctca

SEQ ID NO: 46370 - RNA, 642 nt, synthetic construct
  misc_feature 1..642: note = derived and/or modified sequence opt6 from Lexatumumab_LightChain
  source 1..642: mol_type = other RNA
tcatcagaactaactcaagacccagcagtatcagtagcacttggacaaacagtaagaataacatgccaaggcgactcactacgatcatactacgcatcatggtaccaacaaaaaccaggacaagcaccagtattagtaatatacggaaaaaacaacagaccatcaggaataccagacagattctcaggatcatcaagcggcaacacagcatcactaacaataacaggagcacaagctgaagacgaagcagactactactgcaactcaagagactcatcaggaaaccacgtagtatttggcggaggaactaaactaacagtattaggacaaccaaaagcagcaccatcagtaacattattccccccatcatcagaagaactacaagcaaacaaagcaacactagtatgcctaatctcagacttctacccaggagcagtaacagtagcctggaaagcagacagctcaccagtaaaagcaggcgtagaaaccacaacaccatcaaaacaatcaaacaacaaatacgctgcatcaagctacttatcactaacacccgaacaatggaaatcacacagatcatacagctgccaagtaacacacgaaggatcaacagtagaaaaaacagtagcaccaaccgaatgctca

SEQ ID NO: 46371 - RNA, 1377 nt, synthetic construct
  misc_feature 1..1377: note = derived and/or modified sequence opt6 from Libivirumab_HeavyChain1
  source 1..1377: mol_type = other RNA
caagtccaattagtagaatcaggaggaggagtagtaagacctggcagatcactacgactatcatgtgcagcatccggattcgcattctcagattattcaataaattgggtaagacaagctccaggtaaaggactagaatgggtagcaataatatcttatgatggaagaataacttactaccgagactcagtaaaaggaagatttaccatatccagagacgattcaaaaaataccctatatctccaaatgaattcactaagaacagaagacaccgctgtatattactgtgccagacaatattatgatttctggtcaggatcaagcgttggccgcaattacgatggaatggacgtatggggtctaggaacaacagtaacagtatcatcagcctcaacaaaaggaccatcagtatttccattagcaccatcatctaaatcaacatcaggaggaacagcagcactaggatgtctagtaaaagattacttccccgaacccgtcaccgtatcctggaactcgggagcactaacatcaggagtacatacattcccagcagtattacaatcatccggtctatatagcttaagttcagtagtaaccgtaccttcaagctcattaggaacacaaacctacatatgcaatgtgaaccacaaaccttcaaacacaaaagtagataaaagagtagaacctaaatcgtgtgacaaaacacatacatgcccaccttgcccagcaccagaattactcggaggacccagcgtttttcttttcccaccaaaaccaaaagacacactaatgatatcaagaacacccgaagtaacatgcgttgtagtagacgttagtcatgaagatcctgaagtaaaatttaactggtatgtcgatggagtagaagttcacaacgcaaaaaccaaacctagagaagaacaatataattcaacatacagagttgtatctgtccttacagtattacaccaagactggttaaacggtaaagaatacaaatgtaaagtatcaaacaaagccctaccagcaccaatagaaaaaacaatatcaaaagcaaaaggacaaccacgagaaccccaagtatatacactaccaccatcaagagaagaaatgacaaaaaaccaagtatcactaacctgtttagtaaaaggattctacccatcagacatagcagtagaatgggaaagtaatggacaaccagaaaataactacaaaacaacaccaccagtactagactcagacggatcattttttctatactcaaaactcacagtagacaaatcaagatggcaacaaggaaacgtcttctcctgctcagtaatgcatgaagcattacacaaccactatacacaaaaatcactttcactctcaccaggcaaa

SEQ ID NO: 46372 - RNA, 657 nt, synthetic construct
  misc_feature 1..657: note = derived and/or modified sequence opt6 from Libivirumab_LightChain1
  source 1..657: mol_type = other RNA
gacatagtaatgacacaatcaccattatcattatcagtaacaccaggagaaccagcttcaatatcatgcagatcatcacaatctctactacatagatcaggaaataactacctagattggtacctacaaaaacccggacactcaccacaactactaatatatgtaggatcaaaccgagcatcaggagtaccagacagattctcaggatcaggatcaggaacagaatacaccctaaaaatatcaagagtagaagcagaagacgtaggagtatactactgcatgcaagcactacaaacaccacgaacattcggacaaggaaccaaactagaaataaaaagaacagtagctgcaccaagcgtattcatattcccaccatcagacgaacaattaaaatcaggaacagcatcagtagtatgtctactaaacaacttttacccaagagaagccaaagtacaatggaaagtagataacgcactacaatcaggaaactctcaagaatccgtaacagaacaagactcaaaagattcaacatactcactatcatcaacactcacactatcaaaagcagactacgaaaaacacaaagtatacgcatgcgaagtaacacaccaaggcctatcatcaccagtaaccaaatcattcaacagaggagaatgc

SEQ ID NO: 46373 - RNA, 1350 nt, synthetic construct
  misc_feature 1..1350: note = derived and/or modified sequence opt6 from Lifastuzumab_HeavyChain
  source 1..1350: mol_type = other RNA
gaagtacaactagtagaatcaggcggaggactagtacaacccggcggatccttaagactatcctgtgcagcaagcggattttcattttcagatttcgcaatgtcttgggtaagacaagcaccaggaaaaggactagaatgggtagcaacaataggaagagtagcattccacacatactatccagatagtatgaaaggaagattcactatttctagagacaactctaaaaacacactatacctccaaatgaactcactcagagcagaagacacagccgtctattactgtgcaagacacagaggctttgacgtaggacatttcgatttctggggacaaggcacactcgtcacagtctcatccgcatctacaaaaggcccaagtgttttccccctcgcaccatcatcaaaatctacatcaggtggaacagcagcattaggatgcctcgtcaaagattatttccctgaaccagtaacagtctcctggaactcaggagctctaacaagcggagttcacacattccctgcagtattacaatcttcaggactatactcactatcttcagtcgtcaccgtaccatcatcatcattaggaacacaaacatacatctgtaacgtaaaccataaaccatcaaacactaaagtcgacaagaaagtagaacccaagtcatgtgacaaaacacacacctgccccccatgcccagcacccgaattactaggaggaccatcagttttcctatttccacccaaacctaaagatactctaatgatatccagaacaccagaagtaacatgcgtagttgtagatgtatcccacgaagatcccgaagtaaaatttaactggtatgtagacggcgtagaagtacataatgcaaaaaccaaaccaagagaagaacaatacaattcaacatacagagtagtatcagtactaactgtcttacaccaagactggttaaacggaaaagaatacaaatgcaaagtatccaataaagcactcccagcacccatagaaaaaacaatatcaaaagccaaaggacaaccaagagaaccacaagtatatacattaccaccatcaagagaagaaatgacaaaaaaccaagtatccctaacctgcctagtaaaaggattttacccctcagatatcgctgtagaatgggaatccaatggacaacctgaaaacaactataaaacaacaccccctgtattagactcagatggatcattcttcctatactctaaactaacagtagataaatcacgatggcaacaaggaaacgtcttctcctgttcagtaatgcatgaagcattacataaccattatactcaaaaatcactatcgttatcacccggaaaa

SEQ ID NO: 46374 - RNA, 657 nt, synthetic construct
  misc_feature 1..657: note = derived and/or modified sequence opt6 from Lifastuzumab_LightChain
  source 1..657: mol_type = other RNA
gacatacaaatgacacaatcaccatcatcattatcagcatcagtaggagacagagtaacaataacatgcagatcatcagaaacattagtacactcatcaggaaacacatacctagaatggtaccaacaaaaaccaggaaaagcacccaaactactaatatatagagtatcaaacagattctcaggcgtaccatcacgattttccggctcaggatcaggaacagacttcacactcacaatatcatcactacaaccagaagacttcgcaacatactactgctttcaaggatccttcaacccattaacatttggacaaggcacaaaagtagaaataaaaagaacagtagcagcaccatcagtattcatatttccaccatcagatgaacaattaaaatcaggaacagcatcagtagtatgtctactaaacaacttctacccaagagaagcaaaagtacaatggaaagtagacaacgcactacaatcaggaaactcacaagaatcagtaacagaacaagactcaaaagactcaacatactcactctcatcaacactaaccctatcaaaagcagactacgaaaaacacaaagtatacgcatgcgaagtaacacaccaaggactatcatcaccagtaaccaaatcattcaacagaggagaatgc

SEQ ID NO: 46375 - RNA, 1347 nt, synthetic construct
  misc_feature 1..1347: note = derived and/or modified sequence opt6 from Lifastuzumab_vedotin_HeavyChain1
  source 1..1347: mol_type = other RNA
gtacaattagtagaatcaggaggaggactagtacaaccaggcggctcactacgactatcatgcgccgcatcaggattctcattcagtgatttcgccatgtcatgggtacgccaagctccaggaaaaggattagaatgggttgcaaccataggaagagtagcatttcacacatactacccagactcaatgaaaggcagatttactatatctagagataactcaaaaaatacattatacttacaaatgaattcactaagagctgaagacacagcagtatactactgcgcccgccacagaggattcgatgtaggacacttcgacttttggggccaaggaacactagtaacagtctcctcagcatcaaccaaaggaccttcagtattcccattagcaccttcatctaaatcaacatccggcggcacagccgcacttggatgtttagtcaaagactacttccccgaaccagtaacagtctcatggaactcaggagcattaacatcaggagtacacacctttcccgcagtactccaatcaagcggattatattctctatcttcagtagtaacagtaccatcatcttcactaggaacccaaacatatatatgcaatgtaaatcataaaccaagcaacacaaaagtagacaaaaaagtcgaacccaaatcatgcgacaagacacacacctgccccccttgcccagcaccagaacttttaggcggaccatcagttttcctattcccaccaaaacccaaagatacactaatgatatctagaacaccagaagtcacctgcgtagtagtagacgtatcgcacgaagatccagaagtaaaattcaactggtatgtcgacggagtagaagtacacaacgcaaaaaccaaaccacgagaagaacagtataattccacctacagagtagtatccgtcttaacagtattacatcaagactggctaaacggaaaagaatacaaatgcaaagtatctaacaaagcactaccagcaccaattgaaaaaacaatatctaaagcaaaaggacaaccacgagaaccacaagtatacacattaccaccatcaagagaagaaatgacaaaaaaccaagtctcactaacatgcctagtaaaaggattttatccatctgatatagcagtagaatgggaatcaaacggacaacccgaaaacaactacaaaaccacaccaccagtattagattctgacggatcattcttcctatattcaaaactaactgtagataaatctagatggcaacaaggaaacgtattctcctgctcagttatgcatgaagctttacacaaccactacacacaaaaatcattatctctttctccaggtaaa

SEQ ID NO: 46376 - RNA, 657 nt, synthetic construct
  misc_feature 1..657: note = derived and/or modified sequence opt6 from Lifastuzumab_vedotin_LightChain1
  source 1..657: mol_type = other RNA
gacatacaaatgactcaatcaccatcttcactctcagcatcagtaggagacagagtaacaatcacatgcagatcatcagaaacactagtacactcatcaggaaacacatacctagaatggtaccaacaaaaaccaggaaaagcaccaaaactactaatatacagagtatcaaacagattctcaggagtcccatcaagattctcaggatcaggttccggaacagacttcacactcacaatctcctcactacaaccagaagacttcgccacatactactgcttccaaggatcattcaacccactaacattcggacaaggaacaaaagtcgaaataaaaagaacagtagcagcaccatcagtattcatattcccaccatcagacgaacaactaaaatcaggaacagcatcagtagtatgcttactaaacaacttctacccaagagaagcaaaagtccaatggaaagtagacaacgcactacaatcaggaaactcacaagaatcagtcacagaacaagactcaaaagactcaacatactcactatcatcaacactaacattatcaaaagcagactacgaaaaacacaaagtatacgcatgcgaagtaacacaccaaggactatcatccccagtaacaaaatccttcaacagaggagaatgc

SEQ ID NO: 46377 - RNA, 1359 nt, synthetic construct
  misc_feature 1..1359: note = derived and/or modified sequence opt6 from Ligelizumab_HeavyChain1
  source 1..1359: mol_type = other RNA
caagtacaattagtccaatccggagcagaagtaatgaaacccggatcttcagtaaaagtttcatgcaaagcatccggctacaccttctcatggtattggttagaatgggtccgccaagcacctggccacggattagaatggatgggagaaattgatcccggaacattcacaacaaactacaacgaaaaattcaaagcacgagtcactttcactgcagacacttcaacatcaacagcatatatggaattatcctcactacgatccgaagacacagccgtatactattgcgccagattttcacacttctcaggaagtaactacgactattttgattactggggtcaaggcacattagtaacagtatcatcagcctcaactaaaggtccctcagtattcccactagcacccagttcaaaaagcacatcaggaggaaccgcagcactaggatgtctcgtaaaagactacttccctgaaccagtaacagtttcatggaactctggcgcactaacatcaggtgtacacacattccctgcagtactacaaagctcaggactatactcactatcatcagttgtaaccgtaccatcatcatcgctagggactcaaacttacatatgcaacgtaaaccacaagccgtcaaacacaaaagttgataaaaaagtagaaccaaaatcatgtgataaaacacacacatgtcccccatgtccagcaccagaactattaggtggaccatcagtatttcttttcccacctaaacccaaagacacactcatgatatccagaacaccagaagtaacatgcgttgtcgtagacgtatcacacgaagacccagaagtaaaattcaattggtatgtcgacggcgtagaagtacataatgctaaaaccaaaccacgagaagaacaatacaactccacctacagagtagtatcagtactaacagtactacaccaagactggctaaacggaaaagaatacaaatgcaaagtttcaaacaaagcactcccagcaccaatagaaaaaacaatatcaaaagcaaaaggacaaccaagagaaccacaagtctatacactacccccatctagagatgaattaacaaaaaaccaagtatcattaacatgcctagtcaaaggattctatccatccgatatagctgtagaatgggaatcaaatggccaacccgaaaataattataaaacgacaccaccagtattagactcagacggctcattcttcttatactccaaattaacagtagataaatcaagatggcaacaaggaaacgtattctcctgttcagtaatgcacgaagccttacataaccactacacacaaaaaagtctaagcctatcaccaggaaaa

SEQ ID NO: 46378 - RNA, 642 nt, synthetic construct
  misc_feature 1..642: note = derived and/or modified sequence opt6 from Ligelizumab_LightChain1
  source 1..642: mol_type = other RNA
gaaatagtaatgacacaatcaccagcaacactatccgtatccccaggagaaagagcaacattaagttgcagagcaagccaaagcataggcacaaacattcactggtaccaacaaaaaccaggacaagcaccaagactattaatatattacgcaagtgaatccataagcggaataccagcaagattctctggatcaggatccggaacagaatttacattaacaataagctcactacaaagcgaagactttgcagtatactattgccaacaatcatggtcatggccaaccacattcggaggaggaacaaaagtagaaataaaaagaacagtagcagcaccatcagtattcatattcccaccatcggacgaacaattaaaatcaggaacagcatcagtagtatgcctactaaataacttttacccaagagaagcaaaagtacaatggaaagtagataacgcactacaaagcggaaactcacaagaatcagtaacagaacaagacagcaaagactcaacatatagcctaagctctacactaacattaagcaaagctgattatgaaaaacacaaagtatacgcatgcgaagtaacacaccaaggactaagctcaccagtaacaaaaagctttaacagaggcgaatgc
